United States Patent 8,586,006 (ORGAN-SPECIFIC PROTEINS AND METHODS OF THEIR USE) - sequence listing, part 19

SEQ ID NO: 57444 - DNA, 2226 bp, Homo sapiens
ctcgacccacgcgtccgcgcgccccaggagccaaagccgggctccaagtcggcgccccacgtcgaggctccgccgcagcctccggagttggccgcagacaagaaggggagggagcgggagagggaggagagctccgaagcgagagggccgagcgccatgcgccgcgccagcagagactacaccaagtacctgcgtggctcggaggagatgggcggcggccccggagccccgcacgagggccccctgcacgccccgccgccgcctgcgccgcaccagccccccgccgcctcccgctccatgttcgtggccctcctggggctggggctgggccaggttgtctgcagcgtcgccctgttcttctatttcagagcgcagatggatcctaatagaatatcagaagatggcactcactgcatttatagaattttgagactccatgaaaatgcagattttcaagacacaactctggagagtcaagatacaaaattaatacctgattcatgtaggagaattaaacaggcctttcaaggagctgtgcaaaaggaattacaacatatcgttggatcacagcacatcagagcagagaaagcgatggtggatggctcatggttagatctggccaagaggagcaagcttgaagctcagccttttgctcatctcactattaatgccaccgacatcccatctggttcccataaagtgagtctgtcctcttggtaccatgatcggggttgggccaagatctccaacatgacttttagcaatggaaaactaatagttaatcaggatggcttttattacctgtatgccaacatttgctttcgacatcatgaaacttcaggagacctagctacagagtatcttcaactaatggtgtacgtcactaaaaccagcatcaaaatcccaagttctcataccctgatgaaaggaggaagcaccaagtattggtcagggaattctgaattccatttttattccataaacgttggtggattttttaagttacggtctggagaggaaatcagcatcgaggtctccaacccctccttactggatccggatcaggatgcaacatactttggggcttttaaagttcgagatatagattgagccccagtttttggagtgttatgtatttcctggatgtttggaaacattttttaaaacaagccaagaaagatgtatataggtgtgtgagactactaagaggcatggccccaacggtacacgactcagtatccatgctcttgaccttgtagagaacacgcgtatttacagccagtgggagatgttagactcatggtgtgttacacaatggtttttaaattttgtaatgaattcctagaattaaaccagattggagcaattacgggttgaccttatgagaaactgcatgtgggctatgggaggggttggtccctggtcatgtgccccttcgcagctgaagtggagagggtgtcatctagcgcaattgaaggatcatctgaaggggcaaattcttttgaattgttacatcatgctggaacctgcaaaaaatactttttctaatgaggagagaaaatatatgtatttttatataatatctaaagttatatttcagatgtaatgttttctttgcaaagtattgtaaattatatttgtgctatagtatttgattcaaaatatttaaaaatgtcttgctgttgacatatttaatgttttaaatgtacagacatatttaactggtgcactttgtaaattccctggggaaaacttgcagctaaggaggggaaaaaaatgttgtttcctaatatcaaatgcagtatatttcttcgttctttttaagttaatagattttttcagacttgtcaagcctgtgcaaaaaaattaaaatggatgccttgaataataagcaggatgttggccaccaggtgcctttcaaatttagaaactaattgactttagaaagctgacattgccaaaaaggatacataatgggccactgaaatctgtcaagagtagttatataattgttgaacaggtgtttttccacaagtgccgcaaattgtacctttttttttttttcaaaatagaaaagttattagtggtttatcagcaaaaaagtccaattttaatttagtaaatgttatcttatactgtacaataaaaacattgcctttgaatgttaattttttggtacaaaaataaatttatatgaaaacctgaaaaaaaaaacaaaaaaaaaaa

SEQ ID NO: 57445 - DNA, 1931 bp, Homo sapiens
gcgcctggcctattgaaggtttttaatcttcagagtttcgactttatcaacaacacttagaagccaccaaagaattgcagatggatcctaatagaatatcagaagatggcactcactgcatttatagaattttgagactccatgaaaatgcagattttcaagacacaactctggagagtcaagatacaaaattaatacctgattcatgtaggagaattaaacaggcctttcaaggagctgtgcaaaaggaattacaacatatcgttggatcacagcacatcagagcagagaaagcgatggtggatggctcatggttagatctggccaagaggagcaagcttgaagctcagccttttgctcatctcactattaatgccaccgacatcccatctggttcccataaagtgagtctgtcctcttggtaccatgatcggggttgggccaagatctccaacatgacttttagcaatggaaaactaatagttaatcaggatggcttttattacctgtatgccaacatttgctttcgacatcatgaaacttcaggagacctagctacagagtatcttcaactaatggtgtacgtcactaaaaccagcatcaaaatcccaagttctcataccctgatgaaaggaggaagcaccaagtattggtcagggaattctgaattccatttttattccataaacgttggtggattttttaagttacggtctggagaggaaatcagcatcgaggtctccaacccctccttactggatccggatcaggatgcaacatactttggggcttttaaagttcgagatatagattgagccccagtttttggagtgttatgtatttcctggatgtttggaaacattttttaaaacaagccaagaaagatgtatataggtgtgtgagactactaagaggcatggccccaacggtacacgactcagtatccatgctcttgaccttgtagagaacacgcgtatttacagccagtgggagatgttagactcatggtgtgttacacaatggtttttaaattttgtaatgaattcctagaattaaaccagattggagcaattacgggttgaccttatgagaaactgcatgtgggctatgggaggggttggtccctggtcatgtgccccttcgcagctgaagtggagagggtgtcatctagcgcaattgaaggatcatctgaaggggcaaattcttttgaattgttacatcatgctggaacctgcaaaaaatactttttctaatgaggagagaaaatatatgtatttttatataatatctaaagttatatttcagatgtaatgttttctttgcaaagtattgtaaattatatttgtgctatagtatttgattcaaaatatttaaaaatgtcttgctgttgacatatttaatgttttaaatgtacagacatatttaactggtgcactttgtaaattccctggggaaaacttgcagctaaggaggggaaaaaaatgttgtttcctaatatcaaatgcagtatatttcttcgttctttttaagttaatagattttttcagacttgtcaagcctgtgcaaaaaaattaaaatggatgccttgaataataagcaggatgttggccaccaggtgcctttcaaatttagaaactaattgactttagaaagctgacattgccaaaaaggatacataatgggccactgaaatctgtcaagagtagttatataattgttgaacaggtgtttttccacaagtgccgcaaattgtaccttttttgttttttcaaaatagaaaagttattagtggtttatcagcaaaaaagtccaattttaatttagtaaatgttatcttatactgtacaataaaaacattgcctttgaatgttaattttttggtacaaaaataaatttatatgaaaacctgaaaaaaaaaaaaaaaaaaaaaa

SEQ ID NO: 57446 - DNA, 548 bp, Homo sapiens
gccttgcagaacttctacttgcctgcctccctgcctctggccatggcctgccggtgcctcagcttccttctgatggggaccttcctgtcagtttcccagacagtcctggcccagctggatgcactgctggtcttcccaggccaagtggctcaactctcctgcacgctcagcccccagcacgtcaccatcagggactacggtgtgtcctggtaccagcagcgggcaggcagtgcccctcgatatctcctctactaccgctcggaggaggatcaccaccggcctgctgacatccccgatcgattctcggcagccaaggatgaggcccacaatgcctgtgtcctcaccattagtcccgtgcagcctgaagacgacgcggattactactgctctgttggctacggctttagtccctaggggtggggtgtgagatgggtgcctcccctctgcctcccatttctgcccctgaccttgggtcccttttaaactttctctgagccttgcttcccctctgtaaaatgggttaataatattcaacatgtcaacaaaaa

SEQ ID NO: 57447 - DNA, 363 bp, Homo sapiens
atgggctggacttggaggatcctgtttttggtggtcatagctgcaggtgcccagtcccaggtacagctgatgcagtctggggctgaggtgaagaagcctggggcctcagtgaggatctcctgcaaggcttctggatacaccttcaccagctactgtatgcactgggtgtgccaggcccatgcacaagggcttgagtggatgggattggtgtgccctagtgatggcagcacaagctatgcacagaagttccagggcagagtcaccataaccagggacacatccatgggcacagcctacatggagctaagcagcctgagatctgaggacacggccatgtattactgtgtgagagacacaatgtga

SEQ ID NO: 57448 - protein, 545 aa, Homo sapiens
MATDAALRRLLRLHRTEIAVAVDSAFPLLHALADHDVVPEDKFQETLHLKEKEGCPQAFHALLSWLLTQDSTAILDFWRVLFKDYNLERYGRLQPILDSFPKDVDLSQPRKGRKPPAVPKALVPPPRLPTKRKASEEARAAAPAALTPRGTASPGSQLKAKPPKKPESSAEQQRLPLGNGIQTMSASVQRAVAMSSGDVPGARGAVEGILIQQVFESGGSKKCIQVGGEFYTPSKFEDSGSGKNKARSSSGPKPLVRAKGAQGAAPGGGEARLGQQGSVPAPLALPSDPQLHQKNEDECAVCRDGGELICCDGCPRAFHLACLSPPLREIPSGTWRCSSCLQATVQEVQPRAEEPRPQEPPVETPLPPGLRSAGEEVRGPPGEPLAGMDTTLVYKHLPAPPSAAPLPGLDSSALHPLLCVGPEGQQNLAPGARCGVCGDGTDVLRCTHCAAAFHWRCHFPAGTSRPGTGLRCRSCSGDVTPAPVEGVLAPSPARLAPGPAKDDTASHEPALHRDDLESLLSEHTFDGILQWAIQSMARPAAPFPS

SEQ ID NO: 57449 - protein, 348 aa, Homo sapiens
MWLVYSSGAPGTQQPARNRVFFPIGMAPGGVCWRPDGWGTGGQGRISGPGSMGAGQRLGSSGTQRCCWGSCFGKEVALRRVLHPSPVCMGVSCLCQKNEDECAVCRDGGELICCDGCPRAFHLACLSPPLREIPSGTWRCSSCLQATVQEVQPRAEEPRPQEPPVETPLPPGLRSAGEEVRGPPGEPLAGMDTTLVYKHLPAPPSAAPLPGLDSSALHPLLCVGPEGQQNLAPGARCGVCGDGTDVLRCTHCAAAFHWRCHFPAGTSRPGTGLRCRSCSGDVTPAPVEGVLAPSPARLAPGPAKDDTASHEPALHRDDLESLLSEHTFDGILQWAIQSMARPAAPFPS

SEQ ID NO: 57450 - protein, 98 aa, Homo sapiens
MALLLALSLLVLWTSPAPTLSGTNDAEDCCLSVTQKPIPGYIVRNFHYLLIKDGCRVPAVVFTTLRGRQLCAPPDQPWVERIIQRLQRTSAKMKRRSS

SEQ ID NO: 57451 - protein, 207 aa, Homo sapiens
MQSGTHWRVLGLCLLSVGVWGQDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 57452 - protein, 399 aa, Homo sapiens
MSDSKEPRVQQLGLLEEDPTTSGIRLFPRDFQFQQIHGHKSSTGCLGHGALVLQLLSFMLLAGVLVAILVQVSKVPSSLSQEQSEQDAIYQNLTQLKAAVGELSEKSKLQEIYQELTQLKAAVGELPEKSKLQEIYQELTRLKAAVGELPEKSKLQEIYQELTRLKAAVGELPEKSKLQEIYQELTRLKAAVGELPEKSKLQEIYQELTELKAAVGELPEKSKLQEIYQELTQLKAAVGELPDQSKQQQIYQELTDLKTAFERLCRHCPKDWTFFQGNCYFMSNSQRNWHDSVTACQEVRAQLVVIKTAEEQNFLQLQTSRSNRFSWMGLSDLNQEGTWQWVDGSPLSPSFQRYWNSGEPNNSGNEDCAEFSGSGWNDNRCDVDNYWICKKPAACFRDE

SEQ ID NO: 57453 - protein, 399 aa, Homo sapiens; identical to SEQ ID NO: 57452

SEQ ID NO: 57454 - protein, 376 aa, Homo sapiens
MSDSKEPRVQQLGLLEEDPTTSGIRLFPRDFQFQQIHGHKSSTGCLGHGALVLQLLSFMLLAGVLVAILVQVSKVPSSLSQEQSEQDAIYQNLTQLKAAVGELSEKSKLQEIYQELTQLKAAVGELPEKSKLQEIYQELTRLKAAVGELPEKSKLQEIYQELTRLKAAVGELPEKSKLQEIYQELTRLKAAVGELPEKSKLQEIYQELTQLKAAVGELPDQSKQQQIYQELTDLKTAFERLCRHCPKDWTFFQGNCYFMSNSQRNWHDSVTACQEVRAQLVVIKTAEEQNFLQLQTSRSNRFSWMGLSDLNQEGTWQWVDGSPLSPSFQRYWNSGEPNNSGNEDCAEFSGSGWNDNRCDVDNYWICKKPAACFRDE

SEQ ID NO: 57455 - protein, 272 aa, Homo sapiens
MSDSKEPRVQQLGLLEEDPTTSGIRLFPRDFQFQQIHGHKSSTGCLGHGALVLQLLSFMLLAGVLVAILVQVSKVPSSLSQEQSEQDAIYQNLTQLKAAVGELSEKSKLQEIYQELTQLKAAVGELPEKSKLQEIYQELTRLKAAVGELPEKSKLQEIYQELTRLKAAVGELPEKSKLQEIYQELTRLKAAVGELPEKSKLQEIYQELTELKAAVGELPEKSKLQEIYQELTQLKAAVGELPDQSKQQQIYQELTDLKTAFGEFLHIKGPWA

SEQ ID NO: 57456 - protein, 272 aa, Homo sapiens; identical to SEQ ID NO: 57455

SEQ ID NO: 57457 - protein, 251 aa, Homo sapiens
MSDSKEPRVQQLGLLEEDPTTSGIRLFPRDFQFQQIHGHKSSTVPFLLGPVSKVPSSLSQEQSEQDAIYQNLTQLKAAVGELSEKSKLQEIYQELTQLKAAVGELPEKSKLQEIYQELTRLKAAVGELPEKSKLQEIYQELTRLKAAVGELPEKSKLQEIYQELTRLKAAVGELPEKSKLQEIYQELTELKAAVGELPEKSKLQEIYQELTQLKAAVGELPDQSKQQQIYQELTDLKTAFGEFLHIKGPWA

SEQ ID NO: 57458 - protein, 422 aa, Homo sapiens
MDHPSREKDERQRTTKPMAQRSAHCSRPSGSSSSSGVLMVGPNFRVGKKIGCGNFGELRLGKNLYTNEYVAIKLEPIKSRAPQLHLEYRFYKQLGSAGEGLPQVYYFGPCGKYNAMVLELLGPSLEDLFDLCDRTFTLKTVLMIAIQLLSRMEYVHSKNLIYRDVKPENFLIGRQGNKKEHVIHIIDFGLAKEYIDPETKKHIPYREHKSLTGTARYMSINTHLGKEQSRRDDLEALGHMFMYFLRGSLPWQGLKADTLKERYQKIGDTKRNTPIEALCENFPEEMATYLRYVRRLDFFEKPDYEYLRTLFTDLFEKKGYTFDYAYDWVGRPIPTPVGSVHVDSGASAITRESHTHRDRPSQQQPLRNQVVSSTNGELNVDDPTGAHSNAPITAHAEVEVVEEAKCCCFFKRKRKKTAQRHK

SEQ ID NO: 57459 - protein, 393 aa, Homo sapiens
MDHPSREKDERQRTTKPMAQRSAHCSRPSGSSSSSGVLMVGPNFRVGKKIGCGNFGELRLGKNLYTNEYVAIKLEPIKSRAPQLHLEYRFYKQLGSAGEGLPQVYYFGPCGKYNAMVLELLGPSLEDLFDLCDRTFTLKTVLMIAIQLLSRMEYVHSKNLIYRDVKPENFLIGRQGNKKEHVIHIIDFGLAKEYIDPETKKHIPYREHKSLTGTARYMSINTHLGKEQSRRDDLEALGHMFMYFLRGSLPWQGLKADTLKERYQKIGDTKRNTPIEALCENFPEEMATYLRYVRRLDFFEKPDYEYLRTLFTDLFEKKGYTFDYAYDWVGRPIPTPVGSVHVDSGASAITRESHTHRDRPSQQQPLRNQSLRTVTAEHYDVNNSAIWHRGRGT

SEQ ID NO: 57460 - protein, 174 aa, Homo sapiens
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIAKEKKPSYNRGLCENAPNRARM

SEQ ID NO: 57461 - protein, 223 aa, Homo sapiens
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 57462 - protein, 626 aa, Homo sapiens
MPLLLLLLLLPSPLHPHPICEVSKVASHLEVNCDKRNLTALPPDLPKDTTILHLSENLLYTFSLATLMPYTRLTQLNLDRCELTKLQVDGTLPVLGTLDLSHNQLQSLPLLGQTLPALTVLDVSFNRLTSLPLGALRGLGELQELYLKGNELKTLPPGLLTPTPKLEKLSLANNNLTELPAGLLNGLENLDTLLLQENSLYTIPKGFFGSHLLPFAFLHGNPWLCNCEILYFRRWLQDNAENVYVWKQGVDVKAMTSNVASVQCDNSDKFPVYKYPGKGCPTLGDEGDTDLYDYYPEEDTEGDKVRATRTVVKFPTKAHTTPWGLFYSWSTASLDSQMPSSLHPTQESTKEQTTFPPRWTPNFTLHMESITFSKTPKSTTEPTPSPTTSEPVPEPAPNMTTLEPTPSPTTPEPTSEPAPSPTTPEPTPIPTIATSPTILVSATSLITPKSTFLTTTKPVSLLESTKKTIPELDQPPKLRGVLQGHLESSRNDPFLHPDFCCLLPLGFYVLGLFWLLFASVVLILLLSWVGHVKPQALDSGQGAALTTATQTTHLELQRGRQVTVPRAWLLFLRGSLPTFRSSLFLWVRPNGRVGPLVAGRRPSALSQGRGQDLLSTVSIRYSGHSL

SEQ ID NO: 57463 - protein, 148 aa, Homo sapiens
MPSRLRKTRKLRGHVSHRHGRIGKHRKHPGGRGNAGGLHHHRINFDKYHPGYFGKVGMKHYHLKRNQSFCPTVNLDKLWTLVSEQTRVNAAKNKTGAAPIIDVVRSGYYKVLGKGKLPKQAVTVQAKFFSRRAEEKIKSVGGACVLVA

SEQ ID NO: 57464 - protein, 148 aa, Homo sapiens; identical to SEQ ID NO: 57463

SEQ ID NO: 57465 - protein, 125 aa, Homo sapiens
MDMRVPAQLLGLLLLWFPGARCNIQMTQSPSAMSASVGDRVTITCRARQGISNYLAWFQQKPGKVPKHLIYAASSLQSGVPSRFSGSGSGTEFTLTISSLQPEDFATYYCLQHNSYPPTVLHTRT

SEQ ID NO: 57466 - protein, 221 aa, Homo sapiens
MSVAMQRLYIGKCKDNGRKNSRTVEQLEASDTNSLMNGVTQPLVDTESLLLGKLQYSQVTICKHDECTLATSPILYVCALRASPNNHTRPLEKPLRAQLLTMGWTWRILFLVVIAAGAQSQVQLMQSGAEVKKPGASVRISCKASGYTFTSYCMHWVCQAHAQGLEWMGLVCPSDGSTSYAQKFQGRVTITRDTSMGTAYMELSSLRSEDTAMYYCVRDTM

SEQ ID NO: 57467 - protein, 404 aa, Homo sapiens [sequence omitted]

SEQ ID NO: 57468 - protein, 128 aa, Homo sapiens
MGSTAILALLLAVLQGVCAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARHTVRETSPEPV

SEQ ID NO: 57469 - protein, 380 aa, Homo sapiens [sequence omitted]

SEQ ID NO: 57470 - protein, 382 aa, Homo sapiens
MDFGLALLLAGLLGLLLGQSLQVKPLQVEPPEPVVAVALGASRQLTCRLACADRGASVQWRGLDTSLGAVQSDTGRSVLTVRNASLSAAGTRVCVGSCGGRTFQHTVQLLVYAFPDQLTVSPAALVPGDPEVACTAHKVTPVDPNALSFSLLVGGQELEGAQALGPEVQEEEEEPQGDEDVLFRVTERWRLPPLGTPVPPALYCQATMRLPGLELSHRQAIPVLHSPTSPEPPDTTSPESPDTTSPESPDTTSPEPPDTTSPEPPDKTSPEPAPQQGSTHTPRSPGSTRTRRPEISQAGPTQGEVIPTGSSKPAGDQLPAALWTSSAVLGLLLLALPTYHLWKRCRHLAEDDTHPPASLRLLPQVSAWAGLRGTGQVGISPS

SEQ ID NO: 57471 - protein, 406 aa, Homo sapiens
MDFGLALLLAGLLGLLLGQSLQVKPLQVEPPEPVVAVALGASRQLTCRLACADRGASVQWRGLDTSLGAVQSDTGRSVLTVRNASLSAAGTRVCVGSCGGRTFQHTVQLLVYAFPDQLTVSPAALVPGDPEVACTAHKVTPVDPNALSFSLLVGGQELEGAQALGPEVQEEEEEPQGDEDVLFRVTERWRLPPLGTPVPPALYCQATMRLPGLELSHRQAIPVLHSPTSPEPPDTTSPESPDTTSPESPDTTSPESPDTTSQEPPDTTSQEPPDTTSQEPPDTTSPEPPDKTSPEPAPQQGSTHTPRSPGSTRTRRPEISQAGPTQGEVIPTGSSKPAGDQLPAALWTSSAVLGLLLLALPTYHLWKRCRHLAEDDTHPPASLRLLPQVSAWAGLRGTGQVGISPS

SEQ ID NO: 57472 - protein, 295 aa, Homo sapiens
MDFGLALLLAGLLGLLLGQSLQVKPLQVEPPEPVVAVALGASRQLTCRLACADRGASVQWRGLDTSLGAVQSDTGRSVLTVRNASLSAAGTRVCVGSCGGRTFQHTVQLLVYAFPDQLTVSPAALVPGDPEVACTAHKVTPVDPNALSFSLLVGGQELEGAQALGPEVQEEEEEPQGDEDVLFRVTERWRLPPLGTPVPPALYCQATMRLPGLELSHRQAIPASKPAGDQLPAALWTSSAVLGLLLLALPTYHLWKRCRHLAEDDTHPPASLRLLPQVSAWAGLRGTGQVGISPS

SEQ ID NO: 57473 - protein, 147 aa, Homo sapiens
MVTGGPWPTRLSRTCLHYLGSLEKTRSMKPTNKAEGLWRHCYVGDPRGPAQRRCQPQEKSSSPGLYPPLKEAGACSDGLHSRLQAARRAGSPCSVLPSCLPPPASGHSGLGGSQRLPLWTQIKPSDLTSFLCKRCLWGWECRHWCFC

SEQ ID NO: 57474 - protein, 335 aa, Homo sapiens
MAGSPTCLTLIYILWQLTGSAASGPVKELVGSVGGAVTFPLKSKVKQVDSIVWTFNTTPLVTIQPEGGTIIVTQNRNRERVDFPDGGYSLKLSKLKKNDSGIYYVGIYSSSLQQPSTQEYVLHVYEHLSKPKVTMGLQSNKNGTCVTNLTCCMEHGEEDVIYTWKALGQAANESHNGSILPISWRWGESDMTFICVARNPVSRNFSSPILARKLCEGAADDPDSSMVLLCLLLVPLLLSLFVLGLFLWFLKRERQEEYIEEKKRVDICRETPNICPHSGENTEYDTIPHTNRTILKEDPANTVYSTVEIPKKMENPHSLLTMPDTPRLFAYENVI

SEQ ID NO: 57475 - protein, 317 aa, Homo sapiens
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGGSTKYWSGNSEFHFYSINVGGFFKLRSGEEISIEVSNPSLLDPDQDATYFGAFKVRDID

SEQ ID NO: 57476 - protein, 244 aa, Homo sapiens
MDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGGSTKYWSGNSEFHFYSINVGGFFKLRSGEEISIEVSNPSLLDPDQDATYFGAFKVRDID

SEQ ID NO: 57477 - protein, 123 aa, Homo sapiens
MACRCLSFLLMGTFLSVSQTVLAQLDALLVFPGQVAQLSCTLSPQHVTIRDYGVSWYQQRAGSAPRYLLYYRSEEDHHRPADIPDRFSAAKDEAHNACVLTISPVQPEDDADYYCSVGYGFSP

SEQ ID NO: 57478 - protein, 120 aa, Homo sapiens
MGWTWRILFLVVIAAGAQSQVQLMQSGAEVKKPGASVRISCKASGYTFTSYCMHWVCQAHAQGLEWMGLVCPSDGSTSYAQKFQGRVTITRDTSMGTAYMELSSLRSEDTAMYYCVRDTM

SEQ ID NO: 57479 - DNA, 20 bp, Homo sapiens
gatcaagaaggggacagcgc

SEQ ID NO: 57480 - DNA, 20 bp, Homo sapiens
gatctgtgtgaggctgcagg

SEQ ID NO: 57481 - DNA, 20 bp, Homo sapiens
gatccagccaccgtggctgg

SEQ ID NO: 57482 - DNA, 20 bp, Homo sapiens
gatctcggaggggctgatag

SEQ ID NO: 57483 - DNA, 20 bp, Homo sapiens
gatcaggctggagggcgcga

SEQ ID NO: 57484 - DNA, 20 bp, Homo sapiens
gatctgcaaaaagcccgcag

SEQ ID NO: 57485 - DNA, 20 bp, Homo sapiens
gatcacttcctatatgcact

SEQ ID NO: 57486 - DNA, 20 bp, Homo sapiens
gatctcctcctgtgactcgc

SEQ ID NO: 57487 - DNA, 20 bp, Homo sapiens
gatctccttctgcagacaaa

SEQ ID NO: 57488 - DNA, 20 bp, Homo sapiens
gatcttttcaagttaaattt

SEQ ID NO: 57489 - DNA, 20 bp, Homo sapiens
gatctcacggtgaaccattt

SEQ ID NO: 57490 - DNA, 20 bp, Homo sapiens
gatcacatcctaagtggttc

SEQ ID NO: 57491 - DNA, 20 bp, Homo sapiens
gatctgtacataaaagtttc

SEQ ID NO: 57492 - DNA, 20 bp, Homo sapiens
gatctggctactacaaagtt

SEQ ID NO: 57493 - DNA, 20 bp, Homo sapiens
gatctatgctgcatccagtt

SEQ ID NO: 57494 - DNA, 20 bp, Homo sapiens
gatctatgctgcatccactt

SEQ ID NO: 57495 - DNA, 20 bp, Homo sapiens
gatctgggacagaattcact

SEQ ID NO: 57496 - DNA, 20 bp, Homo sapiens
gatctcccggacccctgagg

SEQ ID NO: 57497 - DNA, 20 bp, Homo sapiens
gatcatgagggtgtccttgg

SEQ ID NO: 57498 - DNA, 20 bp, Homo sapiens
gatcatgagagtgtccttgg

SEQ ID NO: 57499 - DNA, 20 bp, Homo sapiens
gatctacattgcaggtgtag

SEQ ID NO: 57500 - DNA, 20 bp, Homo sapiens
gatctatacgctttcctatc

SEQ ID NO: 57501 - DNA, 20 bp, Homo sapiens
gatctcctgcaaggcttctg

SEQ ID NO: 57502 - DNA, 20 bp, Homo sapiens
gatcttcgacattcagactg

SEQ ID NO: 57503 - DNA, 20 bp, Homo sapiens
gatctcatgtgcaagaaaat

SEQ ID NO: 57504 - DNA, 20 bp, Homo sapiens
gatctcctgtaagggttctg

SEQ ID NO: 57505 - DNA, 20 bp, Homo sapiens
gatcaccgagtggagacagc

SEQ ID NO: 57506 - DNA, 20 bp, Homo sapiens
gatcggcactgaatacagga

SEQ ID NO: 57507 - DNA, 20 bp, Homo sapiens
gatctacgatgcatccaatt

SEQ ID NO: 57508 - DNA, 20 bp, Homo sapiens
gatctgggacagattttact

SEQ ID NO: 57509 - DNA, 20 bp, Homo sapiens
gatctatagtgcatccaatt

SEQ ID NO: 57510 - DNA, 20 bp, Homo sapiens
gatcagcccctcctgagtgg

SEQ ID NO: 57511 - DNA, 20 bp, Homo sapiens
gatctatgaagcccaccaac

SEQ ID NO: 57512 - DNA, 20 bp, Homo sapiens
gatcgggctgaggccaggcc

SEQ ID NO: 57513 - DNA, 20 bp, Homo sapiens
gatctctctccctactgcaa

SEQ ID NO: 57514 - DNA, 20 bp, Homo sapiens
gatcatctgaaggggcaaat

SEQ ID NO: 57515 - DNA, 20 bp, Homo sapiens
gatcaccaccggcctgctga

SEQ ID NO: 57516 - DNA, 20 bp, Homo sapiens
gatcttagaagacttttatc

SEQ ID NO: 57517 - DNA, 5385 bp, Homo sapiens
gcaactgaagacggaggtgcccaaggtcagaaggaagcaccacacagagggcacaggcaggatggccgatgctgacaggaaccagcggtgactctggggcccctggcagcagctctgtctcctgaagatgaagtggcccaggtgaagcccaggccagccccaatggccagctcggagactgagatccgctgggctgagcctggcctggggaagggcccccagcggcggcgctgggcctgggccgaggacaagagggatgtggatagaagtagttcacaaagctgggaagaagagagactctttcccaatgccaccagccccgagctcctagaggacttccgcctggcccagcagcacctgccgcccctggagtgggacccacacccgcagcccgatgggcatcaggattccgagtcaggagagacttcgggagaagaggctgaagcagaggatgtggacagcccagcaagttcccatgagcctcttgcctggctcccccagcagggccgtcagctggacatgactgaagaggagccagatgggaccctcggaagtctggaggttgaggaggctggagagagctcctcaaggttggggtatgaggctggtctcagcttggaaggccatggaaacaccagccccatggctcttgggcatggtcaggccaggggctgggtggcttctggcgaacaagccagtggggacaaactttctgaacattccgaggtcaacccatccgttgaactcagcccggcaaggtcctggagcagtgggacagtgagcctcgaccaccctagtgacagccttgattctacctgggaaggagagaccgatggcccccagcccactgccctggcagaaaccttgccagagggccccagccaccacctcctaagcccagatggcagaactggaggcagtgttgctcgggcaacccccatggaattccaggactcctcagctcccccagcccagagtccgcagcatgccacagatagatggaggagagaaacgaccagattcttctgccctcagcccaaggaacacatctggaagcagacaaagacgtcacctaagccactcccttcccgattcattggctccatcagccccctgaatccccagcccaggccaacgcggcagggcaggccgctgcccagacagggagccactctggctggccgctcctcttctaatgcccccaagtatggccgggggcagttgaactacccactccctgatttctccaaggtagggccccgggtgagattccccaaagatgagagctaccgtccccccaagtccagaagccacaacaggaagcctcaggcccctgccaggcccctcatcttcaagtctccagctgagattgtgcaggaggtgctgttgagcagtggagaagcagccctggcaaaggacacgcctcctgcccaccctatcaccagggtaccccaagaatttcagacgcctgagcaagccactgagctggtccatcagctccaggaagactaccacaggctcctcaccaagtacgctgaggccgagaacaccattgaccagctacgcctcggggccaaggtgaacctgttctctgacccaccccagcccaaccacagcatccacacgggaatggtgccccaggggaccaaggtcttgtccttcaccatcccacagccccgctctgcagagtggtggccgggcccggccgaggacccccaggcctctgcggcctcagggtggccatcagctcgaggagacttgagcccctcctcgcttaccagcatgcccaccctggggtggcttccggagaaccgggacatctctgaggaccagtcctcagcagagcagacccaggcactggcttctcaggccagccagttcctggccaaggtggagtcctttgaaagactgatacaggcaggacgtctcatgccccaggaccaagtcaagggcttccagcggctgaaggctgcccacgcggccctagaggaggagtacctgaaggcttgtcgggagcaacaccctgcccagccgcttgccggctccaaggggacgcctggaagatttgatcctcgcagggagctggaggcagagatataccgtctgggaagctgcctggaagagctgaaggaacacatagaccagacccagcaagagcctgagccgcccgggtcagactcagctctggacagcaccccagccctgccctgcctccatcagccaacgcacctgcctgctccttctggacaagcccccatgccagccatcaagacctcctgccctgagcctgctaccaccactgccgccgccagcactggcccctgcccattgcacgtaaatgtggaggtgagctctggcaacagtgaggtggaggacaggccacaggaccccctggcccgactcaggcacaaggagctgcagatggagcaagtttaccatggcctcatggagcggtacctcagtgtgaagtctctcccagaagccatgagaatggaggaggaggaagaaggagaggaggaggaggaggaagaggggggaggtgactccctggaagttgatggggtggctgcaactccagggaaagcagaggccaccagggtcctcccaaggcagtgcccggtgcaggctgagaaaagtcatggggctcccctggaggaggccacggagaagatggtatctatgaagccaccaggtttccaggcatccctggctagagacgggcacatgtcaggcctgggcaaggctgaggcagcccctccaggccctggcgtgccaccccaccctccaggcaccaagtccgcagcatcccaccaaagtagtatgaccagcctggagggaagcggcatctctgagcgccttccacagaagcctttgcaccgaggcggtgggccccacctggaggagacctggatggcgtccccagagacagacagtggctttgtgggctcagaaacaagcagagtttcacccctcacccagactccagagcaccggctctcccacatcagcacagcaggaacattagcccagccctttgctgcatctgtgcccagggatggagcttcctaccccaaggccaggggttctctgattcccagaagagccacagagcccagcacaccccggagccaagcacagaggtacctctccagcccaagtgggcctctccggcagagggcacccaacttcagcctggagcggacactggcagccgagatggcggttcctggctcagagtttgaggggcacaaacggatttctgaacagccccttcccaacaagacaatcagcccacccccagcccccgcccctgccgctgcgcctctaccctgtggaccaacagagaccatccccagcttcctgctcaccagggcagggcgagaccaggccatctgtgagctgcaagaagaggtgtcccggcttcgtctgcggctggaagacagcctgcaccagccactccagggcagcccgacacgcccagcatctgcctttgaccgccccgcccggacccgcggccggccagcagactccccagccacctggggctcccattatggcagtaaatccacagagagattgcctggtgagcctagaggtgaagagcagattgtccctccaggaaggcagcgagccaggtcttcctcagtgcctcgggaggtgctccgactgtccctgagttcagaatctgagctgccctccctaccactgttctctgagaagagcaagaccaccaaggacagtccacaggcagctcgggatggaaagagaggggtgggcagtgctggatggccagacagggtcaccttccggggccaatacacaggccacgaataccatgttctgtcccctaaggcggtcccaaaaggcaatggcacagtctcctgtccccactgccggcccattaggacccaggatgcgggtggtgctgtcacaggggacccactgggaccgcctcccgctgatacccttcagtgtcccctgtgtggtcaagttgggtctcccccagaggcagatggtccaggctcagccacctctggggcagagaaggccaccacgaggagaaaagcaccttcaactcccagccccaagcagaggagcaagcaggcggggtcgtcgccacgcccaccccccggactgtggtatctggcaacagcgcccccagcaccagcccctccagcctttgcctacatctcctcggttcccatcatgccttatccacctgccgctgtgtactatgcgcctgcaggacctacctcagcccaaccagctgccaagtggccgcccacagcctctcccccaccagcccggagacaccggcactccatccagctcgacctgggcgacctagaggagctcaacaaggccctgagccgggccgtgcaggctgccgagagcgtccgctctaccaccaggcagatgagaagctcgctgtcagccgacctgcgccaggctcacagcctgcggggctcctgcctcttctgacttcactgggggcccagaggcagatgggtgggtgggtgggcaggtggcctgccaggccaggagtgggctggagctgctgaggcccagaaggcccgcatagttcctcaccaggagggtctccctccagcacaggtcccgcctgctcagtccctgtgctttccaagtggagggggtgtcagctcggtcaccaagagaagtgacttcccaggagcaccagtcccctcacagaggtgctgtgagcgaggcctccttcggtccaggcagaacctcaggcagtctctcctggtcctgcatgtgtgcaactccagctaataataggtattttatatacagatggacagatatttttttaaactggggagttttcctgatcttgggtcctctttagggggccagacaagaaaggcctacggtttctggagcaaacctgtcccccacctgtgaccagtcactctggggcaagcatcactgggaagggcatagccggagacctttctcctagtgactggtagtcagtggggcattttaggatgtcagggccccagggtgacatgtgtccagcttttctatggcagcagaggcctttccctcagacaagctacaaagtgcccaggatgccatccaccatggtccccttcagtacctcacgcatggtccccagcttctcctaggatcccagtggcatttatcagtggccagctacctgccaggcccgggctggggcacggtctgcggccatgaggccaggccgcctcccgcacccctaccccgtggcagcagcatacctctgcatttctggaatgtgtgtgcatcaatgatgtttgtatatttgaggcatttaaaaatctattttcgttacgagggcaaatgaagaatgaatattgatcttaaaaaaaaaaaaaa

SEQ ID NO: 57518 - DNA, 5243 bp, Homo sapiens
agcgtgagactcgcgccctccggcacggaaaaggccaggcgacaggtgtcgcttgaaaagactgggcttgtccttgctggtgcatgcgtcgtcggcctctgggcagcaggtttacaaaggaggaaaacgacttcttctagatttttttttcagtttcttctataaatcaaaacatctcaaaatggagacctaaaatccttaaagggacttagtctaatctcgggaggtagttttgtgcatgggtaaacaaattaagtattaactggtgttttactatccaaagaatgctaattttataaacatgatcgagttatataaggtataccataatgagtttgattttgaatttgatttgtggaaataaaggaaaagtgattctagctggggcatattgttaaagcatttttttcagagttggccaggcagtctcctactggcacattctcccattatgtagaatagaaatagtacctgtgtttgggaaagattttaaaatgagtgacagttatttggaacaaagagctaataatcaatccactgcaaattaaagaaacatgcagatgaaagttttgacacattaaaatacttctacagtgacaaagaaaaatcaagaacaaagctttttgatatgtgcaacaaatttagaggaagtaaaaagataaatgtgatgattggtcaagaaattatccagttatttacaaggccactgatattttaaacgtccaaaagtttgtttaaatgggctgttaccgctgagaatgatgaggatgagaatgatggttgaaggttacattttaggaaatgaagaaacttagaaaattaatataaagacagtgatgaatacaaagaagatttttataacaatgtgtaaaatttttggccagggaaaggaatattgaagttagatacaattacttacctttgagggaaataattgttggtaatgagatgtgatgtttctcctgccacctggaaacaaagcattgaagtctgcagttgaaaagcccaacgtctgtgagatccaggaaaccatgcttgcaaaccactggtaaaaaaaaaaaaaaaaaaaaaaaaaagccacagtgacttgcttattggtcattgctagtattatcgactcagaacctctttactaatggctagtaaatcataattgagaaattctgaattttgacaaggtctctgctgttgaaatggtaaatttattattttttttgtcatgataaattctggttcaaggtatgctatccatgaaataatttctgaccaaaactaaattgatgcaatttgattatccatcttagcctacagatggcatctggtaacttttgactgttttaaaaaataaatccactatcagagtagatttgatgttggcttcagaaacatttagaaaaacaaaagttcaaaaatgttttcaggaggtgataagttgaataactctacaatgttagttctttgagggggacaaaaaatttaaaatctttgaaaggtcttattttacagccatatctaaattatcttaagaaaatttttaacaaagggaatgaaatatatatcatgattctgtttttccaaaagtaacctgaatatagcaatgaagttcagttttgttattggtagtttgggcagagtctctttttgcagcacctgttgtctaccataattacagaggacatttccatgttctagccaagtatactattagaataaaaaaacttaacattgagttgcttcaacagcatgaaactgagtccaaaagaccaaatgaacaaacacattaatctctgattatttattttaaatagaatatttaattgtgtaagatctaatagtatcattatacttaagcaatcatattcctgatgatctatgggaaataactattatttaattaatattgaaaccaggttttaagatgtgttagccagtcctgttactagtaaatctctttatttggagagaaattttagattgttttgttctccttattagaaggattgtagaaagaaaaaaatgactaattggagaaaaattggggatatatcatatttcactgaattcaaaatgtcttcagttgtaaatcttaccattattttacgtacctctaagaaataaaagtgcttctaattaaaatatgatgtcattaattatgaaatacttcttgataacagaagttttaaaatagccatcttagaatcagtgaaatatggtaatgtattattttcctcctttgagttaggtcttgtgcttttttttcctggccactaaatttcacaatttccaaaaagcaaaataaacatattctgaatatttttgctgtgaaacacttgacagcagagctttccaccatgaaaagaagcttcatgagtcacacattacatctttgggttgattgaatgccactgaaacattctagtagcctggagaagttgacctacctgtggagatgcctgccattaaatggcatcctgatggcttaatacacatcactcttctgtgaagggttttaattttcaacacagcttactctgtagcatcatgtttacattgtatgtataaagattatacaaaggtgcaattgtgtatttcttccttaaaatgtatcagtataggatttagaatctccatgttgaaactctaaatgcatagaaataaaaataataaaaaatttttcattttggcttttcagcctagtattaaaactgataaaagcaaagccatgcacaaaactacctccctagagaaaggctagtcccttttcttccccattcatttcattatgaacatagtagaaaacagcatattcttatcaaatttgatgaaaagcgccaacacgtttgaactgaaatacgacttgtcatgtgaactgtaccgaatgtctacgtattccacttttcctgctggggttcctgtctcagaaaggagtcttgctcgtgctggtttctattacactggtgtgaatgacaaggtcaaatgcttctgttgtggcctgatgctggataactggaaaagaggagacagtcctactgaaaagcataaaaagttgtatcctagctgcagattcgttcagagtctaaattccgttaacaacttggaagctacctctcagcctacttttccttcttcagtaacaaattccacacactcattacttccgggtacagaaaacagtggatatttccgtggctcttattcaaactctccatcaaatcctgtaaactccagagcaaatcaagatttttctgccttgatgagaagttcctaccactgtgcaatgaataacgaaaatgccagattacttacttttcagacatggccattgacttttctgtcgccaacagatctggcaaaagcaggcttttactacataggacctggagacagagtggcttgctttgcctgtggtggaaaattgagcaattgggaaccgaaggataatgctatgtcagaacacctgagacattttcccaaatgcccatttatagaaaatcagcttcaagacacttcaagatacacagtttctaatctgagcatgcagacacatgcagcccgctttaaaacattctttaactggccctctagtgttctagttaatcctgagcagcttgcaagtgcgggtttttattatgtgggtaacagtgatgatgtcaaatgcttttgctgtgatggtggactcaggtgttgggaatctggagatgatccatgggttcaacatgccaagtggtttccaaggtgtgagtacttgataagaattaaaggacaggagttcatccgtcaagttcaagccagttaccctcatctacttgaacagctgctatccacatcagacagcccaggagatgaaaatgcagagtcatcaattatccattttgaacctggagaagaccattcagaagatgcaatcatgatgaatactcctgtgattaatgctgccgtggaaatgggctttagtagaagcctggtaaaacagacagttcagagaaaaatcctagcaactggagagaattatagactagtcaatgatcttgtgttagacttactcaatgcagaagatgaaataagggaagaggagagagaaagagcaactgaggaaaaagaatcaaatgatttattattaatccggaagaatagaatggcactttttcaacatttgacttgtgtaattccaatcctggatagtctactaactgccggaattattaatgaacaagaacatgatgttattaaacagaagacacagacgtctttacaagcaagagaactgattgatacgattttagtaaaaggaaatattgcagccactgtattcagaaactctctgcaagaagctgaagctgtgttatatgagcatttatttgtgcaacaggacataaaatatattcccacagaagatgtttcagatctaccagtggaagaacaattgcggagactacaagaagaaagaacatgtaaagtgtgtatggacaaagaagtgtccatagtgtttattccttgtggtcatctagtagtatgcaaagattgtgctccttctttaagaaagtgtcctatttgtaggagtacaatcaagggtacagttcgtacatttctttcatgaagaagaaccaaaacatcgtctaaactttagaattaatttattaaatgtattataactttaacttttatcctaatttggtttccttaaaatttttatttatttacaactcaaaaaacattgttttgtgtaacatatttatatatgtatctaaaccatatgaacatatattttttagaaactaagagaatgataggcttttgttcttatgaacgaaaaagaggtagcactacaaacacaatattcaatcaaaatttcagcattattgaaattgtaagtgaagtaaaacttaagatatttgagttaacctttaagaattttaaatattttggcattgtactaataccgggaacatgaagccaggtgtggtggtatgtgcctgtagtcccaggctgaggcaagagaattacttgagcccaggagtttgaatccatcctgggcagcatactgagaccctgcctttaaaaacaaacagaacaaaaacaaaacaccagggacacatttctctgtcttttttgatcagtgtcctatacatcgaaggtgtgcatatatgttgaatgacattttagggacatggtgtttttataaagaattctgtgagaaaaaatttaataaagcaacaaaaattactcttaaaaaaaaaaaaaaa

SEQ ID NO: 57519 - DNA, 1507 bp, Homo sapiens
aaacagttgccttttcctctcacagaaggaagatttcattttgtttgagacgagaaaccaaaccacacaccaaagagaggggtatgatggctaagaagcccccaaaaccagcccctcgcaggatcttccaggaaaggttaaagattactgctctacctttgtactttgaaggttttttattaatcaagcggtcaggataccgggagtatgagcattactggacagagttgagaggaactactcttttcttttataccgacaaaaagagtataatatatgttgacaaattagacatagtagacctcacatgccttactgagcagaattcaactgaaaagaactgtgcgaaattcacccttgttttgccgaaagaggaagtacaactgaagacagagaacacagaaagtggggaagaatggagaggcttcattcttacagtaacagagctgtcagttccccaaaacgtgtcactcctacctgggcaagtaattaaactgcatgaagtcctagagagagaaaagaaaaggaggattgagacagagcagagtacgtccgtggaaaaagagaaggaaccaactgaagattatgtggatgtactgaaccctatgccagcatgtttttatacagtgtcccggaaagaggcaactgagatgctccagaagaacccttctttgggaaatatgatcctgaggcctggtagtgacagtagaaactactccatcactattcggcaggagatagacattccaagaatcaagcactacaaagtgatgagcgtaggacaaaactacactattgaactggaaaaacctgtaacactcccaaaccttttcagtgtcattgattattttgtgaaggagactcgaggaaatttaagaccatttatatgttcaactgatgaaaacactggtcaagaacccagtatggaagggagaagtgaaaagttgaagaaaaatccacacattgcatgaaatacaatgtgaaagctcctttgtatatcttggtaatttatattttcaaaacgaagttcttacttttaaagagaattacctatattctcctgatactgattaccaagtcattcacctgaacaccagaattagaattaaacattgtaccatacaatttcattatcttatcagaatgaaaccaattcacagggaaactagagactacggctgtggtggtaacctgcagatatacacattcccatgcactgacataagttgaaaacacatagtactttctagatggaatttttttctttaggcctcaatgaaatacatttcccctatataattccaacagcagtttctctagttctaaattttaccaattcccaaaaaacctaagttttgctgaaatctgatttgaccaatttatcaaatatgtcattttaattacctagctggaagttagagacatgaaatgtactagaggagcccttttccaatggaaatattatataccacattttttgttaatggaaataaatgtctccattccc

SEQ ID NO: 57520 - DNA, 5760 bp, Homo sapiens
caaggtttgcagccgccacggccgctgctgcgctccggtgcagggcaggctggcgccgagcgaaccagggccgggaactgggagccgggagccgggagccagctgcccgcggagctgcggcggcggcggcatctggggtggtctcagtcccacgaacaccgtggccggcgcccggtggctactgcgcccagcggggctcagggaagagcggtctagacactttttattttggaagaaaggggcaagccccggcgggagcttccttcccggcctggctcgctccccattgcgcccagctccggcccggactctggaagatgactccagggtctgctctgtatattccagcggcggcagttccgggaggcagccgaaagtactaacagttggtagcagcggctagtggaaaagtgagccaaggcggcgcggactcggctctccccgcgccccgcggcactcgctgctcctcgccgctccttccctttggctcccaggcggctgcagcatgaagtggcgcagcgatggccaggagaggtaagaagcccgtggtgagaacgctggaggatctgacgctggactcgggttatggtggcgcggcggactcggtgcgctcctccaacttgtctttgtgctgttccgactcgcacccggcgtccccgtatggcgggagctgctggccgcctctagctgactccatgcacagccggcacaacagctttgacactgtcaacactgccctggtggaagactccgaggggctggactgcgccggccagcactgctcgcggctgctgccggacctagacgaggtcccctggactctccaggagctggaggcgctgctgctgcgttcgcgggatccccgggcaggcccggcggtccccggcggcctgcccaaggacgcgctggccaagctgtcgacgctggtgagccgggcgctggtgcgcatagccaaagaggcgcagcgcctgagcctgcgcttcgccaagtgcaccaagtacgagatccagagcgccatggagatcgtgctgtcctggggcctggccgcgcactgtacggcggctgcgctggccgcactgtccctctacaacatgagcagcgccggcggcgaccgcctgggccgcggcaagtcggcccgctgcggcctcaccttctccgtgggccgcgtgtatcgctggatggtggacagccgcgtggcgctgcgcatccacgagcacgccgccatctacctgacagcctgcatggagagcctcttccgggacatctactcgcgggtcgtggcctccggggtgccccggagctgcagtggccctgggtcaggctcgggctccggcccaggcccgagctcgggccctggtgcggcccccgcggcggataaagagcgggaggcgcccgggggaggagcggcgagcggcggcgcctgcagcgcagccagcagcgccagcgggggcagcagctgttgcgccccgccggccgccgcggccgccgcagtcccgccggcagccgccgccaaccaccaccatcaccaccaccatgcgctccacgaggcgcccaagttcaccgtggagaccctggagcacacggtcaacaacgactcggagatctggggtctcctgcagccctaccagcacctgatctgcgggaagaacgccagcggggtgctgtgcctaccagacagcctgaatcttcacagagacccacagcggtcaaacaagccaggggaactgcccatgttcagccagtcggagctgaggaccatcgagcagtctttgctggccacgcgcgtaggcagcatcgccgaattgagtgacctggtgtcccgtgcaatgcatcacctgcagcccctcaatgccaagcaccacggcaatggcacccccctgcaccacaagcagggggcactgtactgggagcccgaggccctgtacaccctttgctatttcatgcactgcccacaaatggaatgggaaaaccccaacgtggagccttccaaagtcaacctccaggtggaaaggcccttcctcgtgctgccgccgctgatggagtggatccgggtggccgtggcgcacgccggccaccgccgcagcttctccatggacagcgacgacgtccgccaggcggcccggctgctgctgcccggcgtggactgcgagccgcgccagctcagggccgacgactgcttttgtgcatctcgaaagctggatgcggtggccatcgaagccaagtttaagcaggacctgggtttccggatgctgaactgtggacgaacagacctggtgaagcaggcagtgtctctgctggggcccgatgggatcaacaccatgagcgaacagggcatgactcccctgatgtatgcctgcgtccgtggggacgaggcgatggttcagatgctgctggatgccggagctgacctgaatgtggaggttgtcagtactcctcataaatatccatccgtccaccccgagacccgccattggacggctctgacttttgctgtgttgcatggacatattcctgtagttcagctcctcctggatgctggggccaaggtggaaggctcagtggagcatggcgaggagaactactcggaaacacccctccagctggcagctgctgtaggaaattttgagctggttagtttgctgttggagcgtggtgccgatcccctgataggaaccatgtacaggaatggaatttctacaaccccccagggtgatatgaactctttcagccaggctgcagcccacggacacaggaatgtgttccgcaaactgctcgcccagccagagaaggagaagagtgatatcctgtccctggaggagattctggccgaggggactgacctggcggagacagccccgccccccttgtgcgccagccgcaacagcaaggccaaactgagggccctgagggaggccatgtatcacagcgctgagcatggctacgtggatgtcacaattgatatcaggagcataggcgtcccgtggactctgcacacgtggctggagtctttgcggatcgccttccagcagcaccgcaggcctctcatccagtgcttgttaaaggagtttaagaccattcaggaggaggaatacacggaggagctcgttacccaaggcctgcccctgatgtttgagatcctgaaagcgagcaagaatgaagtgatcagccagcagctgtgcgtcatcttcacacactgctacgggccctaccccatccccaagctcacagaaatcaaacggaaacagacctcgcgcttggatcctcattttcttaacaataaagaaatgtctgatgttacatttctggtagaaggaagaccattttatgctcacaaagtgctgttatttacagcctctccaaggttcaaagcactcctctccagcaagccgacaaatgatggcacctgcatagagattggttatgtgaaatactccatctttcagctggttatgcagtatctctactatggtggcccagagtcactgctcattaaaaacaatgagatcatggagcttctgtctgctgctaagtttttccagctggaggctttgcagcgacactgtgagattatctgtgcgaaaagcatcaataccgacaactgtgtggatatttacaaccatgccaagtttcttggagtcacagagctctcagcatattgcgaaggctactttctcaaaaacatgatggtcctcattgaaaacgaagcattcaagcagctcctgtatgacaaaaatggtgaagggaccggccaggatgtgctccaggacttacagaggacgttggccatcagaattcagtccatccacttgtcgtcttccaaaggttccgtggtatgaaacgcctagtgcagggaatgcttcccgggaactttccagttctcctgccgcattggctttacacaaacacagacaaattccacctggcacctgtttttggctgggccaaggagctgcctctactgctcccacgtgttcctgttgaaaaacaaaggactttccactggtctgcagatcagatcagctgggtccagagtttaatgggcaactggacaaccaagttaaccccaattgaaagcacccctaggaccattgaacacccactgccggggaccactgtccagtgaatggattgaggccttttaaaggtcactcaggttccaggttgacagttggaggacttcaccgtaccaaccctgaagagattgtattacacattaaggaccttggtagctgtgcttcagcaaacgtcaaccatggtagcaaattggtgaggctgtgaccaataatgaggaaataatctggcaaatttttaggggtgggaacttttttaaatgttcatttaaaaaaaaacaaaaacagggcagtcttgtagtttaaaatatatttctaaaagcttaacagttcgttttcaactaaattgtgtttagggatctgtgtttgagatttttctttatttcttttttttttttaaatagtaagtcacaggtccacactgtgtaaacatgcatctgataagatactgctgatattctaaacaagttgaaataatcttgccttagtgatcatgattacacaaaagaggtgcactgccaataagtatctctaattcaatagttgaaagcaacctgcatgctaatcgtggtttcggggtgagaataaaacacccccacataacatgcatttgcatgggcccgaacctgtgaaatgttacgtttgtgcttcatttttgccaaggtaaaaatgttccatcatttctagctaaaactccatttggtgaaaccaacatatccatttcttttcctagttacggatgatttggggatgcttttgcagaaatgtgttcatagatgatgctgaatgggggaggggggcagcacgtcagagaatttactattaatcccagagttttctctgtattctcagaagatgttaatagtttgttactagccagagagtatgactatgttagattatttttaaagatgaaacatgtatgataggatggattctttctgtattctgagagtgtacagtacaggattattataatgaaagtttatatcaacagggtttcgttggctctgccatatattataagcaaaagagattggtaaagtgccacagtattccagataacttttcagttgcggcctttcttctcgttctttaatttgaaacctagatacatgcagtaaaaactaggagaatgacttttacccttggggacagccaagttttgttgataaacctatttcctagcatgccttcaggaagttgtgccagaccctagattgtgaaggacccactgttcttctgttgtacgagctccctgaaccattgttcagaggaccaatgtcacatcgcttcatgggcatggcccatggagcatctgggtgatatctgtctacagtattggctcttctgcgaggctgatacacaaggcctctcttccacatgatcatttgcaaacctcccccagcccctaccatccaatgtggaaggaaaacaagaactgcctgaagaagagtccaagctacagatacacagcgtgtgcattgcggctgtcaccttcctcctcccacttctgtatcctcagagatgctgcgtggatgtttccttaacctcagctgacttccctgtgaatgtctaatgctagttcagggcctccaggcattgatttgtacagtggtaactcccaatgaggcttctgttatcatttggtgtgctttctctgtcattaaaagaaatgattttcccaggc

SEQ ID NO: 57521 - DNA, 2508 bp, Homo sapiens
ctttctgctgttaccgggagcgcggtggccacggaacgctgcccggagccgcgcgagggaggacccgacgcgcggcgtttacccagcgcagcgttccaccgctcgggtttggctggaatagctctccagacccccagctggccatgtggtgagttcagggcccaaatcaagtagtaccagcaatcagggaactcctatctgttttgaatggattcacaccagccacaagcctggaaagatggtgtcacaatctacagtcaggcaggattctcctgtggagccctgggaagggatcagcgatcactctggcattattgatggttcgcccagactcctgaacactgaccatcctccttgccaattagacatcaggctcatgaggcacaaagctgtctggattaacccccaggatgtgcagcaacagccgcaggacttgcaatctcaggtgccagcagcagggaacagtgggacccattttgtgacagatgctgcctctccctcaggcccttcaccttcgtgcctcggggactccctggcagagacaacgttgtctgaggataccacagactccgttggcagcgcttctccccatggctcgagtgaaaagagtagcagcttctctctgtcctcaacagaggtacacatggtccgcccaggatactctcatcgggtgtctctgcccacaagccctaggattttggccacctccccatatcctgagactgacagtgctttttttgagccttcccatctgacatctgctgctgatgaaggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggttgtgctgtgttacaggtcagcccagtgactgaaacacgtacttaccatgatgtgaaagagatttgcaaatgcgatgttgatgaatttgttattttagagcttggagattttaatgatatcacagaaacctgtagctgttcctgcagctcctctaagagtgtcacttatgagccagacttcaattctgcagaactattagccaaagagctgtaccgcgtgttccagaagtgctggatactgtcagtagttaattctcagctggcaggttccctgagtgcagctggctcgatagtcgtaaatgaagagtgtgtccgaaaagactttgaatccagtatgaatgtagtacaggaaattaaatttaagtctaggatcagagggactgaagactgggctcctcctagatttcaaatcatatttaatattcatccaccactcaagagggaccttgtggtggcagcccagaattttttctgtgccggctgtggaactccagtagagcctaagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacaaatgttctgttttggctgctattggttttttaaagaggttttttatacttttgtatttgaatagttatgtttcactgatgctgagccagtttgtatgtgtgtgcatatatgtgaactgtaactgacaagatgaattactcagtttctctttctctaaagcttgtttgatgaaactggttggtcctttcagtgaacaaaaatatgaccccaaaaaaaaaaaaaaaaa

SEQ ID NO: 57522 - DNA, 2497 bp, Homo sapiens
gtggggccatggtggtcttgcgggcggggaagaagacctttctccccgctctctgccgcgccttcgcctgccgcggctgtcaactcgctccggagcgcggcgccgagcgcagggatacggcgcccagcggggtctcaagattctgccctccaagaaagtcttgccatgattggataggacccccagataaatattcaaaccttcgacctgttcacttttacatacctgaaaatgaatctccattggaacaaaagcttagaaaattaagacaagaaacacaagaatggaatcaacagttctgggcaaaccagaatttgacttttagtaaggaaaaagaagaatttattcactcaagactaaaaactaaaggcctgggcctgagaactgaatcaggtcagaaagcaacattgaatgcagaagaaatggcggacttctacaaggaatttttaagtaaaaattttcagaagcacatgtattataacagagattggtacaagcgcaattttgccatcaccttcttcatgggaaaagtggccctggaaaggatttggaacaagcttaaacagaaacaaaagaagaggagcaactaggagtccactctgacccagccagagtccaggtttccacaggaagcagatggagctcctttcacaggggctctgagaaaaactggagctgatctcaagaagccccacatcttcctaaggggccccatggcctgtttgggggcagggtaggtcctggggcactgtgggccgcctgcctgctgatgtgggctctaggccagcttgttgtcacgtacgtggtgtgaaataaagcccaagcactgggtgcccgtttcctgtgtttcgaattataccaattcaaaacagaactatttaaaaatattggccaggcacggtggctcacacctgtaatcccagcactttgggaggccgaggcgggtggatcacttgagatcaggagttcaagatcagtctggacaacatggcaaaaccctgtctctacaaaaaattagctgggtgtggtggcacgcacctgtaatcccagctgctctggaggctgaggcatgcgacgcttgaacccaggaggcggaggttgcagtgatccaagatcgcaccactgcactccagcctggaagaccaaacgagactctgtatcaaaaaataataataattaataaagttttactggaaaaaagaagtctgctgacgggaatgatgtggaagctgactgccaagcgatcggtgtgctggccgtggagtcagcaccaccctcactgtgagtcgtcagctggtgggtcctcacaggctgcgtcctgaatgcagtgcggtgtgaggacatgaaagcaaatgcaattttattgcatgccaaaaagtttaacttgattcttggtgttaactatgttagtagattcttcaatgctataagcaaattaacaagaaacagcagcactattttcctcttttcttaaacacgaaggttaaatggccaggcatggtgactcatacctgtaatcccaacaatttgggaggccaaggcaagcaaatcacttgagctcaggagttcgaaccagtttgggcaacatggcgaaaccctgcctctacaaaacatgcaaaaattagctgggcatggtagcatgcgcctgtagtcccagctactcgggaggctgagcttcgaggattgattgagccagtgaggtccaggctgcactaagccaagatcctaccactaggcaacagagccagaccctgtctcaaataaaaatttaaaaaaataataaaaaaggccgggcgcactggctcacgcctgtaatctcagcactttgggtggccaaggtgggcggatcacctgaggtcagttcaagaccagcctggccaaacatggtgaaaccctgtctacaaaaattagccaggcatgatggagggtgcctttagtcccagctctttgggaagctgaggcgggagaatagcatgaaccagggaggtggagggtgcctgtaatcccagctccttgggaggctaaggcaggagaatagcatgaacccggtaggtggaggttgcagtgagccgagatcgcgccactgcactccagcctgggcgacagagcaatactcccgtctcaaaaaaaaaaaaaaattaaatgattgtgatatgtgttacttttggtcacaaataaattgtaattaagattattctggccaggtgcggtggctcacgcctataatcccagcactttgggaggccgaggtgggcagatcatgaggtcaggagatcgagaccatcctgcccaacatggtgaaaccccgtttctactaaaaatgcaaaaattagctgggtgtggtggcgtgtgcctgtaatgccagctactcgggaggctgaggcacgagaatcacttgaacccagcaggcagaggttgcagtgagccaagattgcgccactgcactccagcctgacgacaaagcgagactccgtctcaaaaaaaaaaaaaaaaaaaa

SEQ ID NO: 57523 - DNA, 6215 bp, Homo sapiens
ctccccgccgccgccgcccccgagcctgcgggcggcgccgaggccgaggagcgctcgctgcagcacatgctgcgtgccatagcggaggagcgcggccgtcttagcctgcgccgcgaggtctgcggcctcgggtgcttcaaggatgaccgcatcgtcttctggacttggatgttctccacctacttcatggagaaatgggctccccggcaggacgacatgcttttctatgtgcgccggaagctggcgtactccggcagcgaaagcggtgcagacgggaggaaggcagctgagcctgaggtggaggtggaggtgtaccggcgggactccaagaagctgccaggcctgggagaccctgacatcgactgggaggagagcgtctgcctgaatctcatcctgcagaagctggactacatggtgacctgtgcggtgtgcacacgtgctgacggcggggacattcacatccataagaagaaatctcagcaagtgttcgcgtcccccagtaaacaccccatggacagcaagggggaggagtccaagatcagctaccccaacatcttcttcatgattgacagcttcgaggaggtgttcagcgacatgaccgtaggggaaggagagatggtctgtgtggagctggtggctagtgacaaaaccaacacgttccagggggtcatctttcagggctccatccgctacgaggcgctcaagaaggtgtatgacaaccgggtgagcgtggccgcccgcatggcacagaagatgtcgtttggcttctacaagtacagcaacatggagtttgtgcgcatgaagggcccccagggcaagggccacgccgagatggcggtcagccgagtgtctacaggtgacacatccccctgtgggactgaagaggactccagcccagcttcgcccatgcacgagcgggtgacctccttcagcacaccccccaccccagaacggaacaaccggcctgccttcttctccccatccctcaagaggaaggtgccccggaaccggatcgctgagatgaagaagtcgcactcggccaacgacagcgaggagttcttccgggaggacgacggtggagccgatctgcacaatgcaaccaacctgcggtctcggtccctgtcgggcacaggacggtccctggtcgggtcctggctgaagctgaacagagcagatggaaacttccttctctatgcacacttaacctacgtcacgttgccgctgcatcggattttaacagacatcctggaagttcggcagaagcccatcctgatgacctagccgcgtgcggagcctgcgcagagccccggccgggcccagccctcggagtgctgccaagtgcctacctgtccaccgccaccggggtctgcgatggcacgccagtgctggagccgcagccaggcgaggccactcgactcccggggccggggccgactccacgaacaccagcccaaactgaagtgcctcttccctcccctgctggcgctgctccgccctgtgccccccgcccatcgccccccacccatctctggagagccctctgcacccaaagaggactagagatgccgagcggccatgagagagagcggaaggagcagctgatgcccagagcggggccagagcggcgggtctatgttcacgtccccccagcagcaggcggaaccacccagccagggcactcagtgcattggactgtccacatgttcttgaggaaagccggtggaagattctggaatgccgtgcggatgaacttcagcacccgagtcagtcccagctcatcctccccagtttaccactttgttctaataggagatgggaacacgagaagtttgatggctttgccctgggctgggaatacctcacccacgcccagttccagaaaggcctccagctgagcagacggccccgatcccgccagaacggccttttgcttccagccaaagaacaccgccaacacgcacacctccaacctgggacatcccacgctgggcctcgcacggaggaacctgcagaatttggattctgagggtagtcgggaggcctcggtagccaggcagaacaggatatctgccaaagggtgtctgatgtggggtggggctggcatcctcccaggaaggttctaggtgggaccccgtcttctgggggcgggggtgtcttttcatcttccctggtttcctagaactcacttcctttgacggcgtgtgttggtcccatctctcagaccagctcactgaggcagaggagttgctcagaggctcacatgggcacccccattggttcgtgtgagcagctgcccagccccaggcctgccctcggcctggtccagcatgaaggcgtttccatctgcaaggatgcacggtaccctccccgagagcaggcctgtcccctacccaactgggaataaactggaagctgggtctctttgttgctatgtttttttgtttgaagttcccaggaatatttgaggggttccggtgatgtgtttagggatcttctctgtgggggaaaaggaagaggagggtcttgttctcccatctgtttattctttgggctctgggaacaggggactactttggggctttctccagacttttgtatgttgttattaaaagcgagctattgcatttcattctgcctcagtttgcccacctgtgaaatggggctgataccacctacctcactgaagtcccagggttcaagtgtgtggctgggtcagggcgtggtcacccgtcattctgcataggtcgggttggatgttagactcctgggatgccctcctccccctcgccctttgtaataacctaatctgagaccgtgcttggtggggggatgtgaactttctctctcccccagcagtgtctgctcaggcctgacagctcagctctgcacgatttcatgttcctaaacccatgtcttagggcagcacagagccaggtcatgtcatgccccaaagtgtggggacagagcctcagggagccccgagcatggtccagccccatttgagtgctctccggggatgccaaatgctgcttccaagtttgagtccatgtggctaaaatacacccatttcttcaggaactcttcccctggttgttctggggatcttgggagaaacacagccctgacagctcgtccgtgggaagatgaggcagtccaggttgtgaggagcacagcggcccgccctctgttctcagaggtgaggggcgggagaaggttgtctcctctggggccagcatttggccaagctcggaggcttggccagcactgctggatggctcagagcaagctgggctccccgtctgtaagatggcaaaaatgctgcccccctcacagggtgaccatgaggaccagtcacagtgatgtgtgaaagggctcgctggtcacagaaacgtgtacaaatcatgctattttagagatcagccctcaatttgtaaggcatgtgaacagggcacgcggtgggctggtggtttcatagccgacacacagcgcctaccatgtgcagctgcctgtccgaccccatcttacagacgagaaaaccagcacacaggcaccaaggaactgtccggaactaacagcaggggccggcgatgggagtcaaacccaggcacgcggcctggcctgcatgctgagccacatggtgctgtccggacagatggacagacactcggtggagtctgcctttctcaggccctaaatccctctccaaagggtacttgcgatgccggatttaaaacttgctcagagccacttagccacttgagaaccagacagtaaggtgttactcccaggtttgtttttccaaagtaacagatgacatgtggaataaagtaatagagtaacaagtggcagggccagaaccagggtccccaaagtcctggtgttggcacatttgtacttcttgtaagaccatctttaatttttctgggaacacacctgccttttgtgtaatgcggggaagactaatgcatggtgacacctagttttcctcaacaggacacttgatcccaaaacccctttaagaccttaggtttcctcagcggaaaactgtactttaatcccaaaccccctttaagacatattggggctgggcgcagtggctcacgcctgtaatcccagcactttgggaggctgagatgggtggatcacctgagatcaggagttcaagaccagcctgactaacatgctgaaaccccatgtctactaaagatagaaaaattagctggacatggtggcaggcacctgtaatcccagctactcggaaggctgaggaaggagaatcacttgaacctagtaggcagaggttgcagtgagccgagatcacgccattgcattctagcctgggcaacgagagcgaaactctgtctcaaaaaaaaaaaaaaaaaaaaaaaaaaaaaaaaaaaaaaagatacattggtctttaaacccaaaccccctttaaggcatgttggtctcaaggggatttgggattgaagcacagctttctgttgaggaaacctaggtgtcactttttagaacattaaaaagaaagttgtagggtgggcttttccatttaaaggaatgtgatgatcctaggttctgatgagtgataggtggtctccgtttataccctttcttcttttggcacctgtaagttccggtagtggccatcttacattctcatgtcctgctggaagtgcctagttgcctgcaaagccagctaaggcttattatttcaaaagaagattatttaaaacatgagtgacaggtagtcagaagagaacaaaaggacgcaagatactctatagccaagtcagcttggaggcaggatgggttgctgagtgaagtcgccgctcacttttggattcttatggactgtgagttagtcttccctctacacggagtcacaggaagggtataaatgcatgttcctgaggtgccctcccccaaagaatgtacctgcactcaaaccaggatctgtttttgctgttttaatcataaatagactagttagtagaagacttttgaagaacaaagtaaaacttttttttttcattaaaagatgtcccagaggaaaggccctgtgcagccagtatattctaatgactgcctggaccatgtcctaatatggtggttttaagttgttggccaaaatcctttaaagacatacgaaacatctgccaactttttagcgaacttaacaggtttcactgacgttttcctcaatttttgaatttaggtgggatttgctttcatgtcctgtttcaaaaaccaagtgtctcttgacagcccactggttcttcctgtcctcttgctctagtctgtatcagaaagcagaatgactgtacttttgttttacaaacaaccacctgataggacggacactccacgagataaggaaaggcacgtgcccttgagcttgaatggaagcagcctctggagggggcagccactgcccttcgagggagagcagctcttcagcagtggccagagtgccacgtgactctgcagatgacccctgggagccgggtgatgggcacctgctggggcttttgttttttctttttcactggctggcttgatcctcagtggcaaaaggacccctgagccccttctccgagccctggagcactcctcgggacaccgagtggcctcagggctgggttcagagctcctcccgcagggggagcctcagaagtggaggcagctgctgatgggtgagtttacaacttcttatcctgcctaaggcgagtaggcgtttttattccgtttccagtccttgagctcagcagatcaaaataacagtgaccctgcaaccccacagagcccgcgacacgctcgctttcttccccgccctgcccctttagtccccgctctggaaggccaggcagtttaggtgtaaataggtatcttttatggtttccaaatgaattatttgtgtgagagtaattaaatctgtaagaaaacctgttgagattcttcactatgaattatgacttctacaacatgtattttagcaaaaacacgatgctggcctccactggatagctcagtatgctgattgccagtgatagttctgtacgcgttaccaacagcgtctttattaaccctcttccacatccagtggaaatcattgctaggcggtatttgttggttggctgttagctttgctttatgatttcatgtttcttttaaaggttgttttgcatgttgaatattaaattttttttttctgtgtc

SEQ ID NO: 57524 - DNA, 6287 bp, Homo sapiens
ccggcttccagcccagacaccagccagccagtggcgttcctggctcctcgggattttccttttcctccgaagctgctgattcatccccaggctggagtcaggctcagctgtggggctgggagcatgggctctcaggctgctgctgagtggaggaactgggcctcctgggaggtgtcctccagcctctctggatgctccatggggtgcttcaaggatgaccgcatcgtcttctggacttggatgttctccacctacttcatggagaaatgggctccccggcaggacgacatgcttttctatgtgcgccggaagctggcgtactccggcagcgaaagcggtgcagacgggaggaaggcagctgagcctgaggtggaggtggaggtgtaccggcgggactccaagaagctgccaggcctgggagaccctgacatcgactgggaggagagcgtctgcctgaatctcatcctgcagaagctggactacatggtgacctgtgcggtgtgcacacgtgctgacggcggggacattcacatccataagaagaaatctcagcaagtgttcgcgtcccccagtaaacaccccatggacagcaagggggaggagtccaagatcagctaccccaacatcttcttcatgattgacagcttcgaggaggtgttcagcgacatgaccgtaggggaaggagagatggtctgtgtggagctggtggctagtgacaaaaccaacacgttccagggggtcatctttcagggctccatccgctacgaggcgctcaagaaggtgtatgacaaccgggtgagcgtggccgcccgcatggcacagaagatgtcgtttggcttctacaagtacagcaacatggagtttgtgcgcatgaagggcccccagggcaagggccacgccgagatggcggtcagccgagtgtctacaggtgacacatccccctgtgggactgaagaggactccagcccagcttcgcccatgcacgagcgggtgacctccttcagcacaccccccaccccagaacggaacaaccggcctgccttcttctccccatccctcaagaggaaggtgccccggaaccggatcgctgagatgaagaagtcgcactcggccaacgacagcgaggagttcttccgggaggacgacggtggagccgatctgcacaatgcaaccaacctgcggtctcggtccctgtcgggcacaggacggtccctggtcgggtcctggctgaagctgaacagagcagatggaaacttccttctctatgcacacttaacctacgtcacgttgccgctgcatcggattttaacagacatcctggaagttcggcagaagcccatcctgatgacctagccgcgtgcggagcctgcgcagagccccggccgggcccagccctcggagtgctgccaagtgcctacctgtccaccgccaccggggtctgcgatggcacgccagtgctggagccgcagccaggcgaggccactcgactcccggggccggggccgactccacgaacaccagcccaaactgaagtgcctcttccctcccctgctggcgctgctccgccctgtgccccccgcccatcgccccccacccatctctggagagccctctgcacccaaagaggactagagatgccgagcggccatgagagagagcggaaggagcagctgatgcccagagcggggccagagcggcgggtctatgttcacgtccccccagcagcaggcggaaccacccagccagggcactcagtgcattggactgtccacatgttcttgaggaaagccggtggaagattctggaatgccgtgcggatgaacttcagcacccgagtcagtcccagctcatcctccccagtttaccactttgttctaataggagatgggaacacgagaagtttgatggctttgccctgggctgggaatacctcacccacgcccagttccagaaaggcctccagctgagcagacggccccgatcccgccagaacggccttttgcttccagccaaagaacaccgccaacacgcacacctccaacctgggacatcccacgctgggcctcgcacggaggaacctgcagaatttggattctgagggtagtcgggaggcctcggtagccaggcagaacaggatatctgccaaagggtgtctgatgtggggtggggctggcatcctcccaggaaggttctaggtgggaccccgtcttctgggggcgggggtgtcttttcatcttccctggtttcctagaactcacttcctttgacggcgtgtgttggtcccatctctcagaccagctcactgaggcagaggagttgctcagaggctcacatgggcacccccattggttcgtgtgagcagctgcccagccccaggcctgccctcggcctggtccagcatgaaggcgtttccatctgcaaggatgcacggtaccctccccgagagcaggcctgtcccctacccaactgggaataaactggaagctgggtctctttgttgctatgtttttttgtttgaagttcccaggaatatttgaggggttccggtgatgtgtttagggatcttctctgtgggggaaaaggaagaggagggtcttgttctcccatctgtttattctttgggctctgggaacaggggactactttggggctttctccagacttttgtatgttgttattaaaagcgagctattgcatttcattctgcctcagtttgcccacctgtgaaatggggctgataccacctacctcactgaagtcccagggttcaagtgtgtggctgggtcagggcgtggtcacccgtcattctgcataggtcgggttggatgttagactcctgggatgccctcctccccctcgccctttgtaataacctaatctgagaccgtgcttggtggggggatgtgaactttctctctcccccagcagtgtctgctcaggcctgacagctcagctctgcacgatttcatgttcctaaacccatgtcttagggcagcacagagccaggtcatgtcatgccccaaagtgtggggacagagcctcagggagccccgagcatggtccagccccatttgagtgctctccggggatgccaaatgctgcttccaagtttgagtccatgtggctaaaatacacccatttcttcaggaactcttcccctggttgttctggggatcttgggagaaacacagccctgacagctcgtccgtgggaagatgaggcagtccaggttgtgaggagcacagcggcccgccctctgttctcagaggtgaggggcgggagaaggttgtctcctctggggccagcatttggccaagctcggaggcttggccagcactgctggatggctcagagcaagctgggctccccgtctgtaagatggcaaaaatgctgcccccctcacagggtgaccatgaggaccagtcacagtgatgtgtgaaagggctcgctggtcacagaaacgtgtacaaatcatgctattttagagatcagccctcaatttgtaaggcatgtgaacagggcacgcggtgggctggtggtttcatagccgacacacagcgcctaccatgtgcagctgcctgtccgaccccatcttacagacgagaaaaccagcacacaggcaccaaggaactgtccggaactaacagcaggggccggcgatgggagtcaaacccaggcacgcggcctggcctgcatgctgagccacatggtgctgtccggacagatggacagacactcggtggagtctgcctttctcaggccctaaatccctctccaaagggtacttgcgatgccggatttaaaacttgctcagagccacttagccacttgagaaccagacagtaaggtgttactcccaggtttgtttttccaaagtaacagatgacatgtggaataaagtaatagagtaacaagtggcagggccagaaccagggtccccaaagtcctggtgttggcacatttgtacttcttgtaagaccatctttaatttttctgggaacacacctgccttttgtgtaatgcggggaagactaatgcatggtgacacctagttttcctcaacaggacacttgatcccaaaacccctttaagaccttaggtttcctcagcggaaaactgtactttaatcccaaaccccctttaagacatattggggctgggcgcagtggctcacgcctgtaatcccagcactttgggaggctgagatgggtggatcacctgagatcaggagttcaagaccagcctgactaacatgctgaaaccccatgtctactaaagatagaaaaattagctggacatggtggcaggcacctgtaatcccagctactcggaaggctgaggaaggagaatcacttgaacctagtaggcagaggttgcagtgagccgagatcacgccattgcattctagcctgggcaacgagagcgaaactctgtctcaaaaaaaaaaaaaaaaaaaaaaaaaaaaaaaaaaaaaaagatacattggtctttaaacccaaaccccctttaaggcatgttggtctcaaggggatttgggattgaagcacagctttctgttgaggaaacctaggtgtcactttttagaacattaaaaagaaagttgtagggtgggcttttccatttaaaggaatgtgatgatcctaggttctgatgagtgataggtggtctccgtttataccctttcttcttttggcacctgtaagttccggtagtggccatcttacattctcatgtcctgctggaagtgcctagttgcctgcaaagccagctaaggcttattatttcaaaagaagattatttaaaacatgagtgacaggtagtcagaagagaacaaaaggacgcaagatactctatagccaagtcagcttggaggcaggatgggttgctgagtgaagtcgccgctcacttttggattcttatggactgtgagttagtcttccctctacacggagtcacaggaagggtataaatgcatgttcctgaggtgccctcccccaaagaatgtacctgcactcaaaccaggatctgtttttgctgttttaatcataaatagactagttagtagaagacttttgaagaacaaagtaaaacttttttttttcattaaaagatgtcccagaggaaaggccctgtgcagccagtatattctaatgactgcctggaccatgtcctaatatggtggttttaagttgttggccaaaatcctttaaagacatacgaaacatctgccaactttttagcgaacttaacaggtttcactgacgttttcctcaatttttgaatttaggtgggatttgctttcatgtcctgtttcaaaaaccaagtgtctcttgacagcccactggttcttcctgtcctcttgctctagtctgtatcagaaagcagaatgactgtacttttgttttacaaacaaccacctgataggacggacactccacgagataaggaaaggcacgtgcccttgagcttgaatggaagcagcctctggagggggcagccactgcccttcgagggagagcagctcttcagcagtggccagagtgccacgtgactctgcagatgacccctgggagccgggtgatgggcacctgctggggcttttgttttttctttttcactggctggcttgatcctcagtggcaaaaggacccctgagccccttctccgagccctggagcactcctcgggacaccgagtggcctcagggctgggttcagagctcctcccgcagggggagcctcagaagtggaggcagctgctgatgggtgagtttacaacttcttatcctgcctaaggcgagtaggcgtttttattccgtttccagtccttgagctcagcagatcaaaataacagtgaccctgcaaccccacagagcccgcgacacgctcgctttcttccccgccctgcccctttagtccccgctctggaaggccaggcagtttaggtgtaaataggtatcttttatggtttccaaatgaattatttgtgtgagagtaattaaatctgtaagaaaacctgttgagattcttcactatgaattatgacttctacaacatgtattttagcaaaaacacgatgctggcctccactggatagctcagtatgctgattgccagtgatagttctgtacgcgttaccaacagcgtctttattaaccctcttccacatccagtggaaatcattgctaggcggtatttgttggttggctgttagctttgctttatgatttcatgtttcttttaaaggttgttttgcatgttgaatattaaattttttttttctgtgtc

SEQ ID NO: 57525 - DNA, 3177 bp, Homo sapiens
tgcaaacgttcccaaatcttcccagtcggcttgcagagactccttgctcccaggagataaccagaagctgcatcttattgacagatggtcatcacattggtgagctggagtcatcagattgtggggcccggagtgaggctgaagggagtggatcagagcactgcctgagagtcacctctactttcctgctaccgctgcctgtgagctgaaggggctgaaccatacactcctttttctacaaccagcttgcattttttctgcccacaatgagcggggaatcaatgaatttcagcgatgttttcgactccagtgaagattattttgtgtcagtcaatacttcatattactcagttgattctgagatgttactgtgctccttgcaggaggtcaggcagttctccaggctatttgtaccgattgcctactccttgatctgtgtctttggcctcctggggaatattctggtggtgatcacctttgctttttataagaaggccaggtctatgacagacgtctatctcttgaacatggccattgcagacatcctctttgttcttactctcccattctgggcagtgagtcatgccaccggtgcgtgggttttcagcaatgccacgtgcaagttgctaaaaggcatctatgccatcaactttaactgcgggatgctgctcctgacttgcattagcatggaccggtacatcgccattgtacaggcgactaagtcattccggctccgatccagaacactaccgcgcagcaaaatcatctgccttgttgtgtgggggctgtcagtcatcatctccagctcaacttttgtcttcaaccaaaaatacaacacccaaggcagcgatgtctgtgaacccaagtaccagactgtctcggagcccatcaggtggaagctgctgatgttggggcttgagctactctttggtttctttatccctttgatgttcatgatattttgttacacgttcattgtcaaaaccttggtgcaagctcagaattctaaaaggcacaaagccatccgtgtaatcatagctgtggtgcttgtgtttctggcttgtcagattcctcataacatggtcctgcttgtgacggctgcaaatttgggtaaaatgaaccgatcctgccagagcgaaaagctaattggctatacgaaaactgtcacagaagtcctggctttcctgcactgctgcctgaaccctgtgctctacgcttttattgggcagaagttcagaaactactttctgaagatcttgaaggacctgtggtgtgtgagaaggaagtacaagtcctcaggcttctcctgtgccgggaggtactcagaaaacatttctcggcagaccagtgagaccgcagataacgacaatgcgtcgtccttcactatgtgatagaaagctgagtctccctaaggcatgtgtgaaacatactcatagatgttatgcaaaaaaaagtctatggccaggtatgcatggaaaatgtgggaattaagcaaaatcaagcaagcctctctcctgcgggacttaacgtgctcatgggctgtgtgatctcttcagggtggggtggtctctgataggtagcattttccagcactttgcaaggaatgttttgtagctctagggtatatatccgcctggcatttcacaaaacagcctttgggaaatgctgaattaaagtgaattgttgacaaatgtaaacattttcagaaatattcatgaagcggtcacagatcacagtgtcttttggttacagcacaaaatgatggcagtggtttgaaaaactaaaacagaaaaaaaaatggaagccaacacatcactcattttaggcaaatgtttaaacatttttatctatcagaatgtttattgttgctggttataagcagcaggattggccggctagtgtttcctctcatttccctttgatacagtcaacaagcctgaccctgtaaaatggaggtggaaagacaagctcaagtgttcacaacctggaagtgcttcgggaagaaggggacaatggcagaacaggtgttggtgacaattgtcaccaattggataaagcagctcaggttgtagtgggccattaggaaactgtcggtttgctttgatttccctgggagctgttctctgtcgtgagtgtctcttgtctaaacgtccattaagctgagagtgctatgaagacaggatctagaataatcttgctcacagctgtgctctgagtgcctagcggagttccagcaaacaaaatggactcaagagagatttgattaatgaatcgtaatgaagttggggtttattgtacagtttaaaatgttagatgtttttaattttttaaataaatggaatactttttttttttttttaaagaaagcaactttactgagacaatgtagaaagaagttttgttccgtttctttaatgtggttgaagagcaatgtgtggctgaagacttttgttatgaggagctgcagattagctaggggacagctggaattatgctggcttctgataattattttaaaggggtctgaaatttgtgatggaatcagattttaacagctctcttcaatgacatagaaagttcatggaactcatgtttttaaagggctatgtaaatatatgaacattagaaaaatagcaacttgtgttacaaaaatacaaacacatgttaggaaggtactgtcatgggctaggcatggtggctcacacctgtaatcccagcattttgggaagctaagatgggtggatcacttgaggtcaggagtttgagaccagcctggccaacatggcgaaacccctctctactaaaaatacaaaaatttgccaggcgtggtggcgggtgcctgtaatcccagctacttgggaggctgaggcaagagaatcgcttgaacccaggaggcagaggttgcagtgagccgagatcgtgccattgcactccagcctgggtgacaaagcgagactccatctcaaaaaaaaaaaaaaaaaaaaaggaaagaactgtcatgtaaacataccgacatgtttaaacctgacaatggtgttatttgaaactttatattgttcttgtaagctttaactatatctctctttaaaatgcaaaataatgtcttaagattcaaagtctgtatttttaaagcatggctttggctttgcaaaataaaaaatgtgttttgtacatgaa

SEQ ID NO: 57526 - DNA, 3463 bp, Homo sapiens
tgcaaacgttcccaaatcttcccagtcggcttgcagagactccttgctcccaggagataaccaggtaaaggagtatgaaagtttgggtacaaactcattgctgcaaattgaaaaccatgcaaaggctgtcttcctctggggagttcaatgcctctctttttcttatcactttaccattggttggactttgattccagggatcctacgattactcaataccctacaggatatacatggttaaccatttgcatttgggcaaataggcgttacttttcaataggaagtggcaatccagaacttgcttttgggcaattctagtagctcaccgcttttttcttaatgactgctagaagctgcatcttattgacagatggtcatcacattggtgagctggagtcatcagattgtggggcccggagtgaggctgaagggagtggatcagagcactgcctgagagtcacctctactttcctgctaccgctgcctgtgagctgaaggggctgaaccatacactcctttttctacaaccagcttgcattttttctgcccacaatgagcggggaatcaatgaatttcagcgatgttttcgactccagtgaagattattttgtgtcagtcaatacttcatattactcagttgattctgagatgttactgtgctccttgcaggaggtcaggcagttctccaggctatttgtaccgattgcctactccttgatctgtgtctttggcctcctggggaatattctggtggtgatcacctttgctttttataagaaggccaggtctatgacagacgtctatctcttgaacatggccattgcagacatcctctttgttcttactctcccattctgggcagtgagtcatgccaccggtgcgtgggttttcagcaatgccacgtgcaagttgctaaaaggcatctatgccatcaactttaactgcgggatgctgctcctgacttgcattagcatggaccggtacatcgccattgtacaggcgactaagtcattccggctccgatccagaacactaccgcgcagcaaaatcatctgccttgttgtgtgggggctgtcagtcatcatctccagctcaacttttgtcttcaaccaaaaatacaacacccaaggcagcgatgtctgtgaacccaagtaccagactgtctcggagcccatcaggtggaagctgctgatgttggggcttgagctactctttggtttctttatccctttgatgttcatgatattttgttacacgttcattgtcaaaaccttggtgcaagctcagaattctaaaaggcacaaagccatccgtgtaatcatagctgtggtgcttgtgtttctggcttgtcagattcctcataacatggtcctgcttgtgacggctgcaaatttgggtaaaatgaaccgatcctgccagagcgaaaagctaattggctatacgaaaactgtcacagaagtcctggctttcctgcactgctgcctgaaccctgtgctctacgcttttattgggcagaagttcagaaactactttctgaagatcttgaaggacctgtggtgtgtgagaaggaagtacaagtcctcaggcttctcctgtgccgggaggtactcagaaaacatttctcggcagaccagtgagaccgcagataacgacaatgcgtcgtccttcactatgtgatagaaagctgagtctccctaaggcatgtgtgaaacatactcatagatgttatgcaaaaaaaagtctatggccaggtatgcatggaaaatgtgggaattaagcaaaatcaagcaagcctctctcctgcgggacttaacgtgctcatgggctgtgtgatctcttcagggtggggtggtctctgataggtagcattttccagcactttgcaaggaatgttttgtagctctagggtatatatccgcctggcatttcacaaaacagcctttgggaaatgctgaattaaagtgaattgttgacaaatgtaaacattttcagaaatattcatgaagcggtcacagatcacagtgtcttttggttacagcacaaaatgatggcagtggtttgaaaaactaaaacagaaaaaaaaatggaagccaacacatcactcattttaggcaaatgtttaaacatttttatctatcagaatgtttattgttgctggttataagcagcaggattggccggctagtgtttcctctcatttccctttgatacagtcaacaagcctgaccctgtaaaatggaggtggaaagacaagctcaagtgttcacaacctggaagtgcttcgggaagaaggggacaatggcagaacaggtgttggtgacaattgtcaccaattggataaagcagctcaggttgtagtgggccattaggaaactgtcggtttgctttgatttccctgggagctgttctctgtcgtgagtgtctcttgtctaaacgtccattaagctgagagtgctatgaagacaggatctagaataatcttgctcacagctgtgctctgagtgcctagcggagttccagcaaacaaaatggactcaagagagatttgattaatgaatcgtaatgaagttggggtttattgtacagtttaaaatgttagatgtttttaattttttaaataaatggaatactttttttttttttttaaagaaagcaactttactgagacaatgtagaaagaagttttgttccgtttctttaatgtggttgaagagcaatgtgtggctgaagacttttgttatgaggagctgcagattagctaggggacagctggaattatgctggcttctgataattattttaaaggggtctgaaatttgtgatggaatcagattttaacagctctcttcaatgacatagaaagttcatggaactcatgtttttaaagggctatgtaaatatatgaacattagaaaaatagcaacttgtgttacaaaaatacaaacacatgttaggaaggtactgtcatgggctaggcatggtggctcacacctgtaatcccagcattttgggaagctaagatgggtggatcacttgaggtcaggagtttgagaccagcctggccaacatggcgaaacccctctctactaaaaatacaaaaatttgccaggcgtggtggcgggtgcctgtaatcccagctacttgggaggctgaggcaagagaatcgcttgaacccaggaggcagaggttgcagtgagccgagatcgtgccattgcactccagcctgggtgacaaagcgagactccatctcaaaaaaaaaaaaaaaaaaaaaggaaagaactgtcatgtaaacataccgacatgtttaaacctgacaatggtgttatttgaaactttatattgttcttgtaagctttaactatatctctctttaaaatgcaaaataatgtcttaagattcaaagtctgtatttttaaagcatggctttggctttgcaaaataaaaaatgtgttttgtacatgaa

SEQ ID NO: 57527 - DNA, 3804 bp, Homo sapiens
taaagtcatcaaaacaacgttatatcctgtgtgaaatgctgcagtcaggatgccttgtggtttgagtgccttgatcatgtgccctaaggggatggtggcggtggtggtggccgtggatgacggagactctcaggccttggcaggtgcgtctttcagttcccctcacacttcgggttcctcggggaggaggggctggaaccctagcccatcgtcaggacaaagatgctcaggctgctcttggctctcaacttattcccttcaattcaagtaacaggaaacaagattttggtgaagcagtcgcccatgcttgtagcgtacgacaatgcggtcaaccttagctgcaagtattcctacaatctcttctcaagggagttccgggcatcccttcacaaaggactggatagtgctgtggaagtctgtgttgtatatgggaattactcccagcagcttcaggtttactcaaaaacggggttcaactgtgatgggaaattgggcaatgaatcagtgacattctacctccagaatttgtatgttaaccaaacagatatttacttctgcaaaattgaagttatgtatcctcctccttacctagacaatgagaagagcaatggaaccattatccatgtgaaagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcctgacacggacgcctatccagaagccagccggctggcagcccccatctgctcaatatcactgctctggataggaaatgaccgccatctccagccggccacctcaggcccctgttgggccaccaatgccaatttttctcgagtgactagaccaaatatcaagatcattttgagactctgaaatgaagtaaaagagatttcctgtgacaggccaagtcttacagtgccatggcccacattccaacttaccatgtacttagtgacttgactgagaagttagggtagaaaacaaaaagggagtggattctgggagcctcttccctttctcactcacctgcacatctcagtcaagcaaagtgtggtatccacagacattttagttgcagaagaaaggctaggaaatcattccttttggttaaatgggtgtttaatcttttggttagtgggttaaacggggtaagttagagtagggggagggataggaagacatatttaaaaaccattaaaacactgtctcccactcatgaaatgagccacgtagttcctatttaatgctgttttcctttagtttagaaatacatagacattgtcttttatgaattctgatcatatttagtcattttgaccaaatgagggatttggtcaaatgagggattccctcaaagcaatatcaggtaaaccaagttgctttcctcactccctgtcatgagacttcagtgttaatgttcacaatatactttcgaaagaataaaatagttctcctacatgaagaaagaatatgtcaggaaataaggtcactttatgtcaaaattatttgagtactatgggacctggcgcagtggctcatgcttgtaatcccagcactttgggaggccgaggtgggcagatcacttgagatcaggaccagcctggtcaagatggtgaaactccgtctgtactaaaaatacaaaatttagcttggcctggtggcaggcacctgtaatcccagctgcccaggaggctgaggcatgagaatcgcttgaacctggcaggcggaggttgcagtgagccgagatagtgccacagctctccagcctgggcgacagagtgagactccatctcaaacaacaacaacaacaacaacaacaacaacaaaccacaaaattatttgagtactgtgaaggattatttgtctaacagttcattccaatcagaccaggtaggagctttcctgtttcatatgtttcagggttgcacagttggtctctttaatgtcggtgtggagatccaaagtgggttgtggaaagagcgtccataggagaagtgagaatactgtgaaaagggatgttagcattcattagagtatgaggatgagtcccaagaaggttctttggaaggaggacgaatagaatggagtaatgaaattcttgccatgtgctgaggagatagccagcattaggtgacaatcttccagaagtggtcaggcagaaggtgccctggtgagagctcctttacagggactttatgtggtttagggctcagagctccaaaactctgggctcagctgctcctgtaccttggaggtccattcacatgggaaagtattttggaatgtgtcttttgaagagagcatcagagttcttaagggactgggtaaggcctgaccctgaaatgaccatggatatttttctacctacagtttgagtcaactagaatatgcctggggaccttgaagaatgcccttcagtggccctcaccatttgttcatgcttcagttaattcaggtgttgaaggagcttaggttttagaggcacgtagacttggttcaagtctcgttagtagttgaatagcctcaggcaagtcactgcccacctaagatgatggttcttcaactataaatggagataatggttacaaatgtctcttcctatagtataatctccataagggcatggcccaagtctgtctttgactctgcctatccctgacgtttagtagcatgcccgacatacaatgttagctattggtattattgccatatagataaattatgtataaaaattaaactgggcaatagcctaagaaggggggaatattgtaacacaaatttaaacccactacgcagggatgaggtgctataatatgaggaccttttaacttccatcattttcctgtttcttgaaatagtttatcttgtaatgaaatataaggcacctcccacttttatgtatagaaagaggtcttttaatttttttttaatgtgagaaggaagggaggagtaggaatcttgagattccatatcgaaaatactgtactttggttgatttttaagtgggcttccattccatggatttaatcagtcccaagaagatcaaactcagcagtacttgggtgctgaagaactgttggatttaccctggcacgtgtgccacttgcccagcttcttgggcacacagagttcttcaatccaagttatcagattgtatttgaaaatgacagagctggagagttttttgaaatggcagtggcaaataaataaatacttttttttaaatggaaagacttgatctatggtaataaatgattttgttttctgactggaaaaataggcctactaaagatgaatcacacttgagatgtttcttactcactctgcacagaaacaaagaagaaatgttatacagggaagtccgttttcactattagtatgaaccaagaaatggttcaaaaacagtggtaggagcaatgctttcatagtttcagatatggtagttatgaagaaaacaatgtcatttgctgctattattgtaagagtcttataattaatggtactcctataatttttgattgtgagctcacctatttgggttaagcatgccaatttaaagagaccaagtgtatgtacattatgttctacatattcagtgataaaattactaaactact

SEQ ID NO: 57528 - DNA, 1125 bp, Homo sapiens
gtctcccccactgtcagcacctcttctgtgtggtgagtggaccgcttaccccactaggtgaagatgtcagcccaggagagctgcctcagcctcatcaagtacttcctcttcgttttcaacctcttcttcttcgtcctcggcagcctgatcttctgcttcggcatctggatcctcatcgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgagctcgggttcatgacgctctcgatattcctgtgcagaaacctggaccacgtctacaaccggctcgctcgataccgttaggccccgccctccccaaagtcccgccccgcccccgtcacgtgcgctgggcacttccctgctgcctgtaaatatttgtttaatccccagttcgcctggagccctccgccttcacattcccctggggacccacgtggctgcgtgcccctgctgctgtcacctctcccacgggacctggggctttcgtccacagcttcctgtccccatctgtcggcctac

SEQ ID NO: 57529 - DNA, 1674 bp, Homo sapiens
gtcctccacttcctggggaggtagctgcagaataaaaccagcagagactccttttctcctaaccgtcccggccaccgctgcctcagcctctgcctcccagcctctttctgagggaaaggacaagatgaagtggaaggcgcttttcaccgcggccatcctgcaggcacagttgccgattacagaggcacagagctttggcctgctggatcccaaactctgctacctgctggatggaatcctcttcatctatggtgtcattctcactgccttgttcctgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaacagccaggggatttcaccactcaaaggccagacctgcagacgcccagattatgagacacaggatgaagcatttacaacccggttcactcttctcagccactgaagtattcccctttatgtacaggatgctttggttatatttagctccaaaccttcacacacagactgttgtccctgcactctttaagggagtgtactcccagggcttacggccctggccttgggccctctggtttgccggtggtgcaggtagacctgtctcctggcggttcctcgttctccctgggaggcgggcgcactgcctctcacagctgagttgttgagtctgttttgtaaagtccccagagaaagcgcagatgctagcacatgccctaatgtctgtatcactctgtgtctgagtggcttcactcctgctgtaaatttggcttctgttgtcaccttcacctcctttcaaggtaactgtactgggccatgttgtgcctccctggtgagagggccgggcagaggggcagatggaaaggagcctaggccaggtgcaaccagggagctgcaggggcatgggaaggtgggcgggcaggggagggtcagccagggcctgcgagggcagcgggagcctccctgcctcaggcctctgtgccgcaccattgaactgtaccatgtgctacaggggccagaagatgaacagactgaccttgatgagctgtgcacaaagtggcataaaaaacatgtggttacacagtgtgaataaagtgctgcggagcaagaggaggccgttgattcacttcacgctttcagcgaatgacaaaatcatctttgtgaaggcctcgcaggaagacccaacacatgggacctataactgcccagcggacagtggcaggacaggaaaaacccgtcaatgtactaggatactgctgcgtcattacagggcacaggccatggatggaaaacgctctctgctctgctttttttctactgttttaatttatactggcatgctaaagccttcctattttgcataataaatgcttcagtgaaaaaaaaaaaaaaaaaaaaaaaaa

SEQ ID NO: 57530 - DNA, 1677 bp, Homo sapiens
gtcctccacttcctggggaggtagctgcagaataaaaccagcagagactccttttctcctaaccgtcccggccaccgctgcctcagcctctgcctcccagcctctttctgagggaaaggacaagatgaagtggaaggcgcttttcaccgcggccatcctgcaggcacagttgccgattacagaggcacagagctttggcctgctggatcccaaactctgctacctgctggatggaatcctcttcatctatggtgtcattctcactgccttgttcctgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaacagccaggggatttcaccactcaaaggccagacctgcagacgcccagattatgagacacaggatgaagcatttacaacccggttcactcttctcagccactgaagtattcccctttatgtacaggatgctttggttatatttagctccaaaccttcacacacagactgttgtccctgcactctttaagggagtgtactcccagggcttacggccctggccttgggccctctggtttgccggtggtgcaggtagacctgtctcctggcggttcctcgttctccctgggaggcgggcgcactgcctctcacagctgagttgttgagtctgttttgtaaagtccccagagaaagcgcagatgctagcacatgccctaatgtctgtatcactctgtgtctgagtggcttcactcctgctgtaaatttggcttctgttgtcaccttcacctcctttcaaggtaactgtactgggccatgttgtgcctccctggtgagagggccgggcagaggggcagatggaaaggagcctaggccaggtgcaaccagggagctgcaggggcatgggaaggtgggcgggcaggggagggtcagccagggcctgcgagggcagcgggagcctccctgcctcaggcctctgtgccgcaccattgaactgtaccatgtgctacaggggccagaagatgaacagactgaccttgatgagctgtgcacaaagtggcataaaaaacatgtggttacacagtgtgaataaagtgctgcggagcaagaggaggccgttgattcacttcacgctttcagcgaatgacaaaatcatctttgtgaaggcctcgcaggaagacccaacacatgggacctataactgcccagcggacagtggcaggacaggaaaaacccgtcaatgtactaggatactgctgcgtcattacagggcacaggccatggatggaaaacgctctctgctctgctttttttctactgttttaatttatactggcatgctaaagccttcctattttgcataataaatgcttcagtgaaaaaaaaaaaaaaaaaaaaaaaaa

SEQ ID NO: 57531 - DNA, 3151 bp, Homo sapiens
cccggccagacaccctcacctgcggtgcccagctgcccaggctgaggcaagagaaggccagaaaccatgcccatggggtctctgcaaccgctggccaccttgtacctgctggggatgctggtcgcttcctgcctcggacggctcagctggtatgacccagatttccaggcaaggctcacccgttccaactcgaagtgccagggccagctggaggtctacctcaaggacggatggcacatggtttgcagccagagctggggccggagctccaagcagtgggaggaccccagtcaagcgtcaaaagtctgccagcggctgaactgtggggtgcccttaagccttggccccttccttgtcacctacacacctcagagctcaatcatctgctacggacaactgggctccttctccaactgcagccacagcagaaatgacatgtgtcactctctgggcctgacctgcttagaaccccagaagacaacacctccaacgacaaggcccccgcccaccacaactccagagcccacagctcctcccaggctgcagctggtggcacagtctggcggccagcactgtgccggcgtggtggagttctacagcggcagcctggggggtaccatcagctatgaggcccaggacaagacccaggacctggagaacttcctctgcaacaacctccagtgtggctccttcttgaagcatctgccagagactgaggcaggcagagcccaagacccaggggagccacgggaacaccagcccttgccaatccaatggaagatccagaactcaagctgtacctccctggagcattgcttcaggaaaatcaagccccagaaaagtggccgagttcttgccctcctttgctcaggtttccagcccaaggtgcagagccgtctggtggggggcagcagcatctgtgaaggcaccgtggaggtgcgccagggggctcagtgggcagccctgtgtgacagctcttcagccaggagctcgctgcggtgggaggaggtgtgccgggagcagcagtgtggcagcgtcaactcctatcgagtgctggacgctggtgacccaacatcccgggggctcttctgtccccatcagaagctgtcccagtgccacgaactttgggagagaaattcctactgcaagaaggtgtttgtcacatgccaggatccaaaccccgcaggcctggccgcaggcacggtggcaagcatcatcctggccctggtgctcctggtggtgctgctggtcgtgtgcggcccccttgcctacaagaagctagtgaagaaattccgccagaagaagcagcgccagtggattggcccaacgggaatgaaccaaaacatgtctttccatcgcaaccacacggcaaccgtccgatcccatgctgagaaccccacagcctcccacgtggataacgaatacagccaacctcccaggaactcccgcctgtcagcttatccagctctggaaggggttctgcatcgctcctccatgcagcctgacaactcctccgacagtgactatgatctgcatggggctcagaggctgtaaagaactgggatccatgagcaaaaagccgagagccagacctgtttgtcctgagaaaactgtccgctcttcacttgaaatcatgtccctatttctaccccggccagaacatggacagaggccagaagccttccggacaggcgctgctgccccgagtggcaggccagctcacactctgctgcacaacagctcggccgcccctccacttgtggaagctgtggtgggcagagccccaaaacaagcagccttccaactagagactcgggggtgtctgaagggggccccctttccctgcccgctggggagcggcgtctcagtgaaatcggctttctcctcagactctgtccctggtaaggagtgacaaggaagctcacagctgggcgagtgcattttgaatagttttttgtaagtagtgcttttcctccttcctgacaaatcgagcgctttggcctcttctgtgcagcatccacccctgcggatccctctggggaggacaggaaggggactcccggagacctctgcagccgtggtggtcagaggctgctcatctgagcacaaagacagctctgcacattcaccgcagctgccagccaggggtctgggtgggcaccaccctgacccacagcgtcaccccactccctctgtcttatgactcccctccccaaccccctcatctaaagacaccttcctttccactggctgtcaagcccacagggcaccagtgccacccagggccctgcacaaaggggcgcctagtaaaccttaaccaacttggttttttgcttcacccagcaattaaaagtcccaagctgaggtagtttcagtccatcacagttcatcttctaacccaagagtcagagatggggctggtcatgttcctttggtttgaataactcccttgacgaaaacagactcctctagtacttggagatcttggacgtacacctaatcccatggggcctcggcttccttaactgcaagtgagaagaggaggtctacccaggagcctcgggtctgatcaagggagaggccaggcgcagctcactgcggcctctaagaaggtgaagcaacatgggaacacatcctaagacacatcctaagacaggtcctttctccacgccatttgatgctgtatctcctgggagcacaggcatcaatggtccaagccgcataataagtctggaagagcaaaagggagttactaggatatggggtgggctgctcccagaatctgctcagctttctgcccccaccaacaccctccaaccaggccttgccttctgagagcccccgtggccaagcccaggtcacagatcttcccccgaccatgctgggaatccagaaacagggaccccatttgtcttcccatatctggtggaggtgagggggctcctcaaaagggaactgagaggctgctcttagggagggcaaaggttcgggggcagccagtgtctcccatcagtgccttttttaataaaagctctttcatctatagtttggccaccatacagtggcctcaaagcaaccatggcctacttaaaaaccaaaccaaaaataaagagtttagttgaggagaaaaaaaaaaaaaaaaaaaaaaaaa

SEQ ID NO: 57532 - DNA, 3248 bp, Homo sapiens
catgcgtgtcggagaggagagagcagagagagacacaggaacaagaacagcaaagggtagagcagacctgcgccaggggcgcacaacggccgtgtccacctcccggccccaagatggtgcttcccacaggcagccacgcgtagcagccagagacagctccagacatgtggctcttcttcgggatcactggattgctgacggcagccctctcaggtcatccatctccagccccacctgaccagctcaacaccagcagtgcagagagtgagctctgggagccaggggagcggcttccggtccgtctgacaaacgggagcagcagctgcagcgggacggtggaggtgcggctcgaggcgtcctgggagcccgcgtgcggggcgctctgggacagccgcgccgccgaggccgtgtgccgagcactgggctgcggcggggcggaggccgcctctcagctcgccccgccgacccctgagctgccgcccccgcctgcagccgggaacaccagcgtagcagctaatgccactctggccggggcgcccgccctcctgtgcagcggcgccgagtggcggctctgcgaggtggtggagcacgcgtgccgcagcgacgggaggcgggcccgtgtcacctgtgcagagaaccgcgcgctgcgcctggtggacggtggcggcgcctgcgccggccgcgtggagatgctggagcatggcgagtggggatcagtgtgcgatgacacttgggacctggaggacgcccacgtggtgtgcaggcaactgggctgcggctgggcagtccaggccctgcccggcttgcacttcatgcccggccgcgggcctatccaccgggaccaggtgaactgctcgggggccgaagcttacctgtgggactgcccggggctgccaggacagcactactgcggccacaaagaggacgcgggcgtggtgtgctcagagcaccagtcctggcgcctgacagggggcgctgaccgctgcgaggggcaggtggaggtacacttccgaggggtctggaacacagtgtgtgacagtgagtggtacccatcggaggccaaggtgctctgccagtccttgggctgtggaactgcggttgagaggcccaaggggctgccccactccttgtccggcaggatgtactactcatgcaatggggaggagctcaccctctccaactgctcctggcggttcaacaactccaacctctgcagccagtcgctggcagccagggtcctctgctcagcttcccggagtttgcacaatctgtccactcccgaagtccctgcaagtgttcagacagtcactatagaatcttctgtgacagtgaaaatagagaacaaggaatctcgggagctaatgctcctcatcccctccatcgttctgggaattctcctccttggctccctcatcttcatagccttcatcctcttgagaattaaaggaaaatatgccctccccgtaatggtgaaccaccagcacctacccaccaccatcccggcagggagcaatagctatcaaccggtccccatcaccatccccaaagaagttttcatgctgcccatccaggtccaggccccgccccctgaggactcagactctggctcggactcagactatgagcactatgacttcagcgcccagcctcctgtggccctgaccaccttctacaattcccagcggcatcgggtcacagatgaggaggtccagcaaagcaggttccagatgccacccttggaggaaggacttgaagagttgcatgcctcccacatcccaactgccaaccctggacactgcattacagacccgccatccctgggccctcagtatcacccgaggagcaacagtgagtcgagcacctcttcgggggaggattactgcaatagtcccaaaagcaagctgcctccatggaacccccaggtgttttcttcagagaggagttccttcctggagcagcccccaaacttggagctggccagcacccagccagccttttcagcagggcccccggctgatgacagctccagcacctcatccggggagtggtaccagaacttccagccaccaccccagcccccttcggaggagcagtttggctgtccagggtcccccagccctcagcctgactccaccgacaacgatgactacgatgacatcagcgcagcctaggccggggccagccgaggctcctggggtggctctgaccctctggcctcctgctctacctactccctttcccctttcccaccctcccagctcacctccccatggagctgagaggcctcccttggagagatggaaggaaacgttataccttgtacccctcggtctccatccatcaagccaaacctgctgccacagccctcccccggccccagatagcagccccagggaggatgctgcctccaagaggtgtgagccctctgtctcggggatgaacaagcagagtctgggctacctcttgacagctggtggaggggagttggggagctggactggatgactctggaggccccttccaaacctcaagtgtccggcgctttgattgcctgagtttctgacacttcagggcccagaggtcctgcgaggggcagaactggacccccatgccagtgctgctgcaggagggcccatatactagggtctgctgagctgttgtcactgatcggtgggcgctgggggggtagggtagcacaccagctgtcccaggctttgctccgggcggtaactgcacttgggcagggaatatagccttcctgggcacaactagctgacaatgacaggttgactgtgtacccccaaccaaggagctggggcccaaggccagtcctgccccagagacactccaagtccgccaggggcacagaccagttctgcagtgactgtccctggacaatgggtctttattctgagtttcctatggtttacaaagagggccccagcccagccccaccacagatcccagagataggggcccagtctccatgggggcaaggagcatagagatgttttccaggaaggggctcagaagctgcactaggccccgagtccccatgtgtctccttgaattgatgaggatgctcctgggagggatgcgtgactatgtggtgttgcacccggggctgcaaacgtctccgtgcagcccccagagagaggcccatgggctcagaccaggctttgttgtcctgctctgagtatcctgagattaaactgaattgctgaatgaaaaaaaaaaaaaaaaaaaaa

SEQ ID NO: 57533 - DNA, 2574 bp, Homo sapiens
cctggcgcagccgcagcagcgacgcgagcgaactcggccgggcccgggcgcgcgggggcgggacgcgcacgcggcgagggcggcgggtgagccgggggcggggacgggggcgggacgggggcgaagggggcggggacgggggcgcccgccggcctaacgggattaggagggcgcgccacccgcttccgctgcccgccggggaatcccccgggtggcgcccagggaagttcccgaacgggcgggcataaaagggcagccgcgccggcgccccacagctctgcagctcgtggcagcggcgcagcgctccagccatgtcgcgcggcctccagcttctgctcctgagctgcgcctacagcctggctcccgcgacgccggaggtgaaggtggcttgctccgaagatgtggacttgccctgcaccgccccctgggatccgcaggttccctacacggtctcctgggtcaagttattggagggtggtgaagagaggatggagacaccccaggaagaccacctcaggggacagcactatcatcagaaggggcaaaatggttctttcgacgcccccaatgaaaggccctattccctgaagatccgaaacactaccagctgcaactcggggacatacaggtgcactctgcaggacccggatgggcagagaaacctaagtggcaaggtgatcttgagagtgacaggatgccctgcacagcgtaaagaagagacttttaagaaatacagagcggagattgtcctgctgctggctctggttattttctacttaacactcatcattttcacttgtaagtttgcacggctacagagtatcttcccagatttttctaaagctggcatggaacgagcttttctcccagttacctccccaaataagcatttagggctagtgactcctcacaagacagaactggtatgagcaggatttctgcaggttcttcttcctgaagctgaggctcaggggtgtgcctgtctgttacactggaggagagaagaatgagcctacgctgaagatggcatcctgtgaagtccttcacctcactgaaaacatctggaaggggatcccaccccattttctgtgggcaggcctcgaaaaccatcacatgaccacatagcatgaggccactgctgcttctccatggccaccttttcagcgatgtatgcagctatctggtcaacctcctggacattttttcagtcatataaaagctatggtgagatgcagctggaaaagggtcttgggaaatatgaatgcccccagctggcccgtgacagactcctgaggacagctgtcctcttctgcatcttggggacatctctttgaattttctgtgttttgctgtaccagcccagatgttttacgtctgggagaaattgacagatcaagctgtgagacagtgggaaatatttagcaaataatttcctggtgtgaaggtcctgctattactaaggagtaatctgtgtacaaagaaataacaagtcgatgaactattccccagcagggtcttttcatctgggaaagacatccataaagaagcaataaagaagagtgccacatttatttttatatctatatgtacttgtcaaagaaggtttgtgtttttctgcttttgaaatctgtatctgtagtgagatagcattgtgaactgacaggcagcctggacatagagagggagaagaagtcagagagggtgacaagatagagagctatttaatggccggctggaaatgctgggctgacggtgcagtctgggtgctcgcccacttgtcccactatctgggtgcatgatcttgagcaagttccttctggtgtctgctttctccattgtaaaccacaaggctgttgcatgggctaatgaagatcatatacgtgaaaattatttgaaaacatataaagcactatacagattcgaaactccattgagtcattatccttgctatgatgatggtgttttggggatgagagggtgctatccatttctcatgttttccattgtttgaaacaaagaaggttaccaagaagcctttcctgtagccttctgtaggaattcttttggggaagtgaggaagccaggtccacggtctgttcttgaagcagtagcctaacacactccaagatatggacacacgggagccgctggcagaagggacttcacgaagtgttgcatggatgttttagccattgttggctttcccttatcaaacttgggcccttcccttcttggtttccaaaggcatttattgctgagttatatgttcactgtccccctaatattagggagtaaaacggataccaagttgatttagtgtttttacctctgtcttggctttcatgttattaaacgtatgcatgtgaagaagggtgtttttctgttttatattcaactcataagactttgggataggaaaaatgagtaatggttactaggcttaatacctgggtgattacataatctgtacaacgaacccccatgatgtaagtttacctatgtaacaaacctgcacttatacccatgaacttaaaatgaaagttaaaaataaaaaacatatacaaataaaaaaaa

SEQ ID NO: 57534 - DNA, 10469 bp, Homo sapiens
gcggcggcggcagcggcggcggcggcggcggcgcgggggttgagtcgtggtggtgcggacgcgctcgtgctcgggaactatcggattaaacttgaatcgagtgaaattacacaaaggagcgccgcggaggaggcggcccggggacccggacaccctgaaactcaccagagacccgttcgcccccggccaactccgtgcccgtggattcagccccctggccgcagctgccgagccaactccggagcccgctctgcgttttgttttcccctcggcactaggcagcggaggagcccgaccgacccggacctatatccagactttgcctgacactgcagggtccaagagaattaaagaaatatggaatgacatgaagaagattagttaaggattataggctttgagggcaaacacctcagtgaagtgaagcacaggcaagctcctgagctgtggtttggaggagccgtgtgttggaagaagatggcagatccaggaatgatgagtctttttggcgaggatgggaatattttcagtgaaggtcttgaaggcctcggagaatgtggttacccggaaaatccagtaaatcctatgggtcagcaaatgccaatagaccaaggctttgcctctttacagccatcccttcatcatccttcaactaatcaaaatcaaacaaagctgacacattttgatcactataatcagtatgaacaacaaaagatgcatctgatggatcagccgaacagaatgatgagcaacacccctgggaacggactcgcgtctccgcactcgcagtatcacacccctcccgttcctcaggtgccccatggtggcagtggtggcggtcagatgggtgtctaccctggcatgcagaatgagaggcatgggcaatcctttgtggacagcagctccatgtggggccccagggctgttcaggtaccagaccagatacgagccccctaccagcagcagcagccacagccgcagccaccgcagccggctccgtcggggccccctgcacagggccaccctcagcacatgcagcagatgggcagctatatggcacgtggggatttttccatgcagcagcatggtcagccacagcagaggatgagccagttttcccaaggccaagagggcctcaatcagggaaatccttttattgccacctcaggacctggccacttgtcccacgtgccccagcagagtcccagcatggcaccttccttgcgtcactcggtgcagcagttccatcaccacccctctactgctctccatggagaatccgttgcccacagtcccagattctccccgaatcctccccaacaaggggctgttaggccgcaaacccttaactttagttctcggagccagacagtcccctctcctactataaacaactcagggcagtattctcgatatccttacagtaacctaaatcagggattagttaacaatacagggatgaatcaaaatttaggccttacaaataatactccaatgaatcagtccgtaccaagataccccaatgctgtaggattcccatcaaacagtggtcaaggactaatgcaccagcagcccatccaccccagtggctcacttaaccaaatgaacacacaaactatgcatccttcacagcctcagggaacttatgcctctccacctcccatgtcacccatgaaagcaatgagtaatccagcaggcactcctcctccacaagtcaggccgggaagtgctgggataccaatggaagttggcagttatccaaatatgccccatcctcagccatctcaccagccccctggtgccatgggaatcggacagaggaatatgggccccagaaacatgcagcagtctcgtccatttataggcatgtcctcggcaccaagggaattgactgggcacatgaggccaaatggttgtcctggtgttggccttggagacccacaagcaatccaggaacgactgatacctggccaacaacatcctggtcaacagccatcttttcagcagttgccaacctgtcctccactgcagcctcacccgggcttgcaccaccagtcttcacctccacaccctcatcaccagccttgggcacagctccacccatcaccccagaacaccccgcagaaagtgcctgtgcatcagcattccccgtcggagccctttctagagaaaccagtgccggatatgactcaggttagtggaccgaatgctcagctagtgaagagtgatgattacctgccatcaatagaacagcagccacaacaaaagaagaagaaaaagaaaaacaaccacattgtagcagaggatcccagtaaaggttttggtaaagatgacttccctggtggggtagataaccaagaactaaataggaactcactggatgggtcccaagaagaaaaaaagaaaaagaaaaggtcaaaggcaaaaaaagacccgaaggaaccgaaagaacccaaggagaaaaaagagcccaaggaacccaagaccccgaaagcccctaagattcccaaagagccaaaggaaaagaaagcaaaaactgccacgccaaaacccaaatccagcaaaaagtcaagtaataagaaacctgactcagaagcaagtgctttgaagaaaaaggtcaacaagggaaaaacagaaggttctgaaaattcagacttagacaaaacacccccaccatctcctcctcctgaagaagatgaggacccaggtgttcagaagagacggtccagcagacaggtgaagagaaagcgctacactgaagacctggagttcaagatttctgatgaggaggcagatgatgcagatgctgctgggagggattccccctccaacacctcccagtcagaacagcaggaatctgttgatgcagaaggcccagtggtagaaaaaattatgagcagtcgttcagtaaaaaagcagaaggaatctggagaggaggtagaaattgaggaattctatgtgaaatacaaaaacttctcttatcttcattgtcagtgggcatctatagaagatctggaaaaagataagagaattcagcaaaaaattaaacgatttaaggcaaagcagggccagaacaagttcctttcagagattgaggatgagctttttaatccagattatgtggaggttgaccggataatggactttgcacgtagcacagatgaccggggagagcctgtgactcactatctggtgaagtggtgttcacttccttatgaagacagcacgtgggagcggaggcaggacatagatcaagcaaagatcgaggagtttgagaaactaatgtccagggagccggaaacagagcgtgtggagcgacctcctgctgatgattggaagaaatcggagagttccagggagtataaaaacaataacaaactcagggaataccagttggagggagtaaactggctacttttcaattggtacaacatgcgaaactgcattttagcagatgaaatgggtttgggaaaaactatccagtccattacatttctctatgagatatatttgaaaggaatccatggcccttttttagtaattgccccattgtccacaatccccaactgggaaagggaattccgaacctggacagagttgaacgtggttgtgtatcatgggagtcaagctagtcgtcggaccattcagttgtatgaaatgtacttcaaagatccccagggtcgagtgataaaggggtcctataagtttcatgccatcatcactacatttgagatgattttgactgattgtcctgagctgcggaatattccatggcgctgtgtagtcattgatgaagcccacaggctgaagaacaggaactgcaagctgttggagggactcaagatgatggacttggaacacaaagtgctgctgacgggaaccccactccagaacactgtggaagaactcttcagcttgcttcatttcttggaaccaagtcgcttcccttcagaaaccacatttatgcaagaatttggtgatctaaaaacagaagagcaggtgcaaaaacttcaagctattctaaagccaatgatgttgagacgtctcaaagaggatgtagaaaagaacttggcccccaaagaagaaactattattgaagttgagctaacaaacattcagaagaaatattaccgagccatccttgagaagaatttcacatttctttccaaaggcggtggtcaagctaacgtacctaacctattaaacactatgatggaattgcggaagtgctgcaatcatccgtaccttatcaatggtgctgaagagaaaattttggaagagtttaaagaaacacacaatgcagagtctccagattttcagctccaggcaatgatccaggctgctggcaagctagtgctgattgacaagctgctgccaaaactgaaggctggtggccacagggtgcttatcttttcccagatggtgcgctgcttggacatactggaagactacctcattcaaagacggtacccatatgaaaggatcgacggccgagtaagaggcaacctccgccaggcagctatcgacagattctccaaacctgattctgataggtttgttttcctcctgtgtacaagggcaggaggtttaggcattaacctcactgctgctgatacctgcatcatctttgattcagactggaatccccaaaatgacctccaggctcaggctagatgtcatagaataggacagagcaaatctgtgaaaatctacaggctgattacaagaaattcctatgaaagggaaatgttcgacaaggctagtttgaaactgggcctggataaagctgtgctacagtctatgagtggaagagaaaatgctaccaatggggtacaacagctttccaagaaagaaatagaggatcttctacgaaaaggggcctatggtgcactcatggatgaggaggatgaagggtctaaattctgtgaagaagatattgatcagatcctcctacgtcgaacccacaccattaccattgagtcagaagggaaaggttccacatttgctaaggccagttttgttgcatctggaaataggacagatatttccttggatgatccaaatttctggcaaaagtgggctaagaaggctgaattggatattgatgccttaaatgggaggaacaacctggttattgatactccaagagtgagaaagcagaccaggctctacagtgcagtgaaggaagatgagctgatggagttctcagacttggaaagtgattctgaagaaaagccctgtgcaaagccacggcgtccccaggataagtcacagggctatgcaaggagtgaatgtttcagggtggagaagaatctgcttgtctatggttggggacggtggacagacattctttcccacggacgctataaacgccaactcactgagcaagatgtagaaaccatctgcagaaccatcctggtgtactgtcttaatcattacaaaggggatgagaatatcaaaagcttcatctgggatctgatcacacccacagcggatggccagactcgagccttggtcaaccattccggtttgtcagctcctgtgccaaggggaaggaagggaaagaaggtgaaagcccagagcacacagccggtggtgcaggatgccgactggctggccagctgcaacccagatgccctgttccaggaggacagctacaagaaacacctgaagcatcactgtaacaaggtcctgctgcgtgtccgcatgctgtactacctaagacaagaagtgataggagaccaggcggataagatcttagagggtgctgactcaagtgaagccgatgtgtggatccctgaacctttccatgctgaagttcctgcagattggtgggataaggaagcagacaaatccctcttaattggagtgttcaaacatggctatgagaagtacaactccatgcgagctgaccccgcgctgtgctttctggaacgagtcggtatgcctgatgccaaggccatagctgccgagcaaagaggaacagacatgctagcagatggtggtgacgggggagaatttgatagagaagatgaagacccagaatataaaccaaccagaacaccgttcaaagatgaaatagatgaatttgcaaattctccttcagaggataaggaagaatccatggaaatacatgccacaggcaagcacagtgagagtaatgctgagttaggccaactttactggcctaacacttcaaccctgactacacgtctgcgccggctcattactgcctatcagcgcagctataaaaggcaacagatgaggcaagaggccctaatgaagactgaccggcgcagacggcggcctcgagaggaagtgagagctctggaagcggaaagggaagctattatatctgagaagcggcaaaagtggacaagaagagaagaggctgatttttaccgtgtggtatccacctttggggttatttttgaccctgtgaaacagcaatttgactggaaccaatttagagcctttgccaggcttgacaaaaaatctgatgagagtttggagaaatacttcagttgttttgtggccatgtgtaggcgagtatgtcgaatgcccgtcaagccagatgatgaaccgcccgacctctcctccataattgagccgatcacagaggagcgagcctctcgaactctgtaccgcattgagctgctacggaagatccgcgagcaggttctccatcacccccagctgggagagaggcttaagctctgccagccaagcttggatctgccagagtggtgggagtgtggacggcatgaccgagacttgctggttggtgctgctaaacacggggtcagtcggacggattatcacatcctcaatgaccctgagttatccttcttggatgcacataaaaactttgctcaaaacagaggggcaggtaatacatcttccttgaacccactggcagttggatttgtccagactcctccagtcatctcatctgctcatattcaagatgagagggtactggaacaagccgaaggcaaagtggaggagcctgaaaacccagctgccaaggagaaatgtgagggcaaagaagaggaagaagaaaccgatggcagcgggaaggagagcaagcaggaatgtgaggcagaggccagctctgtgaaaaatgaactgaaaggtgttgaggtcggcgcagacactgggtccaaatctatttcagagaaaggttccgaagaggatgaagaggaaaagctggaggatgacgataagtcggaagagtcttcccagcccgaagcaggagctgtctctagagggaagaattttgatgaagaaagcaatgcttccatgagcactgctagagatgaaacccgagatggattctacatggaggacggagatccttcagtagctcagctccttcatgaaagaacatttgccttctcgttttggcctaaggatagagtaatgataaaccgcttagacaacatctgtgaagcagtgttgaaaggcaaatggccagtaaataggcgccagatgtttgatttccaaggcctcatcccaggttacacacccaccacagtggacagccccttgcagaagaggagctttgctgagctctccatggtcggccaagccagcattagtgggagtgaggacatcactacgtctcctcagttgtcaaaggaagatgccctcaacctctctgtccctcgccagcggaggaggaggaggagaaaaatcgaaattgaggccgaaagagctgccaagaggcgaaatctcatggagatggttgcccagcttcgagagtctcaggtggtctcagaaaatggacaagaaaaagttgtagatttatcaaaggcctcaagagaggcaacaagctctacctcaaatttttcatctctttcttcaaagtttatcttgcctaatgtctcaacaccagtgtctgatgcctttaagactcaaatggaactgctccaagcaggcctttcgcgcacacccacaaggcatctccttaatggctccctagtggatggagagcctcccatgaagaggaggcggggaaggaggaaaaatgtggagggacttgatctgcttttcatgagccacaaacggacgtcattgagtgcagaggatgctgaggtgaccaaagcttttgaagaagatatagagaccccaccaacaagaaacattccttctcccggacagctggacccagacacacggatccctgttatcaatcttgaagatgggactaggctggtgggggaagatgctcctaaaaataaggatttagttgaatggctgaagctgcaccctacttacactgttgatatgccaagttatgtaccaaagaatgcagatgtgctgttttcctcatttcagaaaccgaaacagaaacgacatagatgtcgaaaccctaataaattggatataaacactttgacaggagaagaaagggtgcctgttgtcaataaacgaaatgggaagaagatgggtggagctatggcgcctccaatgaaggatctacccaggtggctggaagaaaatcctgaatttgcagttgctccagactggactgatatagttaagcagtctggttttgttcctgagtcgatgtttgaccgccttctcactgggcctgtagtgcggggagagggagcgagcagaagaggaagaaggcccaaaagtgagatcgccagagcagccgcggccgccgctgctgtggcctccacgtcagggatcaaccctttgctggtgaacagcctgtttgctggaatggacctgacgagccttcagaatctccagaatctccagtcgctccagctggcaggcctcatgggcttccctccaggactggcaacagctgccaccgccggaggcgatgcgaagaaccctgctgctgtgctgcccctgatgctgccaggaatggcgggcctgcccaacgtgtttggcttgggcgggctgttgaataaccctctgtcagctgctactggaaacaccactactgcttctagtcaaggagaaccggaagacagcacttcaaaaggagaggagaaaggaaatgagaatgaagacgagaacaaagactctgagaaaagcacagatgctgtttcggctgctgactctgcgaatggatctgttggtgctgctactgccccggctggattgccctcaaacccgctagccttcaaccctttcctcctgtccacaatggccccgggcctcttctacccatccatgtttctacctccaggactggggggattgacgctgcctgggttcccagcattggcaggacttcagaatgccgtgggctccagcgaagaaaaggctgctgacaaggctgagggaggaccctttaaagatggagagacccttgaaggcagcgatgccgaggagagcctggataagactgcagagtcctccctcttagaagacgaaatagcacagggtgaagagctagactcacttgatgggggggatgaaatagaaaacaatgaaaatgatgaataaccagtaccagttccagttcaagtgtttaaaacttttgacaagtggtagtcctactgtttacactcacagttaatgttcatacctagttttataagctgttctgtaacatagtgtagcaaaaaaaaaagttcaagtcatgttatacaggtgtgtcaaaaggtatcttggtcattaagtattgtgcagtgcattatttattatccctaggagagatgaaatttgagaggtgatcatgtctttttaaggaaacttacataatgctctgctttttttttttctcttggtaccattggtattataataaagagcaatttgtaactgagtggcactaatggaagaaagtgctgctcaaaggaagtatgaagttatatatttaattttttaattttaatttttaatttttttgctgtgaaggtcaagctgaaatttaccatacatatcatacttgctcatttgtttccctttttgactgtatgggggttcccacactcgtgcatacacacacatccatacactctgacaatctccacgctagtgtgaacgcctctgtcccgaggcgcagcaataataaggcagctgttgaatgtgaagggtccctttggaaaattaacctactgggagggttcttgccagacagaactacagttccattgtctcgtggtcttgtaatgcactggtaaaaacaaaataaatagatgaataaataaagagtgagagaagagagaatcaggtaccttttttaaattaaaggactttgttactttagccacaaagctaaaacagcattacctcagctctaaactagccttgaagtttacagacatgactttgtaaatgtattgtttttctttgttgtgatgtccttttatttttttctttgaaaactgctatcatgtaagataaaatgtaaattgctgccaactgtagtaatgatgcttttaataaaagtgacccatgatatgcagagatgtaaaaaaaaaaaaaaaaaaaaaaaaaaa

SEQ ID NO: 57535 - DNA, 8725 bp, Homo sapiens
actcgcagggagctcactcctcggcggtgccgcagccctgtccggactccactgcgcctctgaggggctcaaatacgaattcaagatccgtggccgttcacatggtttcaaggcacaatgagactcactggcccttggaaactttggctttggatgtcaatatttctgcttcctgcttccacttccgtgaccgttagggacaagacagaagagtcatgccctatcctgagaatagagggacatcagctgacatatgacaacataaacaaacttgaagtttcaggttttgatctaggagacagcttttctctaagacgtgcattttgtgaaagtgataaaacctgtttcaaattgggaagtgcacttcttattagagacactattaagatatttcccaaaggccttcctgaggagtactcagtagctgccatgtttcgagtacgaagaaacgccaaaaaggaacggtggtttctgtggcaggttttaaaccagcagaatattccacagatttctatagtagttgatggtggaaagaaggtggtggaatttatgtttcaagccacagagggagatgtgttgaactacatttttagaaatcgagaactccgtcctttgtttgatcgtcagtggcacaaacttggcattagtatacaatcccaggtcatttcactttatatggattgtaatttaattgcgaggaggcagactgatgaaaaggacactgtggatttccatggacggacagttattgctacgcgagcttcagatggcaagcctgtggatattgaacttcaccaacttaaaatctactgcagtgcaaacctcatagctcaagaaacatgttgtgaaatatcagatactaagtgcccagagcaggatggctttggaaatattgcatcatcatgggtaactgctcatgccagtaaaatgtcttcatatctgccagcaaagcaggaacttaaagaccagtgccagtgcattccaaacaagggagaagcaggattaccaggagctccgggttcacctgggcagaaagggcataaaggagagccgggtgaaaatggtttacatggtgctccaggattccctggtcaaaagggagagcaaggttttgaaggcagcaaaggagaaactggtgaaaagggtgaacaaggagaaaaaggagatccagctctggctggccttaatggagaaaatggtttgaaaggtgacttgggtcctcatggtccacctggcccaaaaggagaaaagggagatacaggacccccaggaccaccagccttacctggttccctggggatacaaggcccccaaggtccacctggaaaagagggtcagaggggaagacgagggaaaacaggacctcccggaaaaccaggacccccaggaccacctggacctcctggaatacaaggaatacaccaaactcttggtggatattataacaaggataacaagggaaatgatgaacatgaagctggaggcctgaaaggagacaagggtgaaactggactaccaggatttccagggtctgttggccctaaaggacaaaaaggagaacctggagagccttttacaaaaggagaaaaaggagatagaggagaacctggggtaataggatcacagggagtaaagggtgaacctggagatcccggaccccctggtttaataggaagcccaggactaaagggtcagcaaggatctgcaggctccatgggacccagaggaccgccaggagatgttggattgccaggagaacatggtatcccaggaaaacaaggcattaaaggagaaaagggagatccgggtgggatcataggccctcccgggcttccaggtccaaaaggtgaggctggtcctccagggaaaagcctgccaggggaaccaggattagatggaaatcctggagcacctggtccacgtgggccaaagggtgaaagaggacttccaggtgttcacggttccccaggggacataggcccacaagggataggaattcctggcagaacaggcgcccaaggaccagctggagagccaggtattcagggtcctcgaggtctccctgggttgccaggaactccagggactccagggaatgatggagttccagggagagatggaaagccaggcctgccaggccccccaggtgacccgattgcacttcctctcttgggagacatcggtgctttgctcaagaatttctgtggcaactgccaagccagtgtcccagggctgaaaagcaacaaaggagaagaaggaggtgctggtgagcctggaaagtatgattccatggcccggaagggtgatatagggccacggggtcctccaggaatcccaggaagagagggaccaaagggaagcaaaggagagcggggctaccctgggatacctggggagaaaggtgatgagggtcttcaaggaattccaggcattccaggtgctccaggcccgactggaccccctggcttaatgggaagaactggacatcctggtcccacaggagcaaaaggtgaaaagggcagcgacggaccccctgggaaacccggaccacctggaccacctggtattccatttaatgaacgaaacggcatgagcagtttatataaaattaagggaggtgtgaatgttcccagttacccagggccacccggtcctcctggcccaaaaggcgatcctggcccagtgggagagcctggtgcaatggggttgccaggattagaaggatttccaggtgtaaagggagatcgaggcccagcaggtcccccaggaatagcagggatgtcgggaaaacctggtgccccagggcctccaggagttccaggggaaccgggtgagagaggacctgttggagatataggtttccctggaccagaaggaccctcaggaaagccaggaataaatggaaaagatggaataccaggtgctcagggcatcatgggtaagcctggagacagaggccccaaaggagaacgtggtgatcaggggattccaggagacagaggctcacaaggtgaacggggaaaaccaggccttacaggcatgaagggggccatcggtcctatgggtccaccaggaaacaagggctccatgggatcccctggccaccaaggccctccaggctctccaggcatccctggcattccggctgatgcagtttcatttgaagaaataaagaagtatattaatcaagaggtcctaaggatttttgaagagaggatggctgtattcctatcccagctcaagctgccagcagcaatgttggctgcccaagcttatgggagacctgggccaccagggaaggatgggttgcctgggccaccaggagaccctggaccccaaggctacagaggacagaagggagaaagaggtgaacctggaattgggctgccagggagtccaggtcttcctgggacttcagctctgggtttgccaggctcaccaggtgccccaggcccccagggccccccaggacccagtggaagatgtaacccagaagattgcctctatcctgtgtctcatgcccatcagcgcacaggtgggaattgaacacacctgaagaagacttggttcctggtaacatttccttgccactggagctctcttaataccgtcaaaccctcatcatctgtgggttgctttttttttttttttttttttttgggagtaagccaggcattaaaagcaaccgtttgaatcctattcctatagcaattgcaaatcagcattttttgatttttcccaaattcattccatatgttttgctttacaattgctatgatttttactcagagttttatatgaaatatgcaagtaaatcttatcgttagttcttcttcaaaaggaaattgcatcttgtgacttagtagactgatgatgatatccattttgtagactcatcaacatgtggttggcctttgatttctgaattttaaagtttcagacttatcttttccttggtgtttaaatttactatcattgctaaacatctcgtcaacttttttgatatagtgcattgctcctgttgaatgttttttgactactttttataacttaagaatttttataccatctacatctatcctacttatgcagaaaaataggcaataagaacttcattttacaatttagttttcaaaaaaaaaatgcaggaaactgttttatcagggagcccaaacacccagcatagccaactactgaaatgattttgttaattctgtataatgagctcaattcaaagcaatcaccactggcatgaataagtactgcatgaaaagggagtatcaaattccagttttgtatgagttctgcaaaaaaagcctaatattctgtggtcccctcactcagtctctcatttggtaaacagaaagctgttttccctacaaggtgcttggtggtgaagccaccaagctgtctttggtactcttaaagcttcagtggcctagcaagatctttgggcccttgtatccattatccttatgacctcatcaccctcagactttaagacaagaagccaccatcaaaacaaaggatgggatacgtatagaatggactcacttgtcctagaagatgaatgtgtagtgtcagcaaatgcatgttaagaaggtgaagcccaaaagctcttaaggagaattgtatttctccagaagctgcagcaagaggtacagctcaacaaaggaaaaccacaggactggatatgcaactagtgctcagaccaaagagttcacacccactctaaaaccatgtcctctgaaaagaaacaaaaatacagtgatcatcaaatgcctaaacagtctttctgttggttagctgtacattcattgaggaactgttgattggcaggcactgattctctagaacactgggcatgaggatgttgcagaaatctagatggtgggtcccacagatgtgagaacatgctgcaagagcctgccagccacagcaatcaggactcacagctcttcaaggagcagtgcagatttcaatttggctaaaacaggatgattgcttttgtctgtttactgaaaaatgagtttagaaaggctagcccactgacattggaaaaagctgtgaacagagttgtgtctgaggaatgtgcctaatttaaggcagggtttgttccaatgcatccgtgatttgaaccggttttcattatagattaatgaactgctggtcaggtactgtctacaatggctgtgcatacctataacattttaggtatttcatattgaattatgctgtatatttcaattccaagtttatttattttccaaggttattttatttattgtaagcattttgacattgattttttttttttcgttttctttcttgtgcaatacctacaatggtgctgtgttttaaacttacacaattgggacatacgtatgtgttttcttagtaaaatggtaatttatcccgaaaaagtgtacatagatctaaaatttggtgctatgtgtatatcttgagcttttaatttgttgaattttctaaacgcttacaacttatctgccactcatattaatttacttgaatttgtcataaagctaaatattttatatgttttcaaagattattttttcatattaataggttgtttatctttttgcctgtttgctaatttaaaaatatttattttatcattttaatgttttcatggacttttttgctgatggtaatcaactttttttgttttttggtttttgagttgttcttgtcatagacataaaaagacaattcattttcttgttttattaactctgttcatttttattctacaaaatatgtcatgcattctttcttatgaattgtatatttagaaatctttctaaataccattaaggcttgactggttaattcctatttcaaggatttggatttattcaggtaatttgatgggatggggaaatataatattgtgtgatgcatattacaaagtggacttgtcacaatgacacaaactcattttttgtaactgggaaatatgactaaatttgacgtaactagagaaacaaggctgtatccacatggtacaagcctttctcaccctactctattatttaccttcagatactttttcctgcctcagctctgtacacatgatatgcaacaaagggcagcaagaaatgctgggtccacctaatttaacacaaaatgaagttgagattcggcagttgcccaattcctttaataaaaagaaactaaataatttgggccccaaagtagggtgggaagttttcctctaaatgacttgatggttgccaaatcccttgcaccattttattccattccaaaacatgtgtttatttccacatagatgttaatgatgttcaaagcaggggagaagaattattcaatttcatgaataactcttgtttgcactccagaaaacaacatacatgtttaaatacaaaataattatgggccatgacgacgattaatattaaaactgtgatttccatatacaagtatgtttgagttccaatcttacattttataccaagttcaaaacactttcagatagaagtctttctatgcaaagattaaagtatgacttcaattcatatttatggcctttggaatccaaagaaaaacagaagaataattcatggatttgttcattgttctttccaactgaaggcagtaaccattacttctaaccgtaacacaaacacagcaagttttaaccttttaaacttttcactttgtgagcaaagtaaccccataagtttatttccctatttcatggtattgtttaaactttaaaattttagtcacttaaagaacttaagcaattatattaaaatacgttgtctgtgaaaattatcatttgatatttggcttataaagtaatttttatgaatctgttttatgagttaggtaagatttagcctttctgcagtctgtctcatctgttgggaacctgtgatatacctccatttgtccacaagatggtgtttaaaacaatttgttcagaagaactgagcaaactaacagaaatacaaggctacgaacagtttagtggacaactaaatcagactcttgcctttgcacttttttttaacttttgtagataatttttgttaatttgttttgttaatttatgtttttcctaattttaagcatctttatgaaacaggcacagtaccctttggtttgttgactgttttgattttatttctttggtggatatatatgtacttatacacttagttaacatgcagattaactagtcataactgtttatacaccactctcatattttagtgatcaatatgaagacagctaaataattatcctactttttagacaggacagatactctcaacagacaagaaaaaagatttagcttatcacaagaagcagacaatttataaaactacacaatgtctaaactctatgttgctcagtgtacttaaaattttacagttatatttgtataacgtttatatttttctagaatacatcactatttacaaaagtacaattagaaacactgttttttttaagtaccgtttttattttcataacactaataatacactgggattgagaatttctgttaagtgttttgctgacgttgttttaatgaatactcaaaaaagctttgcagatttgtccattgctcttgttcttaaattatttttcatacttgtctgtatccaccttctgaagacacacaagtgtttactgtcgcagtttcccagcgttatttcttaatacttgagtgttgacacatttttgtaccatcccccttttgtaccatctctgctcacaaagattatatgcaggctttgaagaggaggagatgcagaagataattgaatttgtatcttgtatgcctatgtaattcaaagtgacttagtccattgaattgtgttcatttattagttggctggttaagatagcattaattatcttaaatttattcaactactaaaagtctcaggcaataggacagatgagtgtcatcatttttattgtgtggcatacttggagctataatccaaacgttttactcaacaaaataatgctagagtaactgatcaatttggttaaattgaatgaagaaccaagtgaacacagagaaaacttattcggacaagtagacccagcacagcaaaaatttgtctgaaagataagacaagcttataagaccaaagctaagtctaagaaaatctaaatggaaaaaaaattgcgtgttcagatccaatagtgagtgatgtggtacaactggaggagttagctacttgcttcatgaatttgtcaaaagtgaatactaataaagtgggaggcttcactaaatgagggggtaaataagatttaagtttatcagaagtgtgtgtattgtgtgaccatactaagcttctgggtgtaagtaaagatgctggctattttacaactttttattgtattgtgttatgcaaagtacattttggagataaatgtttttcagcacattaatgtctttaaattcaggttgtattgggtgtattttacaactatttatttttaaataacatttagggtgtgttttcccccattttgtttgttctctatcttacctcatcaaactctttacgatttaattgaatatactcatgttaagtgcaatggcattagttttattcaaaatcccacatgggcataatgctttgaggccttgattcctacatgttcattatgcataatgagcttgtcacctatctcagcaataaaggttctgacc

SEQ ID NO: 57536 - DNA, 1991 bp, Homo sapiens
tggaacactttatgttgaactgtggtagaggaaacaagacagttctgtctgcagaagcccattatggctgtaactggagatgacacagatgaggaaactgaacttgccccaagtcacatggctgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacaaaaaa

SEQ ID NO: 57537 - DNA, 1955 bp, Homo sapiens
tggaacactttatgttgaactgtggtagaggaaacaagacagttctgtctgcagaagcccattatggctgtaactggagatgacacagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacaaaaaa

SEQ ID NO: 57538 - DNA, 2065 bp, Homo sapiens
gtaaaatgctgctgacagatttagagttaactagctcaccactgcctctgcctccaagctgccttttagactgaatagcttttcttgttagccctactttaacatttcttttgaagtggttgtctgcttgaagagggaaacacgtcatgaaactgtaatgcatgaacagaactcaggagttgtctggccagcttagtgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacaaaaaa

SEQ ID NO: 57539 - DNA, 2108 bp, Homo sapiens
gtaaaatgctgctgacagatttagagttaactagctcaccactgcctctgcctccaagctgccttttagactgaatagcttttcttgttagccctactttaacatttcttttgaagtggttgtctgcttgaagagggaaacacgtcatgaaactgtaatgcatgaacagaactcaggagttgtctggccagcttagtggtaagatcgagcctcctactgaggccgtccctgcatgcgcctgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacaaaaaa

SEQ ID NO: 57540 - DNA, 2144 bp, Homo sapiens
gtaaaatgctgctgacagatttagagttaactagctcaccactgcctctgcctccaagctgccttttagactgaatagcttttcttgttagccctactttaacatttcttttgaagtggttgtctgcttgaagagggaaacacgtcatgaaactgtaatgcatgaacagaactcaggagttgtctggccagcttagtggtaagatcgagcctcctactgaggccgtccctgcatgcgcctgatgaggaaactgaacttgccccaagtcacatggctgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacaaaaaa

SEQ ID NO: 57541 - DNA, 2188 bp, Homo sapiens
gctggcggccggcagggggcggagttcgagcctggatttttttcctcggggcctcccccgggaggccgtcccggcgtgggggaggggaggacggggcgggaggacgcggttcggtcggctgcagcgctacttttggtccggggtcggcagggaggccgcggctaccgcatcacagctgacgtgaggactacgtggggccgctgccggctccgggttgctgggcggcggcgccgctgctgagcggcggtcgggctcgccgtctccacctcctcgcgtccgtaatcagtgacgaggtccgctacgtaaatccctttgcggcggctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacaaaaaa

SEQ ID NO: 57542 - DNA, 2519 bp, Homo sapiens
gataaataaagaaaacaggaaaggaggaaagcattgattacaaatatcttaacaatgagcaaatgtgcaaggaaaaaatatattaagacaaatccaagacaaatgaccatggaaacagttgaatcccagcatgatggaagtataacagcttctttgacagagagcaagtctgctcatgtgcagactcagactggccaaaattcaatccctgctttagctcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacattgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacaaaaaa

SEQ ID NO: 57543 - DNA, 2330 bp, Homo sapiens
gataaataaagaaaacaggaaaggaggaaagcattgattacaaatatcttaacaatgagcaaatgtgcaaggaaaaaatatattaagacaaatccaagacaaatgaccatggaaacagttgaatcccagcatgatggaagtataacagcttctttgacagagagcaagtctgctcatgtgcagactcagactggccaaaattcaatccctgctttagctcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacactgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacaaaaaa

SEQ ID NO: 57544 - DNA, 2687 bp, Homo sapiens
gctggcggccggcagggggcggagttcgagcctggatttttttcctcggggcctcccccgggaggccgtcccggcgtgggggaggggaggacggggcgggaggacgcggttcggtcggctgcagcgctacttttggtccggggtcggcagggaggccgcggctaccgcatcacagctgacgtgaggactacgtggggccgctgccggctccgggttgctgggcggcggcgccgctgctgagcggcggtcgggctcgccgtctccacctcctcgcgtccgtaatcagtgacgaggtccgctacgtaaatccctttgcggcgggataaataaagaaaacaggaaaggaggaaagcattgattacaaatatcttaacaatgagcaaatgtgcaaggaaaaaatatattaagacaaatccaagacaaatgaccatggaaacagttgaatcccagcatgatggaagtataacagcttctttgacagagagcaagtctgctcatgtgcagactcagactggccaaaattcaatccctgctttagctcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacaatgaggaaactgaacttgccccaagtcacatggctgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacaaaaaa

SEQ ID NO: 57545 - DNA, 5108 bp, Homo sapiens
tgcttggcacataagcaaccctgtataaacattagttgctattatcactgtcattatcatcatcatcatcacctccgtcttctgagcactctgggaatccaggggctggccatgtcttctagggcacctgcccatgctcaagggccagcctctctgcacggggctccaggcagggctgcagcctgtgaagtacagcatcccttctcctccttagagcacagacccttcctcagagaaggtgctacttcttcccacaccactttagggtctgtcctggtggctcatgcctttaatcccagcattttgggaggctgaggcaggcagatcacttgcgcccaggagtttgtgactagcctgggcaatgtggcaaaaccttgtctttacaaaaagtacaaaacaatcagtcgggcttggtggtgcgtcccagctacttgagactgaggtgggagaatcgcttgagcccaggaggccgagtctgcagtgagccaagattgcgccactgcactccagcctgggtgacagagcgagaccgtcataaataaataaataaatagataagtaagaaagacctggcattgtactcaccctgatgtgtcccctgtcctacctaggagatgaaagttgcacagcggatggcacagaagtcagcagctgtgcctgagctgtgggcccggtgcctgctggggcactgctatgggctgtggttcctgtgtctgcctgcctatgtgcggtcggcaccctcccgagtgcaggcactgcacacagcctaccatgtgctgcgccagatggagagcggcaaggtggtgctccctgatgaggtaggcaatctatgtgaccatgctcatacccaggcccagtgagccttgtgcagctggagagggctgtgagagggaaacttggtggagactaaggaaagaagttgcagagccccagagctgggcagattatctataaacattcgtcgagtgaataagcatgttcagggtttagcagtgaagactgtagggtggcagggtcagcagaaagggtgggtggctctgaggtagccccaggacctgccaggggccagtgatgtctgtgagaattggggaggcaggaagagggtgcttgctgagactttggttttggttgagagtgagtctcccattgtcctgtgcctctcctggcccaggtgtgttaccgggtactgatgcagctctgctcacactatgggcagcctgtgctgtctgtgcgggtcatgctggagatgcgtcaggcaggcattgtgcccaacaccatcacctatggctactacaataaggtacctactttggggtgaggggtgggatggcagctgtgccagggtgtgtgaggggaggctgctgctgctcccctcgctccttggagattgggctggtactgtttgcctaggtcctggaaccactgtcatccacattgcactcctgtggtgccttagcacctacagtttctcagacgaggctgctttgattcccactcatgacagccctgcctacaactaatagtgtcagccgctaagccaggcacgggtccatacgcatcacacattttacatcattttatcttcacgacagccctatgaggtgggatgatcattatccccatcttatagaagaggagatgaggttgtagagagttagtaactcgtccaaggtcccgcagcaaagaagttaaggagtgagaatatgggcacagggctgggtgcagtggctcatgcctgtaatctcagcactttgggaggctgaggcaggcagatcacctgagatcaggagttcgagaccagcctggccaacatggtgaaaccctgtctctattaaaaatacagaaattagcttggtgtggtggtgggtgcctgtagtcccagctacttgggaggctgaggcaagagaatcacttgaacccgggaggcagaggttgcagtgagccaagattgcgccactgcgctccagcctgggcgacagagcaagactccgtctcgaaaaaaaagaaaaaagaatatgggcagaggcatatccatatctcccgaattcaggcccttagccatgatactaaactgcctcctgttttttagatgaggagactaatgaccaaataaatgaaatgatttcttcagagccatatattttatatttctaagcagcaaggtctgggtacaaattttctccactgcctctgggttcttctaggccccttgggaggcagctgctgcctactgtctcttctgggctcttgttcctggctgagccattggccggacagtcctagacaggatgtctgcaggggaagggcggtccctggggctccaagacagggagtgggtatgaggcagggttagggtgtcgaggtaggccatcctgatgggcactgtgcttggtaggctgtgttggaaagcaagtggccgtctggcacaccaggtgggcgtctgcgctgggccaagctccggaatgttgtcctgggggctgctcagttccgccagcccttgagagaacggcaacagcagcagcagcagcaacagcagcagcagcagcagcagcagcaggagcaggtgtcagcacatcaagaggcaggcagctcccaggcagagccctatttggagcgcccttcccctactcgccctcttcagcgccagactacttgggctgggcgaagtctgagagacccagcctcaccccctggacgcctggtgaagagtggtagcctgggcagtgcccgaggggcacagcccactgtggaggccggtgtggcccacatgatagaggccttgggggtcctggaaccccggggatcacctgtgccctggcacgatggaagtctctcagacctgagcctgacaggggaggagccgctccctggaggcagcccagggggctcaggctcagccctgagtgcccagtccactgaggccctggaagggctaagtgggcggggacccaaggctggtgggcgacaggatgaggcaggcaccccccgacgagggctgggtgcccgcctccaacagctgctcactccttcccgccactcccctgcctcccgcattcccccacctgagctgcctcctgacctgccacccccagcccgccgcagccccatggacagtcttctgcacccccgggagcgccctggatccactgcctccgagagctcagcctctctgggcagtgagtgggacctctcagaatcttctctcagcaacctgagtcttcgccgttcctcagagcgcctcagtgacacccctggatccttccagtcaccttccctggaaattctgctgtccagctgctccctgtgccgtgcctgtgattcgctggtgtatgatgaggaaatcatggctggctgggcacctgatgactctaacctcaacacaacctgccccttctgcgcctgcccctttgtgcccctgctcagtgtccagacccttgattcccggcccagtgtccccagccccaaatctgctggtgccagtggcagcaaagatgctcctgtccctggtggtcctggccctgtgctcagtgaccgaaggctctgccttgctctggatgagccccagctctgcaacgggcacatggggggagcctcccggcgggttgagagtggggcatgggcatacctgagccccctggtgctgcgtaaggagctggagtcgctggtagagaacgagggcagtgaggtgctggcgttgcctgaactgccctctgcccaccccatcatcttctggaaccttttgtggtatttccaacggctacgcctgcccagtattctaccaggcctggtgctggcctcctgtgatgggccttcgcactcccaggccccatctccttggctaacccctgatccagcctctgttcaggtacggctgctgtgggatgtactgacccctgaccccaatagctgcccacctctctatgtgctctggagggtccacagccagatcccccagcgggtggtatggccaggccctgtacctgcatcccttagtttggcactgttggagtcagtgctgcgccatgttggactcaatgaagtgcacaaggctgtggggctcctgctggaaactctagggcccccacccactggcctgcacctgcagaggggaatctaccgtgagatattattcctgacaatggctgctctgggcaaggaccacgtggacatagtggccttcgataagaagtacaagtctgcctttaacaagctggccagcagcatgggcaaggaggagctgaggcaccggcgggcgcagatgcccactcccaaggccattgactgccgaaaatgttttggagcacctccagaatgctagagaccttaagcttccctctccagcctagggtggggaagtgaggaagaagggattctagagttaaactgcttccctgttgccttcatggagttgggaacaggctgggaaggatgcccagtcaaaggctccaagcgaggacaacaggaagagggatccactgttaccaaaagtcctgattcccccatcaccaacctacccagtttgttcgtgctgatgttgggggagatctggggggagttggtacagctctgttcttcccttgtcctataccgggaactcccctccagggtacccacagatctgcattgccctggtcattttagaagtttttgttttaaaaaacaactggaaagatgcagagctactgagcctttgccctgaatgggaggtagggatgtcattctccaccaataatggtccctcttccctgacgttgctgaaggagcccaaggctctccatgcctttctacctaagtgtttgtattttattttaaattatttattctggagccacagcccccttgcttatgaggttcttatggagagtgagaaagggaagggaaatagggcaccatggtccggtggtttgtagttccttcaaagtcaggcactgggagctagaggagtctcaagctccccttaggaagaactggtgccccctccagtcctaatttttcttgcctgccccgccttggggaatgcctcacccacccaggtcctgacctgtgcaataaggattgttccctgcgaagttttgttggatgtaaatatagtaaaagctgcttctgtc

SEQ ID NO: 57546 - DNA, 5108 bp, Homo sapiens; identical to SEQ ID NO: 57545

SEQ ID NO: 57547 - DNA, 1702 bp, Homo sapiens
ggagtcgaccgctcgggcagcgcaccgccacgagagcccgggacgcgggaaagaccgaaaggaagaggaagaggcaccggtggccatggggctggaggcggcgcgcgagctggagtgcgcggcgctgggcacgctgctgcgggatccgcgggaggcggaacgcacgctgctgctggactgccgccccttcctggccttctgccggcgccacgtgcgcgccgcgcggccagtgccttggaacgcgctgctgcggcgccgcgcgcgcggccctcctgccgccgttctcgcctgcctgctgcccgaccgcgcgctgcggacgcgcctggtccgcggggagctggcgcgggccgtggtgctggacgagggcagtgcctcggtggcggagctccggcccgacagcccggctcatgtgctgctggccgcgctgctgcacgagacccgcgcggggcccactgccgtgtacttcctgcgaggaggcttcgacggcttccagggctgctgtcccgatctgtgctctgaggcccccgcccctgcgctgccgccaacaggggacaaaaccagccgctccgactccagggctcctgtctacgaccagggtggccctgtggagatcttgccctacctgttcctgggcagctgcagtcactcgtcagacctgcaggggctgcaggcctgtggcatcacagccgtcctcaacgtgtccgccagctgccccaaccactttgagggccttttccgctacaagagtatccctgtggaggacaaccagatggtggagatcagtgcctggttccaggaggccataggcttcattgactgggtgaagaacagcggaggccgggtgctggtgcactgccaggcgggtatctcgcgctctgccaccatctgtctggcatacctcatgcagagtcgccgtgtgcggctggacgaggcctttgacttcgttaagcagcgccggggggtcatctcccccaacttcagtttcatggggcagctgctgcagtttgagacccaggtgctgtgtcactgaggtggtgcccctctgcctgcctgccccactgtgctggcaggagctgactgtggactggtgggctcccctctgggccagcacagtcccctcacctccggcagggctgctacctcctcagagtttcagaagcccccacatgggggctctaggaatgccggcatgctggtctttccgacctggtgctcttctgctgggggactgaggctggccctcattcggggtcgggaaccaagggtgtgtctgctctttccctccccatcctctggcagaaatcagctagacgctataccgtggactctccctggtccaccaccatgttgaagcccttggcagcctgagagctccaaggaacaagctgtgacaaccaggagccctgtctgtgggttcgtctgcccagggcctggagcccaagccctgtgttcctggggaagctggggacttgggaagtgatgggtgtgtcatgttgcgtgtgtctgtctgtgagcctttcacacctgtgctggcgctggaaaattatttgtgctcagctgacatttaacacttcctcccccgcttcctcctagccctgtgggcaggggttggaaacttagcactttatatttatacagaacattcaggatttgtcaataaaatattgttatatttaaaaaaaaaaaaaaaaaaaaaaaaaaa

SEQ ID NO: 57548 - DNA, 1746 bp, Homo sapiens
tgcacagcctctcttaaaacaacatgccacagttaaaacttacttcagtttggacaactactcacagctactacacagagacccgaacgagtcactgatatacacctggaccaccaccaatggatatacaaatggcaaacaattttactccgccctctgcaactcctcagggaaatgactgtgacctctatgcacatcacagcacggccaggatagtaatgcctctgcattacagcctcgtcttcatcattgggctcgtgggaaacttactagccttggtcgtcattgttcaaaacaggaaaaaaatcaactctaccaccctctattcaacaaatttggtgatttctgatatactttttaccaccgctttgcctacacgaatagcctactatgcaatgggctttgactggagaatcggagatgccttgtgtaggataactgcgctagtgttttacatcaacacatatgcaggtgtgaactttatgacctgcctgagtattgaccgcttcattgctgtggtgcaccctctacgctacaacaagataaaaaggattgaacatgcaaaaggcgtgtgcatatttgtctggattctagtatttgctcagacactcccactcctcatcaaccctatgtcaaagcaggaggctgaaaggattacatgcatggagtatccaaactttgaagaaactaaatctcttccctggattctgcttggggcatgtttcataggatatgtacttccacttataatcattctcatctgctattctcagatctgctgcaaactcttcagaactgccaaacaaaacccactcactgagaaatctggtgtaaacaaaaaggctctcaacacaattattcttattattgttgtgtttgttctctgtttcacaccttaccatgttgcaattattcaacatatgattaagaagcttcgtttctctaatttcctggaatgtagccaaagacattcgttccagatttctctgcactttacagtatgcctgatgaacttcaattgctgcatggacccttttatctacttctttgcatgtaaagggtataagagaaaggttatgaggatgctgaaacggcaagtcagtgtatcgatttctagtgctgtgaagtcagcccctgaagaaaattcacgtgaaatgacagaaacgcagatgatgatacattccaagtcttcaaatggaaagtgaaatggattgtattttggtttatagtgacgtaaactgtatgacaaactttgcaggacttcccttataaagcaaaataattgttcagcttccaattagtattcttttatatttctttcattgggcactttcccatctccaactcggaagtaagcccaagagaacaacataaagcaaacaacataaagcacaataaaaatgcaaataaatatttcatttttatttgtaaacgaatacaccaaaaggaggcgctcttaataactcccaatgtaaaaagttttgttttaataaaaaatttaattattatttcttgccaacaaatggctagaaaggactgaatagattatatattgccagatgttaatactgtaacatactttttaaataacatatttcttaaatccaaatttctctcaatgttagatttaattccctcaataacaccaatgttttgttttgtttcgttctgggtcataaaactttgttaaggaactcttttggaataaagagcaggatgctgcaaagttaaaaaaaaaaaaaaaaa

SEQ ID NO: 57549 - DNA, 1050 bp, Homo sapiens
acacacacacacccctcccctgccatccctccccggactccggctccggctccgattgcaatttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccggtcagttcccgatggttccttctggcctcacccctcagccagcccaagactggtacctccttgatgatgacccaagactgctcactctaagtgcctcttccaaggtgcctgtcaccttggccgctgtctaaaggtccattgctccctaagcaatagagggcccccagtagggggagctaggggcatctgctccagggaaaggaaccctgtgtccttgtggggctggagtcagagctggatctgttaaccgtttttctaatttcaaagtacagtgtaccggaggccaggcctgatggcttacacctgtaatcccagcattttgggaggccaaggagggcagatcacttgagatcaggagtttgagaccagcctggccaacatggcgaaaccctgtctctactaaaaatacaaaaaaataaaataaaataaaaaatta

SEQ ID NO: 57550 - DNA, 1968 bp, Homo sapiens
atttcctcatcgtcaagctttgttcctcgtgggggctagaaatctctttccagttccagattgtgaagggttcctgagtaagcagcgtgtctccatccccctctctaggggctcttggatggaccttgcactctagaagggacaatggacttctggctttggccactttacttcctgccagtatcgggggccctgaggatcctcccagaagtaaaggtagagggggagctgggcggatcagttaccatcaagtgcccacttcctgaaatgcatgtgaggatatatctgtgccgggagatggctggatctggaacatgtggtaccgtggtatccaccaccaacttcatcaaggcagaatacaagggccgagttactctgaagcaatacccacgcaagaatctgttcctagtggaggtaacacagctgacagaaagtgacagcggagtctatgcctgcggagcgggcatgaacacagaccggggaaagacccagaaagtcaccctgaatgtccacagtgaatacgagccatcatgggaagagcagccaatgcctgagactccaaaatggtttcatctgccctatttgttccagatgcctgcatatgccagttcttccaaattcgtaaccagagttaccacaccagctcaaaggggcaaggtccctccagttcaccactcctcccccaccacccaaatcacccaccgccctcgagtgtccagagcatcttcagtagcaggtgacaagccccgaaccttcctgccatccactacagcctcaaaaatctcagctctggaggggctgctcaagccccagacgcccagctacaaccaccacaccaggctgcacaggcagagagcactggactatggctcacagtctgggagggaaggccaaggatttcacatcctgatcccgaccatcctgggccttttcctgctggcacttctggggctggtggtgaaaagggccgttgaaaggaggaaagccctctccaggcgggcccgccgactggccgtgaggatgcgcgccctggagagctcccagaggccccgcgggtcgccgcgaccgcgctcccaaaacaacatctacagcgcctgcccgcggcgcgctcgtggagcggacgctgcaggcacaggggaggcccccgttcccggccccggagcgccgttgccccccgccccgctgcaggtgtctgaatctccctggctccatgccccatctctgaagaccagctgtgaatacgtgagcctctaccaccagcctgccgccatgatggaggacagtgattcagatgactacatcaatgttcctgcctgacaactccccagctatcccccaaccccaggctcggactgtggtgccaaggagtctcatctatctgctgatgtccaatacctgcttcatgtgttctcagagccctcatcacttcccatgccccatctcgactcccatccccatctatctgtgccctgagcatggctctgcccccaggtcgtcttgcacaccttggcagccccctgtagttgacaggtaagctgtaggcatgtagagcaattgtcccaatgccacttgcttcctttccaagccgtcgaacagactgtgggatttgcagagtgtttcttccatgtctttgaccacagggttgttgctgcccaggctctagatcacatggcatcaggctggggcagaggcatagctattgtctcgggcatccttcccagggttgggtcttacacaaatagaaggctcttgctctgagttatgtgacatgcctcagccccatggactaagcaggggtctggtataaaaacactcctggaaacgcctttgccctgatccaaatgttagcacttgctagtgaacgtctacttatctcaagttctatgctaaaggcaatttatcttgatgtgatgataaaccaaacttattagcaagatatgcatatatatcaaaaaaaaaaaaaaaaaa

SEQ ID NO: 57551 - DNA, 2627 bp, Homo sapiens
actctgaggtgcattctttttttgatgagaggcatctctaggtaccatccctgacctggtcctcatgctgccgaggctgttgctgttgatctgtgctccactctgtgaacctgccgagctgtttttgatagccagcccctcccatcccacagaggggagcccagtgaccctgacgtgtaagatgccctttctacagagttcagatgcccagttccagttctgctttttcagagacacccgggccttgggcccaggctggagcagctcccccaagctccagatcgctgccatgtggaaagaagacacagggtcatactggtgcgaggcacagacaatggcgtccaaagtcttgaggagcaggagatcccagataaatgtgcacagggtccctgtcgctgatgtgagcttggagactcagcccccaggaggacaggtgatggagggagacaggctggtcctcatctgctcagttgctatgggcacaggagacatcaccttcctttggtacaaaggggctgtaggtttaaaccttcagtcaaagacccagcgttcactgacagcagagtatgagattccttcagtgagggagagtgatgctgagcaatattactgtgtagctgaaaatggctatggtcccagccccagtgggctggtgagcatcactgtcagaatcccggtgtctcgcccaatcctcatgctcagggctcccagggcccaggctgcagtggaggatgtgctggagcttcactgtgaggccctgagaggctctcctccgatcctgtactggttttatcacgaggatatcaccctggggagcaggtcggccccctctggaggaggagcctccttcaacctttccctgactgaagaacattctggaaactactcctgtgaggccaacaatggcctgggggcccagcgcagtgaggcggtgacactcaacttcacagtgcctactggggccagaagcaatcatcttacctcaggagtcattgaggggctgctcagcacccttggtccagccaccgtggccttattattttgctacggcctcaaaagaaaaataggaagacgttcagccagggatccactcaggagccttcccagccctctaccccaagagttcacctacctcaactcacctaccccagggcagctacagcctatatatgaaaatgtgaatgttgtaagtggggatgaggtttattcactggcgtactataaccagccggagcaggaatcagtagcagcagaaaccctggggacacatatggaggacaaggtttccttagacatctattccaggctgaggaaagcaaacattacagatgtggactatgaagatgctatgtaaggttatggaagattctgctctttgaaaaccatccatgaccccaagcctcaggcctgatatgttcttcagagatcctggggcattagctttccagtatacctcttctggatgccattctccatggcactattccttcatctactgtgaagtgaagttggcgcagccctgaagaaactacctaggagaactaatagacacaggagtgacagggactttgttatcagaaccagattcctgccggctcctttgaaaacaggtcatattgtgctcttctgtttacaagaggaaacaagatggaataaaagaaattgggatcttgggttggagggacagtgaagcttagagcacatgaactcaaggttagtgactctgcaggacttcacagagagagctgtgcccatcattcagtccaagtgctttctctgcccagacagcacagaactccagccccgctacttacatggatcatcgagtttccacctaaaatatgattctatttattttgagtcactgttaccaaattagaactaaaacaaagttacataaaaagttattgtgactccacttaattttagtgacgtatttttgtatatataggccaacctataccacatccaaaattatgtatctattacagcccctagaagctttataaatacagtgtgtcttcttttattcacaaaatttttgaaatcgtggtaatatggtttgaaacctgtatcttaattattttttttttaaattgagacagggtctcactctgtcactcaatctggaatgcagtggcacaatcttgcctcactgcaacgcctgcctctcaggctcaagcaaacctctcacctcagcctgctgagtagctgggactacaggcacatgccaccaaacttggccattttttgtcttacgtagagacaagatttcaccgttttgcccaggctggtctcaaactcctgggctcaagcaatgtattgaattttaaaataaccaggcactcactcttatgaattaataaacatttggaggtatataaagtaaaaagttaaagtctttcctgtaagttaacacaaatgttaactattgttaaaaactttacaggtagctctctagatatttttctatttttgtatgtatacttatgcatacatgtaagtatataaacatttagaagtgtacctatctaacaaactattatgaaatactttcaaatctgtaaatagatctattatactattttaaaaaaaaaaaaaaaaaaaaaaaaaaaaaaaaaaaaaaa

SEQ ID NO: 57552 - DNA, 2247 bp, Homo sapiens
taaatgtgccacgtcttctaagaagggggagtcctgaacttgtctgaagcccttgtccgtaagccttgaactacgttcttaaatctatgaagtcgagggacctttcgctgcttttgtagggacttctttccttgcttcagcaacatgaggcttttcttgtggaacgcggtcttgactctgttcgtcacttctttgattggggctttgatccctgaaccagaagtgaaaattgaagttctccagaagccattcatctgccatcgcaagaccaaaggaggggatttgatgttggtccactatgaaggctacttagaaaaggacggctccttatttcactccactcacaaacataacaatggtcagcccatttggtttaccctgggcatcctggaggctctcaaaggttgggaccagggcttgaaaggaatgtgtgtaggagagaagagaaagctcatcattcctcctgctctgggctatggaaaagaaggaaaaggtaaaattcccccagaaagtacactgatatttaatattgatctcctggagattcgaaatggaccaagatcccatgaatcattccaagaaatggatcttaatgatgactggaaactctctaaagatgaggttaaagcatatttaaagaaggagtttgaaaaacatggtgcggtggtgaatgaaagtcatcatgatgctttggtggaggatatttttgataaagaagatgaagacaaagatgggtttatatctgccagagaatttacatataaacacgatgagttatagagatacatctacccttttaatatagcactcatctttcaagagagggcagtcatctttaaagaacattttatttttatacaatgttctttcttgctttgttttttatttttatatattttttctgactcctatttaaagaaccccttaggtttctaagtacccatttctttctgataagttattgggaagaaaaagctaattggtctttgaatagaagacttctggacaatttttcactttcacagatatgaagctttgttttactttctcacttataaatttaaaatgttgcaactgggaatataccacgacatgagaccaggttatagcacaaattagcaccctatatttctgcttccctctattttctccaagttagaggtcaacatttgaaaagccttttgcaatagcccaaggcttgctattttcatgttataatgaaatagtttatgtgtaactggctctgagtctctgcttgaggaccagaggaaaatggttgttggacctgacttgttaatggctactgctttactaaggagatgtgcaatgctgaagttagaaacaaggttaatagccaggcatggtggctcatgcctgtaatcccagcactttgggaggctgaggcgggcggatcacctgaggttgggagttcgagaccagcctgaccaacacggagaaaccctatctctactaaaaatacaaaagtagccgggcgtggtgatgcgtgcctgtaatcccagctacccaggaaggctgaggcggcagaatcacttgaacccggaggcggaggttgcggtaagccgagatcacctccagcctggacactctgtctcgaaaaaaagaaaagaaacacggttaataacatataaatatgtatgcattgagacatgctacctaggacttaagctgatgaagcttggctcctagtgattggtggcctattatgataaataggacaaatcatttatgtgtgagtttctttgtaataaaatgtatcaatatgttatagatgaggtagaaagttatatttatattcaatatttacttcttaaggctagcggaatatccttcctggttctttaatgggtagtctatagtatattatactacaataacattgtatcataagataaagtagtaaaccagtctacattttcccatttctgtctcatcaaaaactgaagttagctgggtgtggtggctcatgcctgtaatcccagcactttgggggccaaggagggtggatcacttgagatcaggagttcaagaccagcctggccaacatggtgaaaccttgtctctactaaaaatacaaaaattagccaggcgtggtggtgcacacctgtagtcccagctactcgggaggctgagacaggagatttgcttgaacccgggaggcggaggttgcagtgagccaagattgtgccactgcactccagcctgggtgacagagcaagactccatctc

SEQ ID NO: 57553 - DNA, 2845 bp, Homo sapiens
aaaaaagcgggacaggtccagcggttgttctgtgtgaagtcgcgcggcttccacccacgcagtgttctaagtgaaggccagaaactcgctcgccatgtcggctgcagaggcggggggtgttttccacagagccaggggcaggaccctggacgcgtttcccgcagaaaaggaaagcgaatggaaaggcccattctacttcatcctgggcgcagacccacagtttgggctgatcaaggcctggtccactggggactgtgacaatggcggcgacgaatgggaacaggagatccgtctaactgagcaagccgtccaggccatcaacgagctgaaccccaaacccaaattcttcgttctgtgcggcgacctcatccacgccatgccagggaagccgtggcggacggagcagacggaggacctgaagcgagtgcttagggcagtggacagggccatcccactggtccttgtcagcggcaaccatgacattggcaacacccccacggccgagaccgtcgaggagttctgccggacttggggagatgactacttcagcttctgggtcgggggcgtcctgttcctggtcctcaactcccagttctacgagaacccctccaaatgccccagcctgaagcaggctcaggaccagtggctggacgagcagctgagcatcgcgaggcagcggcactgccagcatgccatcgtcttccagcacatcccgctgttcctggagagcatcgacgaggacgacgactactacttcaacctcagcaagtccactcggaaggagttggcagacaagttcatccacgcaggtgtcagagtcgtgttctcaggccactaccacaggaatgccgggggtacctaccagaacctcgacatggtggtgtcatctgccattggatgccagctgggcagagacccccacgggctccgagtcgtggtggtcaccgccgagaaaattgttcaccgatactacagtctagatgagctgagtgagaaaggaatagaagacgatctcatggatttgatcaagaaaaaatgacgctccttcccgttcccgttcacttttcacttgcactatttttttattttgccagaaacagcagctgcacacaacctcttgctgaaatataaaaatagcccaggcaggtttgtgaatttatgtccttttgcataaatcagagagctggggccctgtcctgaattatattcaaaatagaactgcatttcctttaaaatggagcgaatgatcctggaaatcagtttttaaaatattagactatctctgcatggatgtttgaataaattctcctaatgctgtgtttctcaactccacttttgaattggattgtattctggttagcatatggtcaaagtctgcctatcgacctcaattccaatctgacagccaagtatgatctttgataattccttaaacaaactacacctgattgtattaaattgtggtcacgattcccaaaacgctaggcaaaacaaagttcatctcctttcctttccagcggaacgaacagctgtctgccttgttgtgagagccatgcagacttattttgacaaggagccaagtaggcaccatttactgttcaattctgagacttctgatgataggaacagaatgcagttgatacagctcggagcttaaatttgccttcctgggtgcctagaaaagtcacctttgcacataaattggccatttctgaaaatctcctccaagagactgaaaccaaagctctaaaacgccgcttcttcagtctctggggagcacgttgagttggttcacatccacattctggctgtgtagccactccacagatgggtggtctcttgggatcagaatgcccctccactcatgagactctccattttgtccactttgacaggaaaagtgggaatgtatgcagagctctcaaaagaaacaaaaaaggccaaaacggtgccttcagccacatcctctgaattggccctgacttggactaaatgcactaatgcgaaatcccttgacaaaagcgcataggttatttcaaaccagcattgttttttatgtaacctgttttaccgcatcttctcagcagcttctgaccactgctcaattttctcctttacagccattgttctggtggacaaataacctaggtactccaaatcctggcaggaaaaatatacagcattatgaaacagcactcagtaatcctaaaatgatttccaaagctggttacacatgacctgcaaagtctattaaattaaaagactttctcattacagagtttagtcaacgtagcaaaaccatgggaaattaaatggaaagataattaaatatgtaaattcataaggaacaaaagacgagaagttaattatacaataggctggtgacaccagagttcattgttatgtgccacaagaaaattaaattttttaaaaaactagaacgctcttcttttagtgttttgctgaaatcctgttttgtatttgtttctttacaacaggtgtaggtataggaggtcaagaaaaggagttcggtaaagggcatagctaataacaaccacacattgggccaggcgcagtggcttacgcctgtaatcccagcactttgggaggctgagacgggcagatcacctgagatcaggagtttgagaacagcctggccaacatggtgaaactccatctctactaaaaatacaaaaattagccaggcatgctggtgcacacctgtaatcccagctactcgggaggctgaggcaggagatcgctggaactcaggaggcagaggttgcagtgagccaagatcatgccactgcactccagcctgggcaacagagcaagactctgtctc

SEQ ID NO: 57554 - DNA, 1051 bp, Homo sapiens
atggcgtcgtggggggttctgggagttgtagtccctgggggagctgcttttacgcagtgttttgaggtgcaggactgcaatgcccgcacttccggaccccagactcttcctacggcgactgacacctcagacacgcgttgtggggggcggcgctctggctccggggctgtgcccagcgcgagcgtggccggcacccacttgctgcagagccggcactgcactggggttcttgggggcggctcctccagacgtctctgcgggttgtcgggtgctgccgagttgggttgggggacgctacaggtagtgggtccggagcagcggctggcccctcatctcactgcccttcctcggaccccaccgtcctctggaagcttgtgcagggcacctgccactgtgaccacctggacgcagatacctgctttcccacaacagcaaggaagaaccatggcccaggggtcactgtcattcggggacgtggctgtgggcttcacccggaaagagtggcagcagctggacctggagcagaggaccctgtaccaggatgtgatgctggagaactacagccacctgctctctgtgggctgaactgtctgcttgcttggaaggcccagctggctcagcacaaatcctttaaccgtttctccccaagagggtgtcaagtcagcaaaccagctgtgatctccagtttggagcaggggaaggagccatggatggaggaggaagagataaggacgtggagcttcccagaaagctgacttcatgagaccgaggatctcgttcgttgatcgatgctacatattcagcatgttagataatgaggttggtgagattgatgaaatcccgcccaccagggccgacccacaaagagccactttatgaagaacatgctcctgaactccactccacaaccagcttttgaaaagaaaaatctgaaaaaatttgacctcagttaaactggtccaaatgcctgagcataaccaaaatctttcctcattcactcttcacgtggaccgtgtttaatttggttgctggtgatcatatttgttttagt

SEQ ID NO: 57555 - DNA, 1051 bp, Homo sapiens
atggcgtcgtggggggttctgggagttgtagtccctgggggagctgcttttacgcagtgttttgaggtgcaggactgcaatgcccgcacttccggaccccagactcttcctacggcgactgacacctcagacacgcgttgtggggggcggcgctctggctccggggctgtgcccagcgcgagcgtggccggcacccacttgctgcagagccggcactgcactggggttcttgggggcggctcctccagacgtctctgcgggttgtcgggtgctgccgagttgggttgggggacgctacaggtagtgggtccggagcagcggctggcccctcatctcactgcccttcctcggaccccaccgtcctctggaagcttgtgcagggcacctgccactgtgaccacctggacgcagatacctgctttcccacaacagcaaggaagaaccatggcccaggggtcactgtcattcggggacgtggctgtgggcttcacccggaaagagtggcagcagctggacctggagcagaggaccctgtaccaggatgtgatgctggagaactacagccacctgctctctgtgggctgaactgtctgcttgcttggaaggcccagctggctcagcacaaatcctttaaccatttctccccaagagggtgtcaagtcagcaaaccagctgtgatctccagtttggagcaggggaaggagccatggatggaggaggaagagataaggacgtggagcttcccagaaagctgacttcatgagaccgaggatctcgttcgttgatcgatgctacatattcagcatgttagataatgaggttggtgagattgatgaaatcccgcccaccagggccgacccacaaagagccactttatgaagaacatgctcctgaactccactccacaaccagcttttgaaaagaaaaatctgaaaaaatttgacctcagttaaactggtccaaatgcctgagcataaccaaaatctttcctcattcactcttcacgtggaccgtgtttaatttggttgctggtgatcatatttgttttagt

SEQ ID NO: 57556 - DNA, 1051 bp, Homo sapiens
atggcgtcgtggggggttctgggagttgtagtccctgggggagctgcttttacgcagtgttttgaggtgcaggactgcaatgcgcgcacttccggaccccagactcttcctacggcgactgacacctcagacacgcgttgtggggggcggcgctctggctccggggctgtgcccagcgcgagcgtggccggcacccacttgctgcagagccggcactgcactggggtccttgggggcggctcctccagacgtctctgcgggttgtcgggtgctgccgagttgggttgggggacgctacaggtagtgggtccggagcagcggctggcccctcatctcactgcccttcctcggaccccaccgtcctctggaagcttgtgcagggcacctgccactgtgaccacctggacgcagatacctgctttcccacaacagcaaggaagaaccatggcccaggggtcactgtcattcggggacgtggctgtgggcttcacccggaaagagtggcagcagctggacctggagcagaggaccctgtaccaggatgtgatgctggagaactacagccacctgctctctgtgggctgaactgtctgcttgcttggaaggcccagctggctcagcacaaatcctttaaccgtttctccccaagagggtgtcaagtcagcaaaccagctgtgatctccagtttggagcaggggaaggagccatggatggaggaggaagagataaggacgtggagcttcccagaaagctgacttcatgagaccgaggatctcgttcgttgatcgatgctacatattcagcatgttagataatgaggttggtgagattgatgaaatcccgcccaccagggccgacccacaaagagccactttatgaagaacatgctcctgaactccactccacaaccagcttttgaaaagaaaaatctgaaaaaatttgacctcagttaaactggtccaaatgcctgagcataaccaaaatctttcctcattcactcttcacgtggaccgtgtttaatttggttgctggtgatcatatttgttttagt

SEQ ID NO: 57557 - DNA, 1723 bp, Homo sapiens
agcaacatgcccgcagagaattcttccggaggcggtcacagacatctccgtgacgcagaacgagttagagcgtcccttggggtttccatggtgctgcccttagcctgcagtatctccacttcctctcccgcctgagcgccgggaacggaaaagcaggcggccggtcccagctgcgacgtagacgccgcgtgggggtggggttgggcgagtaggtgacgctctaggcgagctcgttggcctctctatggtgccgagcgcgcccgttcggacgttgcccctttaatcggcagagggcggtgcccaggaggtcccgcgagagctgcggggggcgggggggcggtgccgaggctgggggccggtggcggatggagcccgcgatggagccggagactctggaggcgcgaatcaatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgagaaggggagaggccaccatccgtcccccgccatgtgacgacaccaagggaggccaagactgaggttcttggggtccataaggctcttcagagcccaagagagttgtgctaagatggcccaggatggaggtccgggcctgccccaagggtcccaccacagccagcgggctggcctcccaccccagcatccatacacgtaggcctgttgctgagggaaggccctctagggtcatctggtccaggggttctttgcttcagctgcacatcggctgcctctccaggaagcgtgttcaacacatggaatcagggctccacccagacctgccgaggccacactcctggagtatctgcatccagagatctgcacgtttgtaaagctaaggggtggtgcttgggctcaggcctgaggttttgcatctgttcaatagcagaggagagaggggtgtactgtctgtggcccccagcatgggccacataccaacccaccatggagcaaagctgattttaagtggtggtagagatacagtttctcttttaatacttacgtgtttagttgggtgcagtggcttatacctgtaatttcagcacttggggaggccaaggcaggaggcttgcttgaggcaaggagttcaaggctacagtgagctatgattgtgccactgtactccagactggacaacagagtgagaccccatctctaaataataatcattattgttacatatttgttttaacatttttttctcaagtataactagtcctatgatttcatagatgtagcttaggataaggccaaggtagatgttgcctatataaggtttttttaaaaaaggaaaaataggccgggctggtggctcacgcctgtaatcccagcactttggcaggctgaggcgggcagatcacctgagatcaggagttcaagatcagcctgaccaacatggagaagccccatgtctactaaaaataaaaaattagcgaggcgtggtgggcgggcgcctgtaatcccagctacttgggaggctgaggcagaagaatcatttgaacccaggaggcagaggttacagtgagccgagatcgtgctactgcattccaacctgggcaacaagagtgaaactctgtcccaaaaaaaaaaaaaaaaaaaaaaaaaaaaa

SEQ ID NO: 57558 - DNA, 3652 bp, Homo sapiens
gggaggggtgcgaggctagccacgcaggcggggccctgggtcattttaaactctcagagtgaacgtcttgataggaccgacaagacgcatgacatgtacttagaaagcttatcttagagccacactgagattggaacccgcaaaatatgccagggaggaaggtgagcaagggacacgacactcacccggagaaacccagcaagcgcagcgaggctgtggggagaccggagccctgcacaccgccgggggaaggtgggccagcgccaccaccgtggagaacagcgcggaggcaccccacgagatgagacggaactgccgtgagatccagcaatgccaactgtgggtctgacccaggagaacggaaagcagggacgtgaacagccctcctcatgttcttgacaccgtcattctcagcagctcagctaaggcacagaggcagccgagcgtctgtcagcggagtcgtggctgagcagaacacgccacacgccacacgccacacgccacacgtgcaggattgctcaagatggaagggcacagtggaatatatatatatatttatatttttggcgagaccctggaggacacactgaatacaatggaataccatcccgcctttgaaaggaagggaaatcctggcacacgctgcaacaggagggagcttgaggacactgtggtgagtggagcacgtgagacacggaaggacacacgctgaagacacgcagagatgcccacccacgtggggaggtgacaggggagcccagcgcacagagacaaagtggaatggaggcctgggggctgggagcaaatgcggagcgagtgcttcctggggcagagtctccgtttgggaagatgagaaggttctgccgacggatgctggcgatggttgcagaagaatgtgaatgtgcccaatgctactgaaaaacggttacaatggaaacgccaccccagtgaccaccactgccccgtgggcctccctgggcctctccgccaagacctgcaacaacgtgtccttcgaagagagcaggatagtcctggtcgtggtgtacagcgcggtgtgcacgctgggggtgccggccaactgcctgactgcgtggctggcgctgctgcaggtactgcagggcaacgtgctggccgtctacctgctctgcctggcactctgcgagctgctgtacacaggcacgctgccactctgggtcatctatatccgcaaccagcaccgctggaccctaggcctgctggcctgcaaggtgaccgcctacatcttcttctgcaacatctacgtcagcatcctcttcctgtgctgcatctcctgcgaccgcttcgtggccgtggtgtacgcgctggagagtcggggccgccgccgccggaggaccgccatcctcatctccgcctgcatcttcatcctcgtcgggatcgttcactacccggtgttccagacggaagacaaggagacctgctttgacatgctgcagatggacagcaggattgccgggtactactacgccaggttcaccgttggctttgccatccctctctccatcatcgccttcaccaaccaccggattttcaggagcatcaagcagagcatgggcttaagcgctgcccagaaggccaaggtgaagcactcggccatcgcggtggttgtcatcttcctagtctgcttcgccccgtaccacctggttctcctcgtcaaagccgctgccttttcctactacagaggagacaggaacgccatgtgcggcttggaggaaaggctgtacacagcctctgtggtgtttctgtgcctgtccacggtgaacggcgtggctgaccccattatctacgtgctggccacggaccattcccgccaagaagtgtccagaatccataaggggtggaaagagtggtccatgaagacagacgtcaccaggctcacccacagcagggacaccgaggagctgcagtcgcccgtggcccttgcagaccactacaccttctccaggcccgtgcacccaccagggtcaccatgccctgcaaagaggctgattgaggagtcctgctgagcccactgtgtggcagggggatggcaggttgggggtcctggggccagcaatgtggttcctgtgcactgagcccaccagccacagtgcccatgtcccctctggaagacaaactaccaatttctcgttcctgaagccactccctccgtgaccactggccccaggctttcccacatggaaggtggctgcatgccaaggggaggagcgacacctccaggcttccgggagcccagagagcatgtggcaggcagtggggcctcttcatcagcagcctgcctggctggctcccttggctgtgggcaggtagcacgcctgctggcagaggtacctggtggctgccctgttcgcatcagtggcgatgactttatttgcggagcatttctgcaagcgttgcctggatgcggtggtgcattgtgggccctctgggctcctgcctcagaatgtcagtgagcaccatgctggaggtcacccagcactgtggcagcgcccaggagggcatagggcagcctaccacctccaagggggcaggcgccctcatctggggttgggtctgtgctgagctggagggcctctagggaaccgtggggcagggtggccagctgctggctcccagagcgcagcccaggcgtcctcaacggggagccccaaatgtccacgcccagaacaacagttggcaggacaggtgtgacacagccacagcagaggcaaggggtgccaggagtccccagcggcatcctcggggagatgctggtgaggggtccgtacagggtggggtccccacccctagccccttactgaggggggagtgcagcagttggcctgcttgtctggcggagaaagccagctccctgcaccctcggggctgagtcagatctgggtctgccgcaaaggccttgcctagaccaggtcacactgatgccctggtttccctatctgtaaaatggggccaatgacacctacctcactgggtcaccatcgagatcaatcctcctccctgccccgacacctcgggcacatcgcatgcactcagagcacagagccgggcagacgcagcacctgcatggggagcccagtgcccggcacagcacaggggcttccagggaggccgcgcagggccgtggggctgagccacgctctcgttttgtcaggcagctatgcagttgctcttccttgtttttgttttgtttttgtttttgtttttaatatttatttttttagagacagggccttgctctgttgcctgggctggagaacagtggcaccatcatagctcactgcagcctcaaactcctgggctcaagcgatcctccccgctcagcctcctgagtagctgggactacaggtgtgcaccaccacacccagccaaaacagccatcctccccttgagagtcatcagaaaaatacattaggaaaatgtgtttagaaataaaagcacaaggcagggcagtgctcacgcctgtcatcccagcactttgggaggccgagacgggaggatcagttgaggtcaggagtttgagaccagcctcggcaacatggcaaaatcttgtctcttttttttggtattaaaaaaatcataaaaataaaagaaataatgcaaaaaaaaaaaaaaaaaa

SEQ ID NO: 57559 - DNA, 1952 bp, Homo sapiens
ccagccccgccgaggggagccagcgccgtctctgaggggcgtccggcgccggagccatgaccctccgccgactcaggaagctgcagcagaaggaggaggcggcggccaccccggaccccgccgcccggactcccgactcggaagtcgcgcccgccgctccggtcccgaccccgggaccccctgccgcagccgccacccctgggcccccagcggacgagctgtacgcggcgctggaggactatcaccctgccgagctgtaccgcgcgctcgccgtgtccgggggcaccctgccccgccgaaagggctcaggattccgctggaagaatctcagccagagtcctgaacagcagcggaaagtgctgacgttggagaaggaggataaccagaccttcggctttgagatccagacttatggccttcaccaccgggaggagcagcgtgtggaaatggtgacctttgtctgccgagttcatgagtctagccctgcccagctggctgggctcacaccaggggacaccatcgccagcgtcaatggcctgaatgtggaaggcatccggcatcgagagattgtggacatcattaaggcgtcaggcaatgttctcagactggaaactctatatgggacatcaattcggaaggcagaactggaggctcgtctgcagtacctgaagcaaaccctgtatgagaagtggggagagtacaggtccctaatggtgcaggagcagcggctggtgcatggcctggtggtgaaggaccccagcatctacgacacgctggagtcggtgcgctcctgcctctacggcgcgggcctgctcccgggctcgctgcccttcgggcctctgctcgccgtgcccgggcgtccccgcggaggcgcccgacgggccaggggcgacgccgacgacgccgtctaccacacgtgcttcttcggggactccgagccgccggcgctgccgcccccgccgcccccggcccgcgccttcggcccgggccccgccgagacccctgccgtggggccgggccctgggccgcgggccgcgctgagccgcagcgccagtgtgcggtgcgcgggccctggcgggggcggaggcgggggcgcgccgggcgcgctctggactgaggctcgcgagcaggccctatgcggccccggcctgcgcaaaaccaagtaccgcagcttccgccggcggctgctcaagttcatccccggactcaaccgctccctggaggaggaggagagccagctgtaggggcgggggcgggcagggaggtatttatttatttattcgcaacagccagcgctaaaagagggggaggccgagccaagaggaccccaggagcccagagcagcgggagagggtccttcctagcctcggcccgccgggtcggttcctggctggtgtctgctgagggagtggggggcccagccccttctcttctcccccgccaaaccacagtgggagctggggcagggggagagccaggcaatcgggggccaaagatgggggtgctcgcctacagtctgcatctgtagtgccttgtggggtatccaggaacaccctcccagcaggggatgggaaccctgtcccatgaagccctctcctcagctttacttgctcccccgcccttagccttggggagaaatggcccgtggtgggctgaccccccaccctccacacacacagttccatgacccagcgggcccccaggggcatcaggtgctggtcctcctccctcctggcctcgacccctaagggcttcgcccctcccaggggcctgtaactaagtcgggtcctgccaggcagggggcctgtgttctgtgccccttgggagacaggaactggcgagttcaggtggggtggggacagcacagactgttccaccgttgtgcatattgttgcttctgaaccacaaactgtataaatggatggttttttgacaaaaaaaaaaaaaaaaaa

SEQ ID NO: 57560 - DNA, 1074 bp, Homo sapiens
gatcaacacatttcatctgggcttcttaaatctaaatctttaaaatgactaagttttcttccttttctctgtttttcctaatagttggggcttatatgactcatgtgtgtttcaatatggaaattattggagggaaagaagtgtcacctcattccaggccatttatggcctccatccagtatggcggacatcacgtttgtggaggtgttctgattgatccacagtgggtgctgacagcagcccactgccaatatcggtttaccaaaggccagtctcccactgtggttttaggcgcacactctctctcaaagaatgaggcctccaaacaaacactggagatcaaaaaatttataccattctcaagagttacatcagatcctcaatcaaatgatatcatgctggttaagcttcaaacagccgcaaaactcaataaacatgtcaagatgctccacataagatccaaaacctctcttagatctggaaccaaatgcaaggttactggctggggagccaccgatccagattcattaagaccttctgacaccctgcgagaagtcactgttactgtcctaagtcgaaaactttgcaacagccaaagttactacaacggcgacccttttatcaccaaagacatggtctgtgcaggagatgccaaaggccagaaggattcctgtaagggtgactcagggggccccttgatctgtaaaggtgtcttccacgctatagtctctggaggtcatgaatgtggtgttgccacaaagcctggaatctacaccctgttaaccaagaaataccagacttggatcaaaagcaaccttgtcccgcctcatacaaattaagttacaaataattttattggatgcacttgcttcttttttcctaatatgctcgcaggttagagttgggtgtaagtaaagcagagcacatatggggtccatttttgcacttgtaagtcattttattaaggaatcaagttctttttcacttgtatcactgatgtatttctaccatgctggttttattctaaataaaatttagaagactcaaaaaaaaaaaaaaaaaaaaaaaaaaaaa

SEQ ID NO: 57561 - DNA, 2147 bp, Homo sapiens
gcagcctcagaaggtgtgagcagtggccacgagaggcaggctggctgggacatgaggttggcagagggcaggcaagctggcccttggtgggcctcgtcctgagcactcggaggcactcctatgcttggaaagctcgctatgctgctgtgggtccagcaggcgctgctcgccttgctcctccccacactcctggcacagggagaagccaggaggagccgaaacaccaccaggcccgctctgctgaggctgtcggattaccttttgaccaactacaggaagggtgtgcgccccgtgagggactggaggaagccaaccaccgtatccattgacgtcattgtctatgccatcctcaacgtggatgagaagaatcaggtgctgaccacctacatctggtaccggcagtactggactgatgagtttctccagtggaaccctgaggactttgacaacatcaccaagttgtccatccccacggacagcatctgggtcccggacattctcatcaatgagttcgtggatgtggggaagtctccaaatatcccgtacgtgtatattcggcatcaaggcgaagttcagaactacaagccccttcaggtggtgactgcctgtagcctcgacatctacaacttccccttcgatgtccagaactgctcgctgaccttcaccagttggctgcacaccatccaggacatcaacatctctttgtggcgcttgccagaaaaggtgaaatccgacaggagtgtcttcatgaaccagggagagtgggagttgctgggggtgctgccctactttcgggagttcagcatggaaagcagtaactactatgcagaaatgaagttctatgtggtcatccgccggcggcccctcttctatgtggtcagcctgctactgcccagcatcttcctcatggtcatggacatcgtgggcttctacctgccccccaacagtggcgagagggtctctttcaagattacactcctcctgggctactcggtcttcctgatcatcgtttctgacacgctgccggccactgccatcggcactcctctcattggtgtctactttgtggtgtgcatggctctgctggtgataagtttggccgagaccatcttcattgtgcggctggtgcacaagcaagacctgcagcagcccgtgcctgcttggctgcgtcacctggttctggagagaatcgcctggctactttgcctgagggagcagtcaacttcccagaggcccccagccacctcccaagccaccaagactgatgactgctcagccatgggaaaccactgcagccacatgggaggaccccaggacttcgagaagagcccgagggacagatgtagccctcccccaccacctcgggaggcctcgctggcggtgtgtgggctgctgcaggagctgtcctccatccggcaattcctggaaaagcgggatgagatccgagaggtggcccgagactggctgcgcgtgggctccgtgctggacaagctgctattccacatttacctgctagcggtgctggcctacagcatcaccctggttatgctctggtccatctggcagtacgcttgagtgggtacagcccagtggaggagggggtacagtcctggttaggtggggacagaggatttctgcttaggcccctcaggacccagggaatgccagggacattttcaagacacagacaaagtcccgtgccctgtttccaatgccaattcatctcagcaatcacaagccaaggtctgaacccttccaccaaaaactgggtgttcaaggcccttacacccttgtcccacccccagcagctcaccatggctttaaaacatgctctcttagatcaggagaaactcgggcactccctaagtccactctagttgtggacttttccccattgaccctcacctgaataagggactttggaattctgcttctctttcacaactttgcttttaggttgaaggcaaaaccaactctctactacacaggcctgataactctgtacgaggcttctctaacccctagtgtcttttttttcttcacctcacttgtggcagcttccctgaacactcatcccccatcagatgatgggagtgggaagaataaaatgcagtgaaaccctaaaaaaaaaaaaaaaaaaaaaaaaa

SEQ ID NO: 57562 - DNA, 2243 bp, Homo sapiens
gcagcctcagaaggtgtgagcagtggccacgagaggcaggctggctgggacatgaggttggcagagggcaggcaagctggcccttggtgggcctcgtcctgagcactcggaggcactcctatgcttggaaagctcgctatgctgctgtgggtccagcaggcgctgctcgccttgctcctccccacactcctggcacagggagaagccaggaggagccgaaacaccaccaggcccgctctgctgaggctgtcggattaccttttgaccaactacaggaagggtgtgcgccccgtgagggactggaggaagccaaccaccgtatccattgacgtcattgtctatgccatcctcaacgtggatgagaagaatcaggtgctgaccacctacatctggtaccggcagtactggactgatgagtttctccagtggaaccctgaggactttgacaacatcaccaagttgtccatccccacggacagcatctgggtcccggacattctcatcaatgagttcgtggatgtggggaagtctccaaatatcccgtacgtgtatattcggcatcaaggcgaagttcagaactacaagccccttcaggtggtgactgcctgtagcctcgacatctacaacttccccttcgatgtccagaactgctcgctgaccttcaccagttggctgcacaccatccaggacatcaacatctctttgtggcgcttgccagaaaaggtgaaatccgacaggagtgtcttcatgaaccagggagagtgggagttgctgggggtgctgccctactttcgggagttcagcatggaaagcagtaactactatgcagaaatgaagttctatgtggtcatccgccggcggcccctcttctatgtggtcagcctgctactgcccagcatcttcctcatggtcatggacatcgtgggcttctacctgccccccaacagtggcgagagggtctctttcaagattacactcctcctgggctactcggtcttcctgatcatcgtttctgacacgctgccggccactgccatcggcactcctctcattggtaaggcccctcctggcagcagagctcagtctggtgagaaacccgccccctcccacctcctgcatgtgtctcttgcctctgccctgggctgcacaggtgtctactttgtggtgtgcatggctctgctggtgataagtttggccgagaccatcttcattgtgcggctggtgcacaagcaagacctgcagcagcccgtgcctgcttggctgcgtcacctggttctggagagaatcgcctggctactttgcctgagggagcagtcaacttcccagaggcccccagccacctcccaagccaccaagactgatgactgctcagccatgggaaaccactgcagccacatgggaggaccccaggacttcgagaagagcccgagggacagatgtagccctcccccaccacctcgggaggcctcgctggcggtgtgtgggctgctgcaggagctgtcctccatccggcaattcctggaaaagcgggatgagatccgagaggtggcccgagactggctgcgcgtgggctccgtgctggacaagctgctattccacatttacctgctagcggtgctggcctacagcatcaccctggttatgctctggtccatctggcagtacgcttgagtgggtacagcccagtggaggagggggtacagtcctggttaggtggggacagaggatttctgcttaggcccctcaggacccagggaatgccagggacattttcaagacacagacaaagtcccgtgccctgtttccaatgccaattcatctcagcaatcacaagccaaggtctgaacccttccaccaaaaactgggtgttcaaggcccttacacccttgtcccacccccagcagctcaccatggctttaaaacatgctctcttagatcaggagaaactcgggcactccctaagtccactctagttgtggacttttccccattgaccctcacctgaataagggactttggaattctgcttctctttcacaactttgcttttaggttgaaggcaaaaccaactctctactacacaggcctgataactctgtacgaggcttctctaacccctagtgtcttttttttcttcacctcacttgtggcagcttccctgaacactcatcccccatcagatgatgggagtgggaagaataaaatgcagtgaaaccctaaaaaaaaaaaaaaaaaaaaaaaaa

SEQ ID NO: 57563 - DNA, 2620 bp, Homo sapiens
ctgaacgcgaggactgttaactgtttctggcaaacatgaagtcaggcctctggtatttctttctcttctgcttgcgcattaaagttttaacaggagaaatcaatggttctgccaattatgagatgtttatatttcacaacggaggtgtacaaattttatgcaaatatcctgacattgtccagcaatttaaaatgcagttgctgaaaggggggcaaatactctgcgatctcactaagacaaaaggaagtggaaacacagtgtccattaagagtctgaaattctgccattctcagttatccaacaacagtgtctctttttttctatacaacttggaccattctcatgccaactattacttctgcaacctatcaatttttgatcctcctccttttaaagtaactcttacaggaggatatttgcatatttatgaatcacaactttgttgccagctgaagttctggttacccataggatgtgcagcctttgttgtagtctgcattttgggatgcatacttatttgttggcttacaaaaaagaagtattcatccagtgtgcacgaccctaacggtgaatacatgttcatgagagcagtgaacacagccaaaaaatctagactcacagatgtgaccctataatatggaactctggcacccaggcatgaagcacgttggccagttttcctcaacttgaagtgcaagattctcttatttccgggaccacggagagtctgacttaactacatacatcttctgctggtgttttgttcaatctggaagaatgactgtatcagtcaatggggattttaacagactgccttggtactgccgagtcctctcaaaacaaacaccctcttgcaaccagctttggagaaagcccagctcctgtgtgctcactgggagtggaatccctgtctccacatctgctcctagcagtgcatcagccagtaaaacaaacacatttacaagaaaaatgttttaaagatgccaggggtactgaatctgcaaagcaaatgagcagccaaggaccagcatctgtccgcatttcactatcatactacctcttctttctgtagggatgagaattcctcttttaatcagtcaagggagatgcttcaaagctggagctattttatttctgagatgttgatgtgaactgtacattagtacatactcagtactctccttcaattgctgaaccccagttgaccattttaccaagactttagatgctttcttgtgccctcaattttctttttaaaaatacttctacatgactgcttgacagcccaacagccactctcaatagagagctatgtcttacattctttcctctgctgctcaatagttttatatatctatgcatacatatatacacacatatgtatataaaattcataatgaatatatttgcctatattctccctacaagaatatttttgctccagaaagacatgttcttttctcaaattcagttaaaatggtttactttgttcaagttagtggtaggaaacattgcccggaattgaaagcaaatttattttattatcctattttctaccattatctatgttttcatggtgctattaattacaagtttagttctttttgtagatcatattaaaattgcaaacaaaatcatctttaatgggccagcattctcatggggtagagcagaatattcatttagcctgaaagctgcagttactataggttgctgtcagactatacccatggtgcctctgggcttgacaggtcaaaatggtccccatcagcctggagcagccctccagacctgggtggaattccagggttgagagactcccctgagccagaggccactaggtattcttgctcccagaggctgaagtcaccctgggaatcacagtggtctacctgcattcataattccaggatctgtgaagagcacatatgtgtcagggcacaattccctctcataaaaaccacacagcctggaaattggccctggcccttcaagatagccttctttagaatatgatttggctagaaagattcttaaatatgtggaatatgattattcttagctggaatattttctctacttcctgtctgcatgcccaaggcttctgaagcagccaatgtcgatgcaacaacatttgtaactttaggtaaactgggattatgttgtagtttaacattttgtaactgtgtgcttatagtttacaagtgagacccgatatgtcattatgcatacttatattatcttaagcatgtgtaatgctggatgtgtacagtacagtactgaacttgtaatttgaatctagtatggtgttctgttttcagctgacttggacaacctgactggctttgcacaggtgttccctgagttgtttgcaggtttctgtgtgtggggtggggtatggggaggagaaccttcatggtggcccacctggcctggttgtccaagctgtgcctcgacacatcctcatccccagcatgggacacctcaagatgaataataattcacaaaatttctgtgaaatcaaatccagttttaagaggagccacttatcaaagagattttaacagtagtaagaaggcaaagaataaacatttgatattcagcaactgaaaaaaaaaaa

SEQ ID NO: 57564 - DNA, 3248 bp, Homo sapiens
ctagaggcagctcagatagaggagctctttgggaagagacgccgggcaggcagaagcagcaggtaccccctccacatccctagggctctgtgatgtaggcagaggcccgtgggagtcagcatgccgcgtggctgggccgcccccttgctcctgctgctgctccagggaggctggggctgccccgacctcgtctgctacaccgattacctccagacggtcatctgcatcctggaaatgtggaacctccaccccagcacgctcacccttacctggcaagaccagtatgaagagctgaaggacgaggccacctcctgcagcctccacaggtcggcccacaatgccacgcatgccacctacacctgccacatggatgtattccacttcatggccgacgacattttcagtgtcaacatcacagaccagtctggcaactactcccaggagtgtggcagctttctcctggctgagagcatcaagccggctccccctttcaacgtgactgtgaccttctcaggacagtataatatctcctggcgctcagattacgaagaccctgccttctacatgctgaagggcaagcttcagtatgagctgcagtacaggaaccggggagacccctgggctgtgagtccgaggagaaagctgatctcagtggactcaagaagtgtctccctcctccccctggagttccgcaaagactcgagctatgagctgcaggtgcgggcagggcccatgcctggctcctcctaccaggggacctggagtgaatggagtgacccggtcatctttcagacccagtcagaggagttaaaggaaggctggaaccctcacctgctgcttctcctcctgcttgtcatagtcttcattcctgccttctggagcctgaagacccatccattgtggaggctatggaagaagatatgggccgtccccagccctgagcggttcttcatgcccctgtacaagggctgcagcggagacttcaagaaatgggtgggtgcacccttcactggctccagcctggagctgggaccctggagcccagaggtgccctccaccctggaggtgtacagctgccacccaccacggagcccggccaagaggctgcagctcacggagctacaagaaccagcagagctggtggagtctgacggtgtgcccaagcccagcttctggccgacagcccagaactcggggggctcagcttacagtgaggagagggatcggccatacggcctggtgtccattgacacagtgactgtgctagatgcagaggggccatgcacctggccctgcagctgtgaggatgacggctacccagccctggacctggatgctggcctggagcccagcccaggcctagaggacccactcttggatgcagggaccacagtcctgtcctgtggctgtgtctcagctggcagccctgggctaggagggcccctgggaagcctcctggacagactaaagccaccccttgcagatggggaggactgggctgggggactgccctggggtggccggtcacctggaggggtctcagagagtgaggcgggctcacccctggccggcctggatatggacacgtttgacagtggctttgtgggctctgactgcagcagccctgtggagtgtgacttcaccagccccggggacgaaggacccccccggagctacctccgccagtgggtggtcattcctccgccactttcgagccctggaccccaggccagctaatgaggctgactggatgtccagagctggccaggccactgggccctgagccagagacaaggtcacctgggctgtgatgtgaagacacctgcagcctttggtctcctggatgggcctttgagcctgatgtttacagtgtctgtgtgtgtgtgtgcatatgtgtgtgtgtgcatatgcatgtgtgtgtgtgtgtgtgtcttaggtgcgcagtggcatgtccacgtgtgtgtgtgattgcacgtgcctgtgggcctgggataatgcccatggtactccatgcattcacctgccctgtgcatgtctggactcacggagctcacccatgtgcacaagtgtgcacagtaaacgtgtttgtggtcaacagatgacaacagccgtcctccctcctagggtcttgtgttgcaagttggtccacagcatctccggggctttgtgggatcagggcattgcctgtgactgaggcggagcccagccctccagcgtctgcctccaggagctgcaagaagtccatattgttccttatcacctgccaacaggaagcgaaaggggatggagtgagcccatggtgacctcgggaatggcaattttttgggcggcccctggacgaaggtctgaatcccgactctgataccttctggctgtgctacctgagccaagtcgcctcccctctctgggctagagtttccttatccagacagtggggaaggcatgacacacctgggggaaattggcgatgtcacccgtgtacggtacgcagcccagagcagaccctcaataaacgtcagcttccttccttctgcggccagagccgaggcgggcgggggtgagaacatcaatcgtcagcgacagcctgggcacccgcggggccgtcccgcctgcagagggccactcgggggggtttccaggcttaaaatcagtccgtttcgtctcttggaaacagctccccaccaaccaagatttctttttctaacttctgctactaagtttttaaaaattccctttatgcacccaagagatatttattaaacaccaattacgtagcaggccatggctcatgggacccaccccccgtggcactcatggagggggctgcaggttggaactatgcagtgtgctccggccacacatcctgctgggccccctaccctgccccaattcaatcctgccaataaatcctgtcttatttgttcatcctggagaattgaagggaggtcaagttgtttgtcaatgatttgtcagagaacctgttgaaatgtgaattaagaagctaagaaaatatttcttagcaacattttctttttcttttttttttttttcttttgagacagagtctcactctcgtcgcccaggctggaatgcagtggtgcgatctcggctctctgcaacctctgtctcccgggttcaagcgatttcctgcgtcagccccagagtagctggaattacaggcacacaccaccacgcctggctaatttttgtatttttagtagagctggggccaccctggcccggccccg

SEQ ID NO: 57565 - DNA, 3361 bp, Homo sapiens
tgcctggaggcccagctgcccgtcatcagagtgacaggtcttatgacagcctgattggtgactcgggctgggtgtggattctcaccccaggcctctgcctgctttctcagaccctcatctgtcacccccacgctgaacccagctgccacccccagaagcccatcagactgcccccagcacacggaatggatttctgagaaagaagccgaaacagaaggcccgtgggagtcagcatgccgcgtggctgggccgcccccttgctcctgctgctgctccagggaggctggggctgccccgacctcgtctgctacaccgattacctccagacggtcatctgcatcctggaaatgtggaacctccaccccagcacgctcacccttacctggcaagaccagtatgaagagctgaaggacgaggccacctcctgcagcctccacaggtcggcccacaatgccacgcatgccacctacacctgccacatggatgtattccacttcatggccgacgacattttcagtgtcaacatcacagaccagtctggcaactactcccaggagtgtggcagctttctcctggctgagagcatcaagccggctccccctttcaacgtgactgtgaccttctcaggacagtataatatctcctggcgctcagattacgaagaccctgccttctacatgctgaagggcaagcttcagtatgagctgcagtacaggaaccggggagacccctgggctgtgagtccgaggagaaagctgatctcagtggactcaagaagtgtctccctcctccccctggagttccgcaaagactcgagctatgagctgcaggtgcgggcagggcccatgcctggctcctcctaccaggggacctggagtgaatggagtgacccggtcatctttcagacccagtcagaggagttaaaggaaggctggaaccctcacctgctgcttctcctcctgcttgtcatagtcttcattcctgccttctggagcctgaagacccatccattgtggaggctatggaagaagatatgggccgtccccagccctgagcggttcttcatgcccctgtacaagggctgcagcggagacttcaagaaatgggtgggtgcacccttcactggctccagcctggagctgggaccctggagcccagaggtgccctccaccctggaggtgtacagctgccacccaccacggagcccggccaagaggctgcagctcacggagctacaagaaccagcagagctggtggagtctgacggtgtgcccaagcccagcttctggccgacagcccagaactcggggggctcagcttacagtgaggagagggatcggccatacggcctggtgtccattgacacagtgactgtgctagatgcagaggggccatgcacctggccctgcagctgtgaggatgacggctacccagccctggacctggatgctggcctggagcccagcccaggcctagaggacccactcttggatgcagggaccacagtcctgtcctgtggctgtgtctcagctggcagccctgggctaggagggcccctgggaagcctcctggacagactaaagccaccccttgcagatggggaggactgggctgggggactgccctggggtggccggtcacctggaggggtctcagagagtgaggcgggctcacccctggccggcctggatatggacacgtttgacagtggctttgtgggctctgactgcagcagccctgtggagtgtgacttcaccagccccggggacgaaggacccccccggagctacctccgccagtgggtggtcattcctccgccactttcgagccctggaccccaggccagctaatgaggctgactggatgtccagagctggccaggccactgggccctgagccagagacaaggtcacctgggctgtgatgtgaagacacctgcagcctttggtctcctggatgggcctttgagcctgatgtttacagtgtctgtgtgtgtgtgtgcatatgtgtgtgtgtgcatatgcatgtgtgtgtgtgtgtgtgtcttaggtgcgcagtggcatgtccacgtgtgtgtgtgattgcacgtgcctgtgggcctgggataatgcccatggtactccatgcattcacctgccctgtgcatgtctggactcacggagctcacccatgtgcacaagtgtgcacagtaaacgtgtttgtggtcaacagatgacaacagccgtcctccctcctagggtcttgtgttgcaagttggtccacagcatctccggggctttgtgggatcagggcattgcctgtgactgaggcggagcccagccctccagcgtctgcctccaggagctgcaagaagtccatattgttccttatcacctgccaacaggaagcgaaaggggatggagtgagcccatggtgacctcgggaatggcaattttttgggcggcccctggacgaaggtctgaatcccgactctgataccttctggctgtgctacctgagccaagtcgcctcccctctctgggctagagtttccttatccagacagtggggaaggcatgacacacctgggggaaattggcgatgtcacccgtgtacggtacgcagcccagagcagaccctcaataaacgtcagcttccttccttctgcggccagagccgaggcgggcgggggtgagaacatcaatcgtcagcgacagcctgggcacccgcggggccgtcccgcctgcagagggccactcgggggggtttccaggcttaaaatcagtccgtttcgtctcttggaaacagctccccaccaaccaagatttctttttctaacttctgctactaagtttttaaaaattccctttatgcacccaagagatatttattaaacaccaattacgtagcaggccatggctcatgggacccaccccccgtggcactcatggagggggctgcaggttggaactatgcagtgtgctccggccacacatcctgctgggccccctaccctgccccaattcaatcctgccaataaatcctgtcttatttgttcatcctggagaattgaagggaggtcaagttgtttgtcaatgatttgtcagagaacctgttgaaatgtgaattaagaagctaagaaaatatttcttagcaacattttctttttcttttttttttttttcttttgagacagagtctcactctcgtcgcccaggctggaatgcagtggtgcgatctcggctctctgcaacctctgtctcccgggttcaagcgatttcctgcgtcagccccagagtagctggaattacaggcacacaccaccacgcctggctaatttttgtatttttagtagagctggggccaccctggcccggccccg

SEQ ID NO: 57566 - DNA, 3263 bp, Homo sapiens
ggtagagtgattttccctcggtgactcaactgggacgtagcaggtcgggcagtcaagccaggtgaccccatgagctgtcgctgcatctttctcatgaagcacggggaacgggtcggatggcccgtgggagtcagcatgccgcgtggctgggccgcccccttgctcctgctgctgctccagggaggctggggctgccccgacctcgtctgctacaccgattacctccagacggtcatctgcatcctggaaatgtggaacctccaccccagcacgctcacccttacctggcaagaccagtatgaagagctgaaggacgaggccacctcctgcagcctccacaggtcggcccacaatgccacgcatgccacctacacctgccacatggatgtattccacttcatggccgacgacattttcagtgtcaacatcacagaccagtctggcaactactcccaggagtgtggcagctttctcctggctgagagcatcaagccggctccccctttcaacgtgactgtgaccttctcaggacagtataatatctcctggcgctcagattacgaagaccctgccttctacatgctgaagggcaagcttcagtatgagctgcagtacaggaaccggggagacccctgggctgtgagtccgaggagaaagctgatctcagtggactcaagaagtgtctccctcctccccctggagttccgcaaagactcgagctatgagctgcaggtgcgggcagggcccatgcctggctcctcctaccaggggacctggagtgaatggagtgacccggtcatctttcagacccagtcagaggagttaaaggaaggctggaaccctcacctgctgcttctcctcctgcttgtcatagtcttcattcctgccttctggagcctgaagacccatccattgtggaggctatggaagaagatatgggccgtccccagccctgagcggttcttcatgcccctgtacaagggctgcagcggagacttcaagaaatgggtgggtgcacccttcactggctccagcctggagctgggaccctggagcccagaggtgccctccaccctggaggtgtacagctgccacccaccacggagcccggccaagaggctgcagctcacggagctacaagaaccagcagagctggtggagtctgacggtgtgcccaagcccagcttctggccgacagcccagaactcggggggctcagcttacagtgaggagagggatcggccatacggcctggtgtccattgacacagtgactgtgctagatgcagaggggccatgcacctggccctgcagctgtgaggatgacggctacccagccctggacctggatgctggcctggagcccagcccaggcctagaggacccactcttggatgcagggaccacagtcctgtcctgtggctgtgtctcagctggcagccctgggctaggagggcccctgggaagcctcctggacagactaaagccaccccttgcagatggggaggactgggctgggggactgccctggggtggccggtcacctggaggggtctcagagagtgaggcgggctcacccctggccggcctggatatggacacgtttgacagtggctttgtgggctctgactgcagcagccctgtggagtgtgacttcaccagccccggggacgaaggacccccccggagctacctccgccagtgggtggtcattcctccgccactttcgagccctggaccccaggccagctaatgaggctgactggatgtccagagctggccaggccactgggccctgagccagagacaaggtcacctgggctgtgatgtgaagacacctgcagcctttggtctcctggatgggcctttgagcctgatgtttacagtgtctgtgtgtgtgtgtgcatatgtgtgtgtgtgcatatgcatgtgtgtgtgtgtgtgtgtcttaggtgcgcagtggcatgtccacgtgtgtgtgtgattgcacgtgcctgtgggcctgggataatgcccatggtactccatgcattcacctgccctgtgcatgtctggactcacggagctcacccatgtgcacaagtgtgcacagtaaacgtgtttgtggtcaacagatgacaacagccgtcctccctcctagggtcttgtgttgcaagttggtccacagcatctccggggctttgtgggatcagggcattgcctgtgactgaggcggagcccagccctccagcgtctgcctccaggagctgcaagaagtccatattgttccttatcacctgccaacaggaagcgaaaggggatggagtgagcccatggtgacctcgggaatggcaattttttgggcggcccctggacgaaggtctgaatcccgactctgataccttctggctgtgctacctgagccaagtcgcctcccctctctgggctagagtttccttatccagacagtggggaaggcatgacacacctgggggaaattggcgatgtcacccgtgtacggtacgcagcccagagcagaccctcaataaacgtcagcttccttccttctgcggccagagccgaggcgggcgggggtgagaacatcaatcgtcagcgacagcctgggcacccgcggggccgtcccgcctgcagagggccactcgggggggtttccaggcttaaaatcagtccgtttcgtctcttggaaacagctccccaccaaccaagatttctttttctaacttctgctactaagtttttaaaaattccctttatgcacccaagagatatttattaaacaccaattacgtagcaggccatggctcatgggacccaccccccgtggcactcatggagggggctgcaggttggaactatgcagtgtgctccggccacacatcctgctgggccccctaccctgccccaattcaatcctgccaataaatcctgtcttatttgttcatcctggagaattgaagggaggtcaagttgtttgtcaatgatttgtcagagaacctgttgaaatgtgaattaagaagctaagaaaatatttcttagcaacattttctttttcttttttttttttttcttttgagacagagtctcactctcgtcgcccaggctggaatgcagtggtgcgatctcggctctctgcaacctctgtctcccgggttcaagcgatttcctgcgtcagccccagagtagctggaattacaggcacacaccaccacgcctggctaatttttgtatttttagtagagctggggccaccctggcccggccccg

SEQ ID NO: 57567 - DNA, 4045 bp, Homo sapiens
gcagccagagctcagcagggccctggagagatggccacggtcccagcaccggggaggactggagagcgcgcgctgccaccgccccatgtctcagccagggcttccttcctcggctccaccctgtggatgtaatggcggcccctgctctgtcctggcgtctgcccctcctcatcctcctcctgcccctggctacctcttgggcatctgcagcggtgaatggcacttcccagttcacatgcttctacaactcgagagccaacatctcctgtgtctggagccaagatggggctctgcaggacacttcctgccaagtccatgcctggccggacagacggcggtggaaccaaacctgtgagctgctccccgtgagtcaagcatcctgggcctgcaacctgatcctcggagccccagattctcagaaactgaccacagttgacatcgtcaccctgagggtgctgtgccgtgagggggtgcgatggagggtgatggccatccaggacttcaagccctttgagaaccttcgcctgatggcccccatctccctccaagttgtccacgtggagacccacagatgcaacataagctgggaaatctcccaagcctcccactactttgaaagacacctggagttcgaggcccggacgctgtccccaggccacacctgggaggaggcccccctgctgactctcaagcagaagcaggaatggatctgcctggagacgctcaccccagacacccagtatgagtttcaggtgcgggtcaagcctctgcaaggcgagttcacgacctggagcccctggagccagcccctggccttcaggacaaagcctgcagcccttgggaaggacaccattccgtggctcggccacctcctcgtgggcctcagcggggcttttggcttcatcatcttagtgtacttgctgatcaactgcaggaacaccgggccatggctgaagaaggtcctgaagtgtaacaccccagacccctcgaagttcttttcccagctgagctcagagcatggaggagacgtccagaagtggctctcttcgcccttcccctcatcgtccttcagccctggcggcctggcacctgagatctcgccactagaagtgctggagagggacaaggtgacgcagctgctcctgcagcaggacaaggtgcctgagcccgcatccttaagcagcaaccactcgctgaccagctgcttcaccaaccagggttacttcttcttccacctcccggatgccttggagatagaggcctgccaggtgtactttacttacgacccctactcagaggaagaccctgatgagggtgtggccggggcacccacagggtcttccccccaacccctgcagcctctgtcaggggaggacgacgcctactgcaccttcccctccagggatgacctgctgctcttctcccccagtctcctcggtggccccagccccccaagcactgcccctgggggcagtggggccggtgaagagaggatgcccccttctttgcaagaaagagtccccagagactgggacccccagcccctggggcctcccaccccaggagtcccagacctggtggattttcagccaccccctgagctggtgctgcgagaggctggggaggaggtccctgacgctggccccagggagggagtcagtttcccctggtccaggcctcctgggcagggggagttcagggcccttaatgctcgcctgcccctgaacactgatgcctacttgtccctccaagaactccagggtcaggacccaactcacttggtgtagacagatggccagggtgggaggcaggcagctgcctgctctgcgccgagcctcagaaggaccctgttgagggtcctcagtccactgctgaggacactcagtgtccagttgcagctggacttctccacccggatggcccccacccagtcctgcacacttggtccatccatttccaaacctccactgctgctcccgggtcctgctgcccgagccaggaactgtgtgtgttgcaggggggcagtaactccccaactccctcgttaatcacaggatcccacgaatttaggctcagaagcatcgctcctctccagccctgcagctattcaccaatatcagtcctcgcggctctccagggctccctgccctgacctcttccctgggttttctgccccagcctcctccttccctcccctccccgtccacagggcagcctgagcgtgctttccaaaacccaaatatggccacgctccccctcggttcaaaaccttgcacaggtcccactgccctcagccccacttctcagcctggtacttgtacctccggtgtcgtgtggggacatccccttctgcaatcctccctaccgtcctcctgagccactcagagctccctcacaccccctctgttgcacatgctattccctggggctgctgtgcgctccccctcatctaggtgacaaacttccctgactcttcaagtgccggttttgcttctcctggagggaagcactgcctcccttaatctgccagaaacttctagcgtcagtgctggagggagaagctgtcagggacccagggcgcctggagaaagaggccctgttactattcctttgggatctctgaggcctcagagtgcttggctgctgtatctttaatgctggggcccaagtaagggcacagatccccccacaaagtggatgcctgctgcatcttcccacagtggcttcacagacccacaagagaagctgatggggagtaaaccctggagtccgaggcccaggcagcagccccgcctagtggtgggccctgatgctgccaggcctgggacctcccactgccccctccactggaggggtctcctctgcagctcagggactggcacactggcctccagaagggcagctccacagggcagggcctcattatttttcactgccccagacacagtgcccaacaccccgtcgtataccctggatgaacgaattaattacctggcaccacctcgtctgggctccctgcgcctgacattcacacagagaggcagagtcccgtgcccattaggtctggcatgccccctcctgcaaggggctcaaccccctaccccgacccctccacgtatctttcctaggcagatcacgttgcaatggctcaaacaacattccaccccagcaggacagtgaccccagtcccagctaactctgacctgggagccctcaggcacctgcacttacaggccttgctcacagctgattgggcacctgaccacacgcccccacaggctctgaccagcagcctatgagggggtttggcaccaagctctgtccaatcaggtaggctgggcctgaactagccaatcagatcaactctgtcttgggcgtttgaactcagggagggaggcccttgggagcaggtgcttgtggacaaggctccacaagcgttgagccttggaaaggtagacaagcgttgagccactaagcagaggaccttgggttcccaatacaaaaatacctactgctgagagggctgctgaccatttggtcaggattcctgttgcctttatatccaaaataaactcccctttcttgaggttgtctgagtcttgggtctatgccttgaaaaaagctgaattattggacagtctcacctcctgccatagggtcctgaatgtttcagaccacaaggggctccacacctttgctgtgtgttctggggcaacctactaatcctctctgcaagtcggtctccttatccccccaaatggaaattgtatttgccttctccactttgggaggctcccacttcttgggagggttacattttttaagtcttaatcatttgtgacatatgtatctatacatccgtatcttttaatgatccgtgtgtaccatctttgtgattatttccttaatattttttctttaagtcagttcattttcgttgaaatacatttatttaaagaaaaatctttgttactctgtaaatgaaaaaacccattttcgctataaataaaaggtaactgtacaaaataagtacaatgcaacaaaa

SEQ ID NO: 57568 - DNA, 1106 bp, Homo sapiens
ccccgcgcggcgcgggccagggaagggccacccaggggtcccccacttcccgcttgggcgcccggacggcgaatggagcaggggcgcgcagataattaaagatttacacacagctggaagaaatcatagagaagccgggcgtggtggctcatgcctataatcccagcacttttggaggctgaggcgggcagatcacttgagatcaggagttcgagaccagcctggtgccttggcatctcccaatggggtggctttgctctgggctcctgttccctgtgagctgcctggtcctgctgcaggtggcaagctctgggaacatgaaggtcttgcaggagcccacctgcgtctccgactacatgagcatctctacttgcgagtggaagatgaatggtcccaccaattgcagcaccgagctccgcctgttgtaccagctggtttttctgctctccgaagcccacacgtgtatccctgagaacaacggaggcgcggggtgcgtgtgccacctgctcatggatgacgtggtcagtgcggataactatacactggacctgtgggctgggcagcagctgctgtggaagggctccttcaagcccagcgagcatgtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactcaaatatttgctgagttcctcctacatggctagccctgtgctagacactggggaatcggcgatgaacaaagcagatagaaatccccactcttgtggagctgacattctggagggagagacaaaaagcaaacatataaagaaagaaagaaatcacatggatctggatgacagtgagtgctgggaagaaaataaaa

SEQ ID NO: 57569 - DNA, 2323 bp, Homo sapiens
tcagcatcttatccccactttctggcctccccaccatgagccgccaattcacctacaagtcgggagctgctgccaaggggggcttcagcggctgctccgctgtgctctcagggggcagctcatcctcctaccgagcagggggcaaagggctcagtggaggcttcagcagtcggagcctttacagcctggggggtgcccggagcatctctttcaatgtggccagtggcagtgggtgggcaggaggctatggatttggccggggccgggccagtggctttgctggcagcatgtttggcagtgtggccttggggtccgtgtgtccgtcgttgtgcccgcccgggggtatccatcaggtcaccatcaacaagagcctcctggcacccctgaacgtggagctggaccctgaaatccagaaagtgcgtgcccaggagcgggagcagatcaaggtgctgaacaacaagttcgcctccttcattgacaaggtgcggttcctggagcagcagaaccaggtgctggagaccaagtgggagctgctacagcagctggacctgaacaactgcaagaataacctggagcccatccttgagggctacatcagcaacctgcggaagcagctggagacgctgtctggggacagggtgaggctggactcggagctgaggagcgtgcgcgaagtggtggaggactacaagaagaggtatgaagaagaaataaacaagcgcacaactgctgagaatgaatttgtggtgcttaagaaggacgtggacgcagcttacacgagcaaagtggagctgcaggccaaggtggatgccctggatggagaaatcaagttcttcaagtgtctgtacgagggggagactgctcagatccagtcccacatcagcgacacgtccatcatcctgtccatggacaacaaccggaacctggacctggacagcatcattgctgaggtccgtgcccagtatgaggagatcgcccggaagagcaaggccgaggccgaggccctgtaccagaccaagttccaggagctgcagctagcagccggccggcatggggatgacctgaaacacaccaaaaatgagatctcagagctgacccgtctcatccaaagactgcgctcggagattgagagtgtgaagaagcagtgtgccaacctggagacggccatcgctgacgccgagcagcggggggactgtgccctcaaggatgccagggccaagctggatgagctggagggcgccctgcagcaggccaaggaggagctggcacggatgctgcgcgagtaccaagagcttttgagcgtgaagctgtccctggatattgagatcgccacctaccgcaagctgctggagggcgaggagtgcaggatgtccggagaatataccaactccgtgagcatttcggtcatcaacagctccatggccgggatggcaggcacaggggctggctttggattcagcaatgctggcacctacggctactggcccagctctgtcagcgggggctacagcatgctgcctgggggctgtgtcactggcagtgggaactgtagcccccgtggggaagccaggaccaggctggggagtgcaagtgaattcagggactcccagggaaagaccttagctctaagctcacccaccaaaaaaaccatgagataaaagtgcaacacagcccatttcccagtagtctgccttgccctggcagactgctccggactcttctaggaaattcctctgtctcatttgtcctcatctccttcttgctttgctttgctgtggacctctcctccttctccttgacctctctgcctcagtctttgttaatgttgaatcaggatttgagagctggagcccatctttctgcctccatccaaagaggccttttaactcagcctccccttctggaagaagacttggccttttctctgcctgcatgtccctgtgcagaggaaggctgtctctcaagggtaaccccaatctgcctgtgctgctctttcataccctgtctcagtaactatttggccatgtgctccctgggtacacaagttttcagatctactgatagacctgcaggaactctctcatgttagagcaatactggctcaggcaaaacacctggtgggaagttgtatcttgtatagccactgcatattacatagccaggagtaccccttgaggctaattctaccaaccaagggatttgtgctcttcatctgtgggtacttgtccttgtttaggcctcacctccctgctcctgtgtcttaccaataaacttataaagcccaaaaaaaaaaaaaaaaaaaaaaaaaaaaaaaaaaaaaaaa

SEQ ID NO: 57570 - DNA, 1572 bp, Homo sapiens
gcacagacagcaccatgtcgctcatggtcgtcagcatggcgtgtgttgggttcttcttgctgcagggggcctggccacatgagggagtccacagaaaaccttccctcctggcccacccaggtcgcctggtgaaatcagaagagacagtcatcctgcaatgttggtcagatgtcaggtttgagcacttccttctgcacagagaagggaagtttaaggacactttgcacctcattggagagcaccatgatggggtctccaaagccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaatgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcataggaaacccttcaaatagttggccttcacccactgaaccaagctctaaaaccggtaacccccgacacctgcacattctgattgggacctcagtggtcatcatcctcttcatcctcctcttctttctccttcatcgctggtgctccaacaaaaaaaatgctgcggtaatggaccaagagtctgcagggaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacgcggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcatgagtctgcatcttagggcatcgctcttcctcacaccacaaatctgaatgtgcctctcacttgcttacaaatgtctaaggtccccactgcctgctggagaaaaaacacactcctttgcttagcccacagttctccatttcacttgacccctgcccacctctccaacctaactggcttacttcctagtctacttgaggctgcaatcacactgaggaactcacaattccaaacatacaagaggctccctcttaacgcagcacttagacacgtgttgttccaccttccctcatgctgttccacctcccctcagactagctttcagtcttctgtcagcagtaaaacttatatattttttaaaataacttcaatgtagttttccatccttcaaataaacatgtctgcccccatg

SEQ ID NO: 57571 - DNA, 1302 bp, Homo sapiens
agctggggcgcggccgcctgtctgcacagacagcaccatgtcgctcatggtcgtcagcatggtgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttcagcacttccttctgcacagagaagggaagtttaaggacactttgcacctcattggagagcaccatgatggggtctccaaggccaacttctccatcggtcccatgatgcaagaccttgcagggacctacagatgctacggttctgttactcactccccctatcagttgtcagctccgagtgacccactgcttgtttctgtcacaggaaacccttcaaatagttggccttcacccactgaaccaagctccgaaaccggtaaccccagacacctgcatgttctgattgggacctcagtggtcatcatcctcttcatcctcctcctcttctttctccttcatcgctggtgctgcaacaaaaaaaatgctgttgtaatggaccaagagcctgcagggaacagaacagtgaacagggaggactctgatgaacaagaccctcaggaggtgacatatgcacagttgaatcactgcgttttcacacagagaaaaatcactcgcccttctcagaggcccaagacacccccaacagatatcatcgtgtacacggaacttccaaatgctgagccctgatccaaagttgtctcctgcccatgagcaccacagtcaggccttgaggggatcttctagggagacaacagccctgtctcaaaactgggttgccagctccaatgtaccagcagctggaatctgaaggcgtgagtctgcatcttagggcatcgctcttcctcacaccacaaatctgaacgtgcctctcccttgcttacaaatgtctaaggtccccactgcctgctggagagaaaacacactcctttgcttagcccacaattctccatttcacttgacccctgcccacctctccaacctaactggcttacttcctagtctacttgaggctgcaatcacactgaggaactcacaattccaaacatacaagaggctccctcttaacacggcacttagacacgtgctgttccaccttccctcatgctgttccacctcccctcagactagctttcagccttctgtcagcagtaaaacttatatattttttaaaataatttcaatgtagttttccctccttcaaataaacatgtctgccctca

SEQ ID NO: 57572 - DNA, 1596 bp, Homo sapiens
agctggggcgcggccgcctgtctgcacagacagcaccatgtcgctcatggtcgtcagcatggtgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttcagcacttccttctgcacagagaagggaagtttaaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggccttcacccactgaaccaagctccgaaaccggtaaccccagacacctgcatgttctgattgggacctcagtggtcatcatcctcttcatcctcctcctcttctttctccttcatcgctggtgctgcaacaaaaaaaatgctgttgtaatggaccaagagcctgcagggaacagaacagtgaacagggaggactctgatgaacaagaccctcaggaggtgacatatgcacagttgaatcactgcgttttcacacagagaaaaatcactcgcccttctcagaggcccaagacacccccaacagatatcatcgtgtacacggaacttccaaatgctgagccctgatccaaagttgtctcctgcccatgagcaccacagtcaggccttgaggggatcttctagggagacaacagccctgtctcaaaactgggttgccagctccaatgtaccagcagctggaatctgaaggcgtgagtctgcatcttagggcatcgctcttcctcacaccacaaatctgaacgtgcctctcccttgcttacaaatgtctaaggtccccactgcctgctggagagaaaacacactcctttgcttagcccacaattctccatttcacttgacccctgcccacctctccaacctaactggcttacttcctagtctacttgaggctgcaatcacactgaggaactcacaattccaaacatacaagaggctccctcttaacacggcacttagacacgtgctgttccaccttccctcatgctgttccacctcccctcagactagctttcagccttctgtcagcagtaaaacttatatattttttaaaataatttcaatgtagttttccctccttcaaataaacatgtctgccctca

SEQ ID NO: 57573 - DNA, 1609 bp, Homo sapiens
gtcgagccgagtcactgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcacaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacgcgagtgacccactgcctgtttctgtcacaggaaacccttctagtagttggccttcacccactgaaccaagcttcaaaactggtatcgccagacacctgcatgctgtgattaggtactcagtggccatcatcctcttcaccatccttcccttctttctccttcatcgctggtgctccaaaaaaaaaaatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttatctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctattaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttcaaaaaaaaaaaaaaaaaaaaaaaaaaaaa

SEQ ID NO: 57574 - DNA, 1596 bp, Homo sapiens
ctgtgcgctgctgagctgagctggggcgcggccgcctgtctgcaccggcagcaccatgtcgctcatggtcatcagcatggcgtgtgttgggttcttcttgctgcagggggcctggacacatgagggtggtcaggacaagcccttgctgtctgcctggcccagcgctgtggtgcctcgaggaggacatgtgactcttctgtgtcgctctcgtcttgggtttaccatcttcagtctgtacaaagaagatggggtgcctgtccctgagctctacaacaaaatattctggaagagcatcctcatgggccctgtgacccctgcacacgcagggacctacagatgtcggggttcacacccacgctcccccattgagtggtcagcacccagcaaccccctggtgatcgtggtcacaggtctatttgggaaaccttcactctcagcccagccgggccccacggttcgcacaggagagaacgtgaccttgtcctgcagctccaggagctcatttgacatgtaccatctatccagggaggggagggcccatgaacctaggctccctgcagtgcccagcgtcaatggaacattccaggctgactttcctctgggccctgccacccacggagggacctacacatgcttcggctctctccatgactcaccctatgagtggtcagacccgagtgacccactgcttgtttctgtcacaggaaactcttcaagtagttcatcttcacccactgaaccaagctccaaaactggtatccgcagacacctgcacattctgattgggacctcagtggctatcatcctcttcatcatcctcttcttctttctccttcattgctgctgctccaacaaaaagaatgctgctgtaatggaccaagagcctgccggggacagaacagtgaacagggaggactctgatgatcaagaccctcaggaggtgacatatgcacagttggatcactgcgttttcacacagacaaaaatcacttccccttctcagaggcccaagacacctccaacagataccaccatgtacatggaacttccaaatgctaagccaagatcattgtctcctgcccataagcaccacagtcaggccttgaggggatcttctagggagacaacagccctgtctcaaaaccgggttgctagctcccatgtaccagcagctggaatctgaaggcatcagtcttcatcttaggggatcgctcttcctcacaccacaaatctgaacatgcctctctcttgcttacaaatgtctaaggtccccactgcctgctggagagaagacacactcctttgcttagcccacaattctctatttcacttgacccctgcccacctctccaactgaactggcttacttcctagtctacttgaggctgcaatcacactgaggaactcacaattccagacatacaagaggctccctcttaacatggcactgagacacgtgctgttccaccttccctcatgctgtttcacctttcctcagactattttccagccttctgtcagtcagcagtgaaacttataaaattttttgtgatttcaatgtagctgtctccttttcaaataaacatgtctgccctc

SEQ ID NO: 57575 - DNA, 1632 bp, Homo sapiens
atgtcgctcatggtcatcagcatggcgtgtgttgggttcttcttgctgcagggggcctggacacatgagggtggacaggacaagcccttgctgtctgcctggcccagcgctgtggtgcctcgaggaggacatgtgactcttctgtgtcgctctcgtcttgggtttaccatcttcagtctgtacaaagaagatggggtgcctgtccctgagctctacaacaaaatattctggaagagcatcctcatgggccctgtgacccctgcacacgcagggacctacagatgtcggggttcacacccgcgctcccccattgagtggtcggcacccagcaaccccctggtgatcgtggtcacaggtctatttgggaaaccttcactctcagcccagccgggccccacggttcgcacaggagagaacgtggccttgtcctgcagctccaggagctcatttgacatgtaccatctatccagggaggggagggcccatgaacctaggctccctgcagtgcccagcgtcgatggaacattccaggctgactttcctctgggccctgccacccacggagggacctacacatgcttcagctctctccatgactcaccctatgagtggtcagacccgagtgacccactgcttgtttctgtcacaggaaactcttcaagtagttcatcttcacccactgaaccaagctccaaaactggtatccgcagacacctgcacattctgattgggacctcagtggctatcatcctcttcatcatcctcttcttctttctccttcattgctgctgctccaacaaaaagaatgctgctgtaatggaccaagggcctgccggggacagaacagtgaacagggaggactctgatgatcaagaccctcaggaggtgacatatgcacagttggatcactgcgttttcacacagacaaaaatcacttccccttctcagaggcccaaggcacctccaacagataccaccatgtacatggaacttccaaatgctaagccaagatcattgtctcctgcccataagcaccacagtcaggccttgaggggatcttctagggagacaacagccctgtctcaaaaccgggttgctagctcccatgtaccagcagctggaatctgaaggcatcagtcttcatcttaggggatcgctcttcctcacaccacaaatctgaacatgcctctctcttgcttacaaatgtctaaggtccccactgcctgctggagagaagacacacacctttgcttagcccacaattctctatttcacttgacccctgcccacctctccaactgaactggcttacttcctagtctacttgaggctgcaatcacactgaggaactcacaattccagacatacaagaggctccctcttaacatggcactgagacacgtgctgttccaccctccctcatgctgtttcacctttcctcagactattttccagccttctgtcagtcagcagtgaaacttataaaattttttgtgatttcaatgtagctgtctccttttcaaataaacatgtctgccctcattgctttaggtaatgtgacactattcgctgaaagaaaccgctgttatcattaccatgtccacataaccccatctgttatccactgggttc

SEQ ID NO: 57576 - DNA, 1557 bp, Homo sapiens
tgtctgcacagacagcaccatgtcgctcatggtcgtcagcatggcgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttgagcacttccttctgcacagagaggggaagtataaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttttggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccctatgagtggtcaaactcgagtgacccactgcttgtttctgtcacaggaaacccttcaaatagttggccttcacccactgaaccaagctccaaaaccggtaaccccagacacctgcatgttctgattgggacctcagtggtcaaaatccctttcaccatcctcctcttctttctccttcatcgctggtgctccaacaaaaaaaatgctgctgtaatggaccaagagcctgcagggaacagaacagtgaacagcgaggattctgatgaacaagaccatcaggaggtgtcatacgcataattggatcactgtgttttcacacagagagaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactagcttacttcctagtctacctgaggctgcaatcacactgaggaactcacaattccaaacatacaagaggctccctcttaacacagcacttagacacgtgctgttccacctcccttcagactatctttcagccttctgccagcagtaaaacttataaattttttaaataatttcaatgtagttttcccgccttcaaataaacatgtctgccctca

SEQ ID NO: 57577 - DNA, 1113 bp, Homo sapiens
ccggcagcaccatgtcgctcatggtcatcagcatggcatgtgttgggttcttctggctgcagggggcctggccacatgagggattccgcagaaaaccttccctcctggcccacccaggtcgcctggtgaaatcagaagagacagtcatcctgcaatgttggtcagatgtcatgtttgagcacttccttctgcacagagaggggacgtttaacgacactttgcgcctcattggagagcacattgatggggtctccaaggccaacttctccatcggtcgcatgaggcaagacctggcagggacctacagatgctacggttctgttcctcactccccctatcagttttcagctcccagtgaccctctggacatcgtgatcacaggtctatatgagaaaccttctctctcagcccagccgggccccacggttctggcaggagagagcgtgaccttgtcctgcagctcctggagctcctatgacatgtaccatctatccacggagggggaggcccatgaacgtaggttctctgcagggcccaaggtcaacggaacattccaggccgactttcctctgggccctgccacccaaggaggaacctacagatgcttcggctctttccatgactctccctacgagtggtcaaagtcaagtgacccactgcttgtttctgtcacaggaaacccttcaaatagttggccttcacccactgaaccaagctccaaaaccggtaaccccagacacctacacgttctgattgggacctcagtggtcaaactccctttcaccatcctcctcttctttctccttcatcgctggtgctccgacaaaaaaaatgcatctgtaatggaccaagggcctgcggggaacagaacagtgaacagggaggattctgacgaacaggaccatcaggaggtgtcatacgcataattggatcactgtgttttcacacagagaaaaatcactcccccttctcagaggcccaagacacccccaacagatagcagcatgtacatagaacttccaaatgctgagtccagatccaaagctgtcttctgtccacgagcaccacagtcaggccttgaggggatcttctagggagacaacagccctgtct

SEQ ID NO: 57578 - DNA, 1565 bp, Homo sapiens
gctgagctgagctggggcgcggccgcctgtctgcaccggcagcaccatgtcgctcatggtcatcatcatggcgtgtgttgggttcttcttgctgcagggggcctggccacaggagggagtccacagaaaaccttccttcctggccctcccaggtcacctggtgaaatcagaagagacagtcatcctgcaatgttggtcggatgtcatgtttgagcacttccttctgcacagagaggggaagtttaacaacactttgcacctcattggagagcaccatgatggggtttccaaggccaacttctccattggtcccatgatgcctgtccttgcaggaacctacagatgctacggttctgttcctcactccccctatcagttgtcagctcccagtgaccctctggacatggtgatcataggtctatatgagaaaccttctctctcagcccagccgggccccacggttcaggcaggagagaatgtgaccttgtcctgcagctccatctatccagggaaggggaggcccatgaacgtaggctccctgcagtgcgcagcatcaacggaacattccaggccgactttcctctgggccctgccacccacggagggacctacagatgcttcggctctttccgtgacgctccctacgagtggtcaaactcgagtgatccactgcttgtttccgtcacaggaaacccttcaaatagttggccttcacccactgaaccaagctccaaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcataattggatcactgtgttttcacacagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactggcttacttcctagtctacctgaggctgcaatcacactgaggaactcacaattccaaacatacaagaggctgcctcttaacacagcacttagacacgtgctgttccacctcccttcagactatctttcagccttctgccagcagtaaaacttataaattttttaaataatttcaatgtagttttcccgccttcaaataaacatgtctgccctcatgg

SEQ ID NO: 57579 - DNA, 1498 bp, Homo sapiens
catggcgtgtgttgggttcttcttgctgcagggggcctggccacaggagggagtccacagaaaaccttccttcctggccctcccaggtcacctggtgaaatcagaagagacagtcatcctgcaatgttggtcggatgtcatgtttgagcacttccttctgcacagagaggggaagtttaacaacactttgcacctcattggagagcaccatgatggggtttccaaggccaacttctccattggtcccatgatgcctgtccttgcaggaacctacagatgctacggttctgttcctcactccccctatcagttgtcagctcccagtgaccctctggacatggtgatcataggtctatatgagaaaccttctctctcagcccagccgggccccacggttcaggcaggagagaatgtgaccttgtcctgcagctccatctatccagggaaggggaggcccatgaacgtaggctccctgcagtgcgcagcatcaacggaacattccaggccgactttcctctgggccctgccacccacggagggacctacagatgcttcggctctttccgtgacgctccctacgagtggtcaaactcgagtgatccactgcttgtttccgtcacaggaaacccttcaaatagttggccttcacccactgaaccaagctccaaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcataattggatcactgtgttttcacacagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactggcttacttcctagtctacctgaggctgcaatcacactgaggaactcacaattccaaacatacaagaggctgcctcttaacacagcacttagacacgtgctgttccacctcccttcagactatctttcagccttctgccagcagtaaaacttataaattttttaaataatttcaatgtagttttcccgccttcaaataaacatgtctgccctcatg

SEQ ID NO: 57580 - DNA, 1865 bp, Homo sapiens
ccacgcgtccggcaccggcagcaccatgttgctcatggtcgtcagcatggcgtgtgttgggttcttcttggtccagagggccggtccacacgtgggtggtcaggacaagcccttcctgtctgcctggcccagcgctgtggtgcctcgaggaggacacgtgactcttcggtgtcactatcgtcataggtttaacaatttcatgctatacaaagaagacagaatccacgttcccatcttccatggcagattattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgcagctcccggagctcctatgacatgtaccatctatccagggagcggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctccaa

SEQ ID NO: 57581 - DNA, 1855 bp, Homo sapiens
ccatgtcgctcactgtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcggcacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagatgggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggaaacccttcaagtagttggccttcacccacagaaccaagctccaaatctggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaaggtatctatttcacttgacccctgcccacctctccaacctaactggcttacttcctagtcctacttgaggctgcaatcacactgaggaactcacaattccaaacatacaagaggctccctcttaacacggcacttacacacttgctgttccaccttccctcatgctgttccacctcccctcagactatctttcagccttctgtcatcagtaaaatttataaattttttttataacttcagtgtagctctctcctcttcaaataaacatgtctgccctcatggtttcg

SEQ ID NO: 57582 - DNA, 6801 bp, Homo sapiens
tgacgtagagggccggaggtggcggcggcggcggcggcggcggcggcggcggcggatgcctgcgtcccaggctcgcgggcggcaggcccggacttgtgcatcacggacaattttgctgagggagatttcactatggcggattatgccttgttagaagattgcccttacgtggacgattgtgtctttgctgctgaatttatgaccgatgattatgttcgtgtgactcagctttactgtgatggggtgggtaagcaatataaagattatgtccaaagtgagaggaatttagaatttgacatctgcagtatatggtgtagtaaaccaatttctgtcctgcaagattattgtgatgccattaaaataaacatcttctggccacttctgtttcaacatcaaaacagttctgtaatatcacgattgcatccctgtgtggacgccaacaattcacgtgcttccgagataaatttgaagagattacaacatcttgagttgatggaagatattgtggatttggcaaagaaagctgctaatgattcactccttattggaggcttattgagaattggttataaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaacccaaagttgtatggattgtatagagcaaggagaactaatgaaaatgaaaggaaatgaagagttttccaaagaaagatttgatatagctattatctattacaccagagccattgaatatagacctgaaaaccaccttctttatggtaaccgagctctttgttttcttcgtactggacagtttagaaatgcacttggtgatggaaagagagccactattctgaagaacacttggccaaagggtcattatcgttattgtgatgctctttctatgctgggggaatataactgggccctgcaagcaaacataacagctcaaaaactctgtaaaaatgaccctgagggaatcaaggatctaattcagcagcatgtaaagttacaaaaacaaatagaagacctacaaggtcgaacagcaaataagaatccaattaaagccttttatgaaaacagggcctacacacctaggagtttatcagcacctgtatttagtacttcacttaactttgtggagaaggaaagagatttcagaaaaattaatcacgaaatggctaacggtggtaatcagaatctaaaggtgatggatgaggcattgatggtagatgattgtgactgtcatcctgaattttcaccaccatcaagtcagcctccgaaacataaaggaaaacaaaaatctcgaaacaatgaatcagaaaagttcagttctagttcacaattgactttaccagcagatttgaagaacatcttggagaaacagttttctaaatcttccagaggtgcacaccaggattttgctaatataatgacaatgctgagaagcttaattcaagatggctatacagccttattggagcagcgttgccgcagtgccgcacatgcctttacagagttgctgaatggtttagatcctcaaaaaataaagcaattgaatctggccatgattaactatgtcttggttgtctatggacttgccatttcactccttggaataggacagcctgaagaactatctgaagctgaaaaccagtttaagaggattattgaacactaccacaatgagggacttgattgcttggcctactgtggaattggaaaagtatatttgaaaaaaaacagatttctagaagctctcaatcactttgagaaagcaagaaccttgatttatcgtcttcctggagtgttaacttggcccacaagtaatgtgattattgaagagtctcagccagaaaaaataaagatgctgttagagaaatttgttgaagaatgcaagttccctccagtgccagatgccatttgttgctatcagaagtgctgtggatattctaagatccagatatacataactgatccagactttaagggttttatacgcatcagctgttgccagtactgtaaaatagaatttcacatgaattgctggaagaagttaaaaaccacaacctttaatgataaaattgacaaggattttctacaaggaatatgtcttacccctgactgtgaaggtgtcatttctaagattatcatcttcagcagtggtggtcaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaaattagcacaagaaagaatggaggaggacttaagagaaagtaatccacccaaaaacgaagagcagaaagaaactgtagacaatgttcagcattgtcagttccttgatgacagaattctacagtgtataaagcagtatgctgacaagattaaatccggcatatggaatacagccacgcttctcaaagaattactttcttggaaagttttgagcacagaggactatacaacctgtttttcaagcagaaattttctaaatgaagcagtggactatgttattcgtcacttgattcaagaaaagaacagagtaaagacaagaatatttctgcatgttttgagtgagcttaaagaagtggagcccaaattagccgcctggatccgaaaacttaatagctttggcttagatgccacaggacctttcttttctcggtatgaagcatctcttaaacagcttgattttagcatcatgactttcctctggaatgagaaatatggtcacaaactagactctatagaaggaaagcaacttgattatttctttgagccaacatcatcgaaggaagcccgctgtttaatatggctgctagaagaacacagagacaagttcccagcattacatagtgctttagatgaattctttgatataatggacagccgctgtactgtgttaaggaaacaagacagtggcgaagcaccgtttagttctaccaaggtgaaaaacaaaggcaagaaaaagaaaccaaaggattcaaagcctatgttagttgggtctggaacaacttcagtaactccaaataatgagatcatcacttcaagtgaagaccatagcaatcaaaattcagatactgcaggcccatttgcagtgcctgaccatcttcggcaagacgtagaagaatttgaagctctctatgaccaacacagtaatgaatatgttgtccgcaataagaagctatgggacatgaacccaaaacaaaaatgttcaactctatatgattacttctctcagttgttggaggaacatggtcccttggacatgagtcacaagatgttctctgaagaatatgagtttttcccagaagaaactcgaccaatactagaaaaagcaggaggtttaaaatcttttctcttgggatgtccccgttttgttgtgattgacaactgtattgcattgaagaaagttgcatcacggctcaagaaaaaaagaaagaagaaaaacattaaaacaaaagtagaagacatttcaaaagcaggagagtatttacaagttaaactaccacttaattcagctgctagggaatttaaaccagatgtaaagtctaaaccagtatcaggttcatcttcagcaccagcttctgaagatgtgaaacccaaacctttgtctgcaaattctcccaagccagcttgtgaagatgtgaaggccaaaccagtatccgataattcttctagacaagtttctgaggatgggaaacccaaagggttctcttctaattctcccaaaccaggctctgaggatgcaaattacaagcgagtctcctctaattctcccaaaccggttcttgaggatgtgaaaccaacttattgggctcaatcccatttggtcacaggatactgtacgtatcttcctttccagagatttgataacacccggacatcgccagcatacataaatgtgttaccaggtttgccccagtacaccagcatatatacacccttggtcagcctttctcctgaatatcagctaccaagatcagtaccagtggtgccgtcttttgtagccaatgacagagcagataaaaatgctactgcctattttgagggtcatcatttgaatgctgagaatgctgctggtcaccagattgcctccgaaacacagatccttgaggattcttcgttaatatctgtaaagtcacagtgcagcacaggtgatgctcatacagtcctgagtgagtctaacagaaaagatgggcactgtggaaattctaacaacaaatgtgaagtaattccagaaagcaccagtgcagtaacaaacattccacaggtgcagatggttgccatacaggtatcttggaacataacacaccaagaagtcaatactgagccatataatccttttgagaaacaacaaggggaaatttcacggattgaaaaggagtaccaagtattacaagaccaacttaaagaagcgtatgaaaattatgagcagataaaacttaagggcttagaagagaccagggacctggaagaaaagttgaaaaggcacttagaagaaaacaagatatcaaagacagaattagattggttgcttcaagatttggaaagagaaattaaaaaatggcaagaggaaaaaaaagaaatccaaaaaacactaaaatcactgaagaagaaaattaaaaaggtttcaaatgccaatgaaatgtatacccagaaaaatgatggaaacgataaggaacatgaattacatctggatcagtcccttgaaatcagcaacacacttacaaacgagaaaatgaaaatagaagagtgtataaagaaagggaaaaaggattatgaagagagtcatcagagagctgtggctgcagaggtatccgtacttgaaaactggaaggagagtgaagtgtataagctacagatcatgcagtcacaagcagaagcctatctgaagaagctggagctgattagccatgatcctgcagcatatcctgacatggagtccgatatatgttcatgggaattgtttctttctaatgttacaaaagaaactgagaaagcaaagtatcagtttgaagaacaaattaaggcaattaaaaatggttctcggctcagtgaactttctaaagtgcagatttctgagctttcatttcctgcctgtaacacggttcatcctgagttactccctgagtcttcaggccatgatgaccaagggtttatgacttccgcaagcgatgtgactggaaaccaagcagcacttcacagggatcccagtgtgttctctgccggcgattccccaggggaggctccttctgcactgttgccagggccacccccctctcagcctgaagccactcagctgccagggccaaaaggggctggccaggcagctctgtcagagcaaagccctgcggctgatcagaagcagcctgttcctccagggtgtgctgcatgttcaagccagtctccaaaaaagccattcaatagtattattgagcacctgtcagtggtattcccatgttacaacagcactgagcttgctggttttattaaaaaagtgagaagcaaaaacaagaactcactttcaggattgagtattgatgaaattgtccaaagagtgacagaacacattctagatgaacagaaaaagaaaaagccaaacccaggaaaggacaagaggacttatgagcccagctctgccgcccacgtgaccaggtcctcccagggcccacccttggcggttgttgcaccatcacccaaaaccaaggggcagaaagcagaagatgtccctgtgagggttgcactgggtgcaagttcctgtgaaatatgtcacgaggtgttcaaatcaaaaaacgtgcgtgtgctcaaatgtgggcacaagtatcacaaagggtgttttaagcagtggcttaaagggcagagcgcttgcccagcctgccagacttgtgatctcctgtcagaagagtagcctgcaccttctggaagaggctggcccagtgagaatcgggagccgccttcctgctcctctaggtagtcacacttcactaaagcgtcatccgccagcgtgttgaatcggaagaatgacaatttcctaccattggtgtaaaaagcaaacatctgaagacccttgtgcattgtgtgttacaaagctaaatccatggaaatcgttaatatcattgatattaagtaatttccccactctgagtgaatactttgatgatggccaagcagtggctaacaaaatgatggctaccacactcatgggtcgcttgggctgtgcagggctctttgaggtgggtagtttcttttggaaagtactgtgagcgcctcaaagcagtattctagtgataagaattcttaacatattcggccgggcgcggtggctcacgcctgtaatcccagtactttgggaggccgaggcgggcggatcacctgagatcaggagtttgagaccagcctcaacatggagaaaccccgtctctactaaaaacacaaaattagccaggcatggtggtgcatgcccataatcccagctactcaggaggctgaggcaggagaattgcttgaacctcggaggcgcaggttgtggtgagccgagattgcgccattgcacgccagcctgggcaacaagagcgaaactctgtctcaa

SEQ ID NO: 57583 - DNA, 1229 bp, Homo sapiens
aagctttaaaccagcagagacctcagacaaatcatatccctcctggggtgaccaggtgcagatcttccagggagccgtctaatggaatttcctggttaatggacacagagaaccactgctaagaacgatttccttttctctttcaatctgcagtactttttatgaagactggtcttttgtgatggatgaagagaggtccagtatgcttcctaccatggcagcaggtccgaactccatactctttgcgattaacattgacaacaaggatttgaacgggcagagtaagtttgctcccaccgtttcagacctcttaaaggagtcaacgcagaatgtgaccttgctgaaggagtccacgcaaggagtgagcagcgtgttcagggagatcacagcctcctctgccatctccatcctcatcaaacctgaacaggagaccgaccccttgcccgtcgtgtccaggaatgtcagtgctgatgccaaatgcaaaaaggagcggaagaagaaaaagcaagtgaccaacattatctcatttgatgatgaggaagatgagcagaactctggggacatgtttaaaaagacacctggggcaggggagagctcagaggacaactccgaccactcctctgtcaatatcatgtccgcctttgaaagccccttcgggccaaactccaatggaagtcagagcagcaactcgtggaaaattgattccctgtctttgaacagggagtttgggtaccagaagcttgatgtgaaaagcatcgatgatgaagatgtggatgaaaacgaagatgacgtgtatggaaactcatcaggacggaagcacaggggccactcagagtcgcccgagaaaaacggagcacactctgtcacccaggctggagtgcaatggcacgatctcggctcactgcaacctctgcctcccgggttcaggtgattctactgcctcagcctcctaagtagctgggattacaggcgcctgccaccacacccagctaatttttgcatttttagtagagaaagggtttcgccatgttggccaggctggtcttgaactcctgacttcaggtgatcctcctcgcctgccttgcctcccaaagtgctgggattacaggcataagccaccacgcccggccctgcctcttgagctggggagttcaagaccagcctgggcaacataatgagatttcagctctattaaaaataataataattaaaaaaaaaaaaaaaaaaaa

SEQ ID NO: 57584 - DNA, 898 bp, Homo sapiens
tgtgatcctcccacctcagtctcctgagtgccaccaattgtgtgccaccaagcctgactaattttaaaaattttttgaagagaccaggtttcactgtgttgctcagggtgatcttgaacttctgggctcaagcaatcctcctgccttagcctcctcaaatgttggcccgtagttttaagtagtaactccttttctgtacttctgaagtttttatcatcgtatgtaaaatttagtgatgtcacatgaatttgcttaaagtatagattattttcataattctaggaaaccagatattaagcactaaacttattctaggagtttcgttattatatatatatatatatgacaaagccccatctctatatatttataaaacacaaaggccatgggtggggaatggatggcaggcaccatgtctggcagcaaaggtggcaagaagaaggccctgaaacagcccaagaagcaggccaaggagaaggacgaggaagataaggctttcaagcagaaacaaaaagaggagcagaagaaactcgaggagctaaacatgaaggccgtggggaagtggcccctggccacaggtggaattaagaaatttgccaaaaagtgagctgttgcttgtgcctgaggaaatggtaaccctttatttcatccatattgaaacatctgtattccctgccataacaccttttgccacctatagctggaattaagtgttgtcttggagctgttgtacatttaagaataaacttttgtaaaataaataaataaataaatgccaggcgcagtggctcatgcctgtaatctcagtactttgggatgccgaggtggtggatcacttgagatcaggagttcaaccagcctggccaacatggtgaaaccccatctgtcctaaaaaaaa

SEQ ID NO: 57585 - DNA, 1605 bp, Homo sapiens
ggaaggcttgggagtcctcttagacagatcctcagtcacttccctctgcttgtgtctcaggaagaccacctcctcctactgtcttctgtgctagggatcacttccttgttgagtggaacctgagttttaagaggatcttctgctcctcttcatctggtccctttccttccaaggccccagagaggaaggcatgcagtgggccctagcggtgcttctagctttcctgtctcctgccagtcagaaatcttccaacttggaagggagaacgaagtcagtcatcaggcagactgggtcatctgctgaaatcacttgtgatcttgctgaaggaagtaacggctacatccactggtacctacaccaggaggggaaggccccacagcgtcttcagtactatgactcctacaactccaaggttgtgttggaatcaggagtcagtccagggaagtattatacttacgcaagcacaaggaacaacttgagattgatactgcgaaatctaattgaaaatgactttggggtctattactgtgccacctgggacgggcacagattataagaaactctttggcagtggaacaacacttgttgtcacagataaacaacttgatgcagatgtttcccccaagcccactatttttcttccttcgattgctgaaacaaaactccagaaggctggaacatacctttgtcttcttgagaaatttttcccagatattattaagatacattggcaagaaaagaagagcaacacgattctgggatcccaggaggggaacaccatgaagactaacgacacatacatgaaatttagctggttaacggtgccagaagagtcactggacaaagaacacagatgtatcgtcagacatgagaataataaaaacggaattgatcaagaaattatctttcctccaataaagacagatgtcaccacagtggatcccaaatacaattattcaaaggatgcaaatgatgtcatcacaatggatcccaaagacaattggtcaaaagatgcaaatgatacactactgctgcagctcacaaacacctctgcatattacatgtacctcctcctgctcctcaagagtgtggtctattttgccatcatcacctgctgtctgcttagaagaacggctttctgctgcaatggagagaaatcataacagacggtggcacaaggaggccatcttttcctcatcggttattgtccctagaagcgtcttctgaggatctagttgggctttctttctgggtttgggccatttcagttctcatgtgtgtactattctatcattattgtataatggttttcaaaccagtgggcacacagagaacctcactctgtaataacaatgaggaatagccatggcgatctccagcaccaatctctccatgttttccacagctcctccagccaacccaaatagcgcctgctatagtgtagacagcctgcggcttctagccttgtccctctcttagtgttctttaatcagataactgcctggaagcctttcattttacacgccctgaagcagtcttctttgctagttgaattatgtggtgtgtttttccgtaataagcaaaataaatttaaaaaaatgaaaa

SEQ ID NO: 57586 - DNA, 5576 bp, Homo sapiens
ctcactctgttgcccaggctggagtgcagtggcgccatctcagctcgctacaacctgggcaacagagtgagaccctgtctaaaaacaaacaaacaaaaaaaaatgtggtaagatacccatcatatgaaattcaccattaaaaaatagcagggagcatcgtgaatgcgaagtattgatgaggatgatggtgatgttccagaaccttctctgacaccagcctggcgcccccccccccccccagccttacctttcctggcttcatggtgctcatcatactgtactgcaaatgctggtttcctccttctcgccagctagacccgtggtaccccacagggagggaatggcgactcacccaccaggcgcttaataagtgtttgttggccagtggacctcctacgctccctggggagagggactgggactgggactgggactgggacgtgtgtacacacctgcagctacaagactcggtggggagggtgcacagagcctcgaccctgtaagagaggcgatcgggctgaggaagacggggcactggggctggatggatgggacggacatgtggagagggtgggttcgtggatttgttcacccgttcatttattggtttctatgcatccatccatctttcacgccttgagcgtgcgttctgggcagggcctgtaatgggcaccgaatgagtaacatatcgtctctcccttcaaggtacacgcagcctgggtgggtgaggggagagacggtagggtgacatgggaacagtttggggtttgggaagcgctcttgttaaaaattcaaactttgggtcccctctcagatttataaacctaaacgtttgctggtggacctaggactccgcgtatccaggcaggatcctccgctgattggggtgcacgatgacgtcagaacacgtggataacgtgataacttgtgggccaggggctttggaacctcaaagaatgtgataacttttgggtcaggggctttggaacctcaaagacctccgcctgggagatcggggacagctcccggaggaggtgacatctgagtgttaaacacatccgtgacaggcaatgagaaaataaggtgggtccgctgtgctgatcggccctaggggccgcggcggctgtcccggccgggcagcgtcgccttccgaggtgtcttggcctgcggggcactcgtagcccgccgctttcccaggtgaggcacgtcgtcgcccagcgacccaggttggagtccccgcttcagccgccgcggcggatgcggcggccaggcttctccgggccagggcagcgttgcacgtgtggccccgctgggccccgagcagctgcggcaggtcctgaagcgggtgacgaaggcgcagctgctgccgccgcggcccatcaggccgccctccagcgggaccctggcgccgagcccccgtgcccgccacgcctgctgccgccccaggtgaggctccgggagcgacgtggggaaactgaggcccggagggggccgaggccccgcggcggggttagctgcttggccggggtggccagtatccggccccagtcaagactcagggtgtcccgaagctgagccccttagggacggcgttcggcccccacctgccaccaccctggcgttttcaccccaggagcctcacttgaggagccgatgctcacgctgggccctctgcctgggacgccgtcgtgccctctctgcctccacagccctgcccggggctcccctgtgctgcctagctcgtctgacacgcctttgaccactcgttcagcctctgtggggcactcagagacggggttgcccgcactcccacctaagtgcaggaggtgcggccttcaacacactcgaagaacgaacatcaggcaggttctgggagggacagggggccgctttagagtgggtgggcccgtaggccagacgctgcccctgagacctgaatgaattaaaaggaaccaactgagcttttcaggtctcaggcacagcaagtgccacggcccagcattttcttctcttcattgctgcttctcagcattttctttctctctctctctctgtctctgtcactgtttttgcatacagatactatgcttttggggtgggtactctcattgtccttccaggggtcctacacggcgtctgtaaaattccatctcatttcattgctggcgctgtaaataaaattagtcttaacccaaaattgccaaaagaagagggctttttccactagaagagatgcgttagagaatagaatcagcgatcttcactcctgagttttttcgacttcactcgtgattttagctgcctggggttgttgtatccagttcatcatcaagagtggagagttgtcttgctaaggtttaggaaggcaagtatgattctgcccaaatgccacactatctagaggtgtgaccttgggcaactcgacctttttggactgtggtctgggtccgaaggctgcaagacgccatcccgggacagccatctgctgagcctctgctctgtgccgggcagtgttctgggttgcttagctcgcagtagtgtttttgtaccagcattttgcagggaggttgagtggctttgtccaagatccctcaggtgtggctgctctccagagcccttgttctccccagcacaccctgctgtatgtggccacagctttttgggtttggaatggagtcaaaaaatgacatacttttcataaagtaaaagcaaacttagtcaagatcaggcagcatgatgggacttattctgtagctaatctgatggagacgtataaattctacctccaataatgtacctttgtagcacattctgctaatactttttcagccccagctgtgtcgtggaagccacgaagtcaaaccggatgtgtactttgcccctcagtagctgatgaactaacaggagataaaacatgacccagatacctgctaatcaaggcctgaaagctagtgatgaagaactaaatgtagttagagaaagggagattgtttctggccgaggaaatcacaagcagctttgttgaagaagtggtatctgaactagatttgaaagggtgagtctgagttgaaaatgcagaagaggagaggcaggttctggagcaggtggcggggtgcatttcaacaaccacagcagactgcccagtggttcgctgtgggggatggtgtggatcagaagcacagaccagtggacacacttgggtcagatggaggcccctgtctctccgcatcttccctcttcccaccccccagaaatgtccagttccatccaacatgccaaccccttttcatgcatccatgcatgtacacatttttctttgtactcagaatgccctacctggcaaaaattcccagccttcaaaacgcccctcagagatcactgcttctggtctgttctgcctctttattgcacctgttgtaccatgatgacatttttcccgtctgcctcacctgtctgcattccttagggaaacttgtctgccttcgaaatcgtcagcggagcttttgaaagggcagatcgggtctccgacccaggagatcgattcagcaggtctgcggggactgaggcatggcagggaaactgcccaccatctcaagggtgaggctaggagttggctagtgtgtatgtattccatccagaaatatttagtaaatgttcaccaaacaaaataaaaacacacaagaaagcatgaggcgtaatacccacggggtaagccagtcaggatagaggatgaatacattattaggccggctttgctgctgtggttatcctaaaacaatagggtttaggttgtgtgtctgtgtgtatatgtattttgttgttgttttggggttttgttgagacaaggtgttgcattctcacccaggctggactgatcacggctcactacagcctcaaactcccagactcaaacgatccttccccctcagcctcccgagtatctggggctacaggcatgtaccatcaagcctaattttaaaatgttttgtaggcggggctcggtggctcacccctggaatcccagcactttgggaggcggcggcgggtggatcacctgagatcaggagtttgaggccagtctggccaatgtgatgaaaccccgtctctactaaaaatacaaaaattagccagtcacggtggcgcatgcctgcaatcctagctactagcgaggccaagtcaggaaaatcgcttgaactcgggaggcagaggtttcagggagccaagaatgcaccactgcagtccagcctaggcaacagtgagactctttgttttgggtttttgtgtttttttttaacattttgtagggacagggtcttgctctgttgcccaggctggccctgaactcctggcctcaagcaatcctcccacctcagcatcccaaagcactgctactgcaggtgtgatttgtgtttggcccttagagagagattctgtgtgattggtagtaaaatgaaacagacatcgttcttgaaggatatgcacagccaatctagttgtcatttgatttgcacgtagcccaggaatggggactcccagggttgtggtgccacctcggtacacttgacctctgttatttgtactagtgtataacaagagccagacgagagacacactccagcctgatctcagtgagggtctttattctgtcctgtttgacatttttattgactttctactgtttgagggtcacaccagaaggttgagtccaaagagggccagttggtggtcccaaataagtggttctcaaccgaggacagttttgccccacaaggggcacttggcaatatcttgtcaggactcgggatcactactagcatctagtgggtagaggcagagatgctgctgggcatcctccagccacccatgtcaaaggattatgttctgaaatgttggttgtgaaatcatgctctggatgacgaggtttgcctctttttctccctggaggaaaatgctcattatttctgctctgtgagggcaggagccttgtttcttttgcttcctgaccttctcccctaagctgtatgagaactgtttctctgacacctgtagcagtgtctcatgcacatggtcagtactcaataaatatttgtgggatgttgtcgaaggtagctctcccctttggtaggtgttttgctattacagacagtgctgccttgaacctcatagaacataacatctttatggccatctaagtttttttaattttggaatccaggaagtagaattactgggtcaaaaagcacatgtatttgaaattttgttagatatatttgtaaaaagttgttgaggatattcagcccggccgggcacggtggctcacgcctgtaattccagcacttcgagaggctgagtggggcagatcacttgaggtcaggagtttgagaccagcctggacaacatggtgaaaccctatctctactaaaaatacaaaaattaaccaggcgtagtagcacgtgtctgtaatcccagctacccgggaggctgaggcaggagaatcacttgtacctgggaagcgcaggttgcagtgagctgagatcatgccattgcactccagcctggacaacagagcaagacct

SEQ ID NO: 57587 - DNA, 898 bp, Homo sapiens; identical to SEQ ID NO: 57584

SEQ ID NO: 57588 - DNA, 4056 bp, Homo sapiens
tggctgagtgttggtacaggctttccacagcaatattaaaactgaaaaaatcagcaatgaagctcccagccacatttctgcctaatgatttgggggaaaacaacagaggcactcctcaacttttccttcactgcacaaagtggatttggctggaaatgccaaatgtgcttgtagctgggatctttcaaatgaaagcaagctgggagtcaacctcctgcagccgcaggccagaaatgggttgagaccaaactattatagtaacactggtgcacatctaaacagatttaactccctcccagcaatccagattaatttaatatgctttcttaatggcattccgcatttctcattaaagcaaatgaacgtccatccctctgtgataaattaggtcaaaaaacattcatatatttagggcacagggaaggaggagttgttggctgttaaaaaaaaaaaaaaagtcctgcaaatggcctttcaaagtctagacatcttcatcatcaacacaaacattcctcttcacaaagggacctcaagtaaccttaggctggagggcccacctgcgtatgtctttcttctcattctttcttacctttcctccagcccacacaactcacattcagtgaccaagtcacgtaggttttacctcctaaatctctcatatccttcactgctcagccactctcctgacaccaccataaaccaagccaccatcacctccagctgtttgactgcaaatgcctccagactggcctctgcttttccctggccctgtgacaatctgcactcctcacagggaccaaagcaatcacttcagaaggtgcatccaaacagatcactcaactttcaatggctccctctgctgtgtgggttaacaatgataaaagctcggccgggcgcgggggctcacgcctgtaatcccagcactttgggaggccgaggcggtcggatcacgacgttaggagatccagaccattctccctaacacggtgaaaccccgtctctactaaaaacacaaaaaaattagccgggtgtggtggcgggcgcctgtggtcccagctactccggaggctgagacaggagaatggcgtgaacccgggaggtggagcttgcagtgagccgagatcgcgccactgcactccagcctgggtgacagaatgagattccatctcggaaaaaaaaaaacaacaacgataaaaggtcaccttttctgagcacacactatctcagtccatccctacatcagccctttatttcaccagtggggaagctgggacagagagtagttacgtgggatgcccaaggtgggaccactcgtgtgaagtttccacaccctaatgtgagaccctctatgacctagcccctgtctttctccagcctcatttcctgattctctcgcttgccctgcaggcttcagccacagaaacttcttgaaagtcccttaaatctggctgagcgcagtggctcacgcctgtaatcccagcactttgggaagctgaggcgggtggatcacctgagatcaggagttcgagaccagcctggtcaacatggtggaaccccatctctactaaatatcccaaaattagacacgtgtggtggacggcacctgtaatcctagctactcgggagactgaggcaggaaaatcacttgaactcgggaggcagagattgcagtgagccaggatcgcaccactccacccaagcctgggcgtcaagagtgaaagtccgtctcaaaaaaaaaaaagtcccttaaatctgctgtatgcctatcaacctcagggacttcactatgctgttcctcaccctgaaatgctgttcctcatttctccacatagtgaactcatcccaccccctaggcctctccttaagtgtcatctcttccaggaagattttactttttaaatataactattaaaatataattcaggtaccttatgatttgccaatttaaagtaaacaaatcaatggtttcagtgcattcacagagctcggcaaccaccatcatgatcaattttaaaacattgtcatcaccccaaaagaaaccctgtatctatgagcaggtacctgccatttcctcctcccactaagccctgacaatttacttttttgagatagagtctctgtcacaggctggagtgcagtggcacaatctcggctcactgcaacctccacctcccgggttaaagcaattctcctgcctcccgagtagctggaattacagggctatgccaccacgcccatctaattttgtatttttagtagagacagggttcctgtcttcatagatttgcgtgttctggacttttcatataaatgaaatcttataatatgtgaccttttctgactagtttcttctacttagcataatattttcatagttcatccgtgttgtagcacgtgttagtacttcattccttttgatgactgaataatattccattgcatggtcaaaccatgttctatttctccactcatcagtagacaagcatttgtgttgttttcactttggcgctattatgaataatgctgctatgagcatttgtgtacaagtttctgcacggacatatattttcatttgtttcataaactggagtggaagtggtgggtcatagaactctgtgtttaagcttttgaagaagtgccagactgtgtaagaaagaaagcctttcctcaccctgtgagactgagctccctctctccatttatacattctctttatgccctttgcttctctttcagagcaattcactttgacctgggtcaccctcaacttaaggctcataactcccctagatcctcagggtccacactaaatgtgatgaaatatgatgcaagccacatatttacttttgcattttgtagtaaccacattttaaaaagtaaaacaaaagaagtgaaggtaattggaataatatcagagatttaaacaaatctatccgaaataccaggtctacaagtataaaatattttaacattaacaaaatactttgctttctttttatattaagtcttcacaatctaatgtgtatttgacacttctcgcacatctcagaatgatggcagcaccccatatggggggccctcccatgatgccaatgatgggccctcctcctcctgggatgatgccagtgggacctgctcctggaatgaggccgcccatgggaggccacatgcccatgatgcctgggtgcccaatgatgagacctcctgcccatctcatgatggtgcccagtcagcccagaatgactcgaccagacagataaggatagaggggaggcctcatacatcagtgttgttttgttgttgttattgttgtgttttctttgtttgtaatgttttgttttgtttttgagacacaatcttcctctgtcgcccaggctggagggcagtggcacgatctcagctcactgaaacctccacctcccgggttcaagcaattcccctgcctcagcctcctgagtagctgggactacaggcgtgtgcaccatgcccgactaattttttttattttagtagagacagggtttcaccatgttggccaggatggtctcaatctcctgacctcgtgacccgctcgcctcagcctcccaaagtgctgggattacaggtgtgagccactgcgcccggcctatatgagttttatatttacctgctcccttcaccaggagatcatgctgctgtgatgccggcttttcttaacagcataaggaagacttgtccccttgccctatcaaagagaatagttttggaggggagaagtgggacaaaaagatgcagtattcatttctattgggaaatatgaaaataaaattgtcaactcttttagttaaaaacaacaacaaaaaaaaggaaacgagatgtggggctgccacatgcaatatcgtgcattaaaaggatcttctactctggaggaaaatatctttgctgatgccagaccaacctaacacaaagaccttttggttttttaatgtgactgtgttttattttacaatgtgtaattcactttagaagggaaaagtacctgtctggggaaaactatttaatttcctgcatttattt

SEQ ID NO: 57589 - DNA, 2886 bp, Homo sapiens
atgggctgctttacccgggggaaggacattgcttcgccagccaccgggaaaacaggccctgtgcacccgggattcccaatgccctcccgctgcgtgtcgacgactccagtcccgaggactcgccagagacccaggcctccgggcccgcccggtgccacggctcccgccaaacgggcgggcgcgctctgcaaatctcggggcccgccgcaaggcacccagagcacagggaggtgccaagaaaggcaggagcctacgaaacccacctccaaagcaagcaattcatccaagaaaacgcccgcctcagcgctccgttggtcctctcgcacggaccgcctggaccccgtgttctgggcgcagcccaagccccctccaccctatcccggcctgctcaagagggcgctgcctaacggagccgggcgcttcctctctaaggccctctcacccgagatcaggccgccgcctctagtgccagcccggggcaaaacagggccaccccccgacccgctacaccccacgccctcttgcccccccggccgggtcttggtcgggacaagcgaccgtggtgggggcgttgtgagagaaaggccccgcgcggctgggccggctgttcgccttcggccagccctgacggctctgggtgggtggggcaagagggggcctcgcaggagcccctgtgcggcgagggatccaaaacgctgcctccgcgacagggcggaggaccggagggcgtcccaggatcgtgggccctgggccctgacgcctcggagcactccctgctccgagcgggcccgatgtggtggaagctcgggagcgcgggagccgggggaaggccgcgggccagcggctcgggggtccccgatccgagccccgcggccccgggctggcggttcgccatgctacccaacctcccctgactctgctccccctttaccgcccacctacacccccgccgcagccgcagccggggtcctcctgctgggggtccgcccctactgcacgccggcccggcagcagcatcccaccgcttccgcctcgccgccgccccgccaggagcccggctccagcctgggagggcagggggccggaccccaaaggcgcagccgctgggttccctgccgttcgcggtgccttcccgctcccggaacgcccaggcgattcaattcacccatcgggcgccgtcgtcgcacccttccaaaccgggggaaggggcgggcaggggcagcgggtgccacagacgccagccaagacgtcggctccggaacgcatgggctgctttacccgggggaaggacattgcttcgccagccaccgggaaaacaggccctgtgcacccgggattcccaatgccccccgcttcgtgtcgacgactccagtcccgaggactcgccagagacccaggcctccgggcccgcccggtgccacggctcccgccaaacgggcgggcgcgctctgcaaatctcggggcccgccgcaaggcacccagagcacagggagctgccaagaaaggcaggagcctacgaaacccacctccaaagcaagcaattcatccaagaaaacgcccgcctcagcgctccgttggtcctctcgcacggaccgcctggcccccgtgttctgggcgcagcccaagccccctccaccctatcccgacctgctcaagacggccctctcacccgagatcaggccgccgcctctagtgccagcccggggcaaaacagggccaccccccgacccgctacaccccacgccctcttgcccccccggccgggtcttggtcgggacaagcgaccgtggtgggggcgttgtgagagaaaggccccgcgcggctgggccggctgttcgccttcggccagccctgacggctctgggtgggtggggcaagagggggcctcgcaggagcccctgtgcggcgagggatccaaaacgctgcctccgcgacagggcggaggaccggagggcgtcccaggatcgtgggccctgggccctgacgcctcggagcactccctgctccgagcgggcccgatgtggtggaagctcgggagcgcgggagctgggggaaggccgcgggccagcggctcgggggtccccgatccgagccccgcggccccgggctggcggtgtcggctgcaatccggcgggcacggccgggccgggctgggctcttggggcagccagccgcagccggggtcctcctgctgggggtccgcccctactgcacgccggcccggcagcagcatcccaccgcttccgcctcgccgccgccccgccaggagcccggctccagcctgggagggcagggggccggaccccaaaggcgcagccgctgggttccctgccgttcgcggtgccttcccgctcccggaacgcccaggcgattcaattcacccatcgggcgccgtcgtcgcacccttccaaaccgggggaaggggcgggcaggggcagcgggtgccacagacgccagccaagacgtcggctccggaacgcatgggctgctttacccgggggaaggacattgcttcgccagccaccgggaaaacaggccctgtgcacccgggattcccaatgccccccgcttcgtgtcgacgactccagtcccgaggactcgccagagacccaggcctccgggcccgcccggtgccacggctcccgccaaacgggcgggcgcgctctgcaaatctcggggcccgccgcaaggcacccagagcacagggaggtgccaagaaaggcaggagcctacgaaacccacctccaaagcaagcaattcatccaagaaaacgcccgcctcagcgctccgttggtcctctcgcacggaccgcctggaccccgtgttctgggcgcagcccaagccccctccaccctatcccggcctgctcaagagggcgctgcctaa

SEQ ID NO: 57590 - DNA, 6801 bp, Homo sapiens
tgacgtagagggccggaggtggcggcggcggcggcggcggcggcggcggcggcggatgcctgcgtcccaggctcgcgggcggcaggcccggacttgtgcatcacggacaattttgctgagggagatttcactatggcggattatgccttgttagaagattgcccttacgtggacgattgtgtctttgctgctgaatttatgaccgatgattatgttcgtgtgactcagctttactgtgatggggtgggtaagcaatataaagattatgtccaaagtgagaggaatttagaatttgacatctgcagtatatggtgtagtaaaccaatttctgtcctgcaagattattgtgatgccattaaaataaacatcttctggccacttctgtttcaacatcaaaacagttctgtaatatcacgattgcatccctgtgtggacgccaacaattcacgtgcttccgagataaatttgaagagattacaacatcttgagttgatggaagatattgtggatttggcaaagaaagctgctaatgattcactccttattggaggcttattgagaattggttataaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaacccaaagttgtatggattgtatagagcaaggagaactaatgaaaatgaaaggaaatgaagagttttccaaagaaagatttgatatagctattatctattacaccagagccattgaatatagacctgaaaaccaccttctttatggtaaccgagctctttgttttcttcgtactggacagtttagaaatgcacttggtgatggaaagagagccactattctgaagaacacttggccaaagggtcattatcgttattgtgatgctctttctatgctgggggaatataactgggccctgcaagcaaacataacagctcaaaaactctgtaaaaatgaccctgagggaatcaaggatctaattcagcagcatgtaaagttacaaaaacaaatagaagacctacaaggtcgaacagcaaataagaatccaattaaagccttttatgaaaacagggcctacacacctaggagtttatcagcacctgtatttagtacttcacttaactttgtggagaaggaaagagatttcagaaaaattaatcacgaaatggctaacggtggtaatcagaatctaaaggtgatggatgaggcattgatggtagatgattgtgactgtcatcctgaattttcaccaccatcaagtcagcctccgaaacataaaggaaaacaaaaatctcgaaacaatgaatcagaaaagttcagttctagttcacaattgactttaccagcagatttgaagaacatcttggagaaacagttttctaaatcttccagaggtgcacaccaggattttgctaatataatgacaatgctgagaagcttaattcaagatggctatacagccttattggagcagcgttgccgcagtgccgcacatgcctttacagagttgctgaatggtttagatcctcaaaaaataaagcaattgaatctggccatgattaactatgtcttggttgtctatggacttgccatttcactccttggaataggacagcctgaagaactatctgaagctgaaaaccagtttaagaggattattgaacactaccacaatgagggacttgattgcttggcctactgtggaattggaaaagtatatttgaaaaaaaacagatttctagaagctctcaatcactttgagaaagcaagaaccttgatttatcgtcttcctggagtgttaacttggcccacaagtaatgtgattattgaagagtctcagccagaaaaaataaagatgctgttagagaaatttgttgaagaatgcaagttccctccagtgccagatgccatttgttgctatcagaagtgctgtggatattctaagatccagatatacataactgatccagactttaagggttttatacgcatcagctgttgccagtactgtaaaatagaatttcacatgaattgctggaagaagttaaaaaccacaacctttaatgataaaattgacaaggattttctacaaggaatatgtcttacccctgactgtgaaggtgtcatttctaagattatcatcttcagcagtggtggtcaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaaattagcacaagaaagaatggaggaggacttaagagaaagtaatccacccaaaaacgaagagcagaaagaaactgtagacaatgttcagcattgtcagttccttgatgacagaattctacagtgtataaagcagtatgctgacaagattaaatccggcatatggaatacagccacgcttctcaaagaattgctttcttggaaagttttgagcacagaggactatacaacctgtttttcaagcagaaattttctaaatgaagcagtggactatgttattcgtcacttgattcaagaaaagaacagagtaaagacaagaatatttctgcatgttttgagtgagcttaaagaagtggagcccaaattagccgcctggatccgaaaacttaatagctttggcttagatgccacaggacctttcttttctcggtatgaagcatctcttaaacagcttgattttagcatcatgactttcctctggaatgagaaatatggtcacaaactagactctatagaaggaaagcaacttgattatttctttgagccaacatcatcgaaggaagcccgctgtttaatatggctgctagaagaacacagagacaagttcccagcattacatagtgctttagatgaattctttgatataatggacagccgctgtactgtgttaaggaaacaagacagtggcgaagcaccgtttagttctaccaaggtgaaaaacaaaggcaagaaaaagaaaccaaaggattcaaagcctatgttagttgggtctggaacaacttcagtaactccaaataatgagatcatcacttcaagtgaagaccatagcaatcaaaattcagatactgcaggcccatttgcagtgcctgaccatcttcggcaagacgtagaagaatttgaagctctctatgaccaacacagtaatgaatatgttgtccgcaataagaagctatgggacatgaacccaaaacaaaaatgttcaactctatatgattacttctctcagttgttggaggaacatggtcccttggacatgagtcacaagatgttctctgaagaatatgagtttttcccagaagaaactcgaccaatactagaaaaagcaggaggtttaaaatcttttctcttgggatgtccccgttttgttgtgattgacaactgtattgcattgaagaaagttgcatcacggctcaagaaaaaaagaaagaagaaaaacattaaaacaaaagtagaagacatttcaaaagcaggagagtatttacaagttaaactaccacttaattcagctgctagggaatttaaaccagatgtaaagtctaaaccagtatcaggttcatcttcagcaccagcttctgaagatgtgaaacccaaacctttgtctgcaaattctcccaagccagcttgtgaagatgtgaaggccaaaccagtatccgataattcttctagacaagtttctgaggatgggaaacccaaagggttctcttctaattctcccaaaccaggctctgaggatgcaaattacaagcgagtctcctctaattctcccaaaccggttcttgaggatgtgaaaccaacttattgggctcaatcccatttggtcacaggatactgtacgtatcttcctttccagagatttgataacacccggacatcgccagcatacataaatgtgttaccaggtttgccccagtacaccagcatatatacacccttggtcagcctttctcctgaatatcagctaccaagatcagtaccagtggtgccgtcttttgtagccaatgacagagcagataaaaatgctactgcctattttgagggtcatcatttgaatgctgagaatgctgctggtcaccagattgcctccgaaacacagatccttgaggattcttcgttaatatctgtaaagtcacagtgcagcacaggtgatgctcatacagtcctgagtgagtctaacagaaaagatgggcactgtggaaattctaacaacaaatgtgaagtaattccagaaagcaccagtgcagtaacaaacattccacaggtgcagatggttgccatacaggtatcttggaacataacacaccaagaagtcaatactgagccatataatccttttgagaaacaacaaggggaaatttcacggattgaaaaggagtaccaagtattacaagaccaacttaaagaagcgtatgaaaattatgagcagataaaacttaagggcttagaagagaccagggacctggaagaaaagttgaaaaggcacttagaagaaaacaagatatcaaagacagaattagattggttgcttcaagatttggaaagagaaattaaaaaatggcaagaggaaaaaaaagaaatccaaaaaacactaaaatcactgaagaagaaaattaaaaaggtttcaaatgccaatgaaatgtatacccagaaaaatgatggaaatgataaggaacatgaattacatctggatcagtcccttgaaatcagcaacacacttacaaacgagaaaatgaaaatagaagagtgtataaagaaagggaaaaaggattatgaagagagtcatcagagagctgtggctgcagaggtatccgtacttgaaaactggaaggagagtgaagtgtataagctacagatcatgcagtcacaagcagaagcctatctgaagaagctggagctgattagccatgatcctgcagcatatcctgacatggagtccgatatatgttcatgggaattgtttctttctaatgttacaaaagaaactgagaaagcaaagtatcagtttgaagaacaaattaaggcaattaaaaatggttctcggctcagtgaactttctaaagtgcagatttctgagctttcatttcctgcctgtaacacggttcatcctgagttactccctgagtcttcaggccatgatgaccaagggtttatgacttccgcaagcgatgtgactggaaaccaagcagcacttcacagggatcccagtgtgttctctgccggcgattccccaggggaggctccttctgcactgttgccagggccacccccctctcagcctgaagccactcagctgccagggccaaaaggggctggccaggcagctctgtcagagcaaagccctgcggctgatcagaagcagcctgttcctccagggtgtgctgcatgttcaagccagtctccaaaaaagccattcaatagtattattgagcacctgtcagtggtattcccatgttacaacagcactgagcttgctggttttattaaaaaagtgagaagcaaaaacaagaactcactttcaggattgagtattgatgaaattgtccaaagagtgacagaacacattctagatgaacagaaaaagaaaaagccaaacccaggaaaggacaagaggacttatgagcccagctctgccgcccacgtgaccaggtcctcccagggcccacccttggcggttgttgcaccatcacccaaaaccaaggggcagaaagcagaagatgtccctgtgagggttgcactgggtgcaagttcctgtgaaatatgtcacgaggtgttcaaatcaaaaaacgtgcgtgtgctcaaatgtgggcacaagtatcacaaagggtgttttaagcagtggcttaaagggcagagcgcttgcccagcctgccagacttgtgatctcctgtcagaagagtagcctgcaccttctggaagaggctggcccagtgagaatcgggagccgccttcctgctcctctaggtagtcacacttcactaaagcgtcatccgccagcgtgttgaatcggaagaatgacaatttcctaccattggtgtaaaaagcaaacatctgaagacccttgtgcattgtgtgttacaaagctaaatccatggaaatcgttaatatcattgatattaagtaatttccccactctgagtgaatactttgatgatggccaagcagtggctaacaaaatgatggctaccacactcatgggtcgcttgggctgtgcagggctctttgaggtgggtagtttcttttggaaagtactgtgagcgcctcaaagcagtattctagtgataagaattcttaacatattcggccgggcgcggtggctcacgcctgtaatcccagtactttgggaggccgaggcgggcggatcacctgagatcaggagtttgagaccagcctcaacatggagaaaccccgtctctactaaaaacacaaaattagccaggcatggtggtgcatgcccataatcccagctactcaggaggctgaggcaggagaattgcttgaacctcggaggcgcaggttgtggtgagccgagattgcgccattgcacgccagcctgggcaacaagagcgaaactctgtctcaa

SEQ ID NO: 57591 - DNA, 4057 bp, Homo sapiens
tggctgagtgttggtacaggctttccacagcaatattaaaactgaaaaaatcagcaatgaagctcccagccacatttctgcctaatgatttgggggaaaacaacagaggcactcctcaacttttccttcactgcacaaagtggatttggctggaaatgccaaatgtgcttgtagctgggatctttcaaatgaaagcaagctgggagtcaacctcctgcagccgcaggccagaaatgggttgagaccaaactattatagtaacactggtgcacatctaaacagatttaactccctcccagcaatccagattaatttaatatgctttcttaatggcattccgcatttctcattaaagcaaatgaacgtccatccctctgtgataaattaggtcaaaaaacattcatatatttagggcacagggaaggaggagttgttggctgttaaaaaaaaaaaaaaaaagtcctgcaaatggcctttcaaagtctagacatcttcatcatcaacacaaacattcctcttcacaaagggacctcaagtaaccttaggctggagggcccacctgcgtatgtctttcttctcattctttcttaccttccctccagcccacacaactcacattcagtgaccaagtcacgtaggttttacctcctaaatctctcatatccttcactgctcagccactctcctgacaccaccataaaccaagccaccatcacctccagctgtttgactgcaaatgcctccagactggcctctgcttttccctggccctgtgacaatctgcactcctcacagggaccaaagcaatcacttcagaaggtgcatccaaacagatcactcaactttcaatggctccctctgctgtgtgggttaacaatgataaaagctcggccgggcgtgggggctcacgcctgtaatcccagcactttgggaggccgaggcggtcggatcacgacgttaggagatccagaccattctccctaacacggtgaaaccccgtctctactaaaaacacaaaaaaattagccgggcgtggtggcgggcgcctgtggtcccagctactccggaggctgaggcaggagaatggcgtgaacccgggaggtggagcttgcagtgagccgagatcgcgccactgcactccagcctgggtgacagaatgagattccatctcggaaaaaaaaaaacaacaacgataaaaggtcaccttttctgagcacacactatctcagtccatccctacatcagccctttatttcaccagtggggaagctgggacagagagtagttacgtgggatgcccaaggtgggaccactcgtgtgaagtttccacaccctaatgtgagaccctctatgacctagcccctgtctttctccagcctcatttcctgattctctcgcttgccctgcaggcttcagccacagaaacttcttgaaagtcccttaaatctggctgagcaaagtggctcacgcctgtaatcccagcactttgggaagctgaggcgggtggatcacctgagatcaggagttcgagaccagcctggtcaacatggtggaaccccatctctactaaatatcccaaaattagccacgtgtggtggacggcacctgtaatcctagctactcgggagactgaggcaggaaaatcgcttgaactcgggaggcagaggttgcagtgagccaggatcgcaccactccacccaagcctgggcgtcaagagtgaaagtccgtctcaaaaaaaaaaagtcccttaaatctgctgtatgcctatcaacctcagggacttcactatgctgttcctcaccctgaaatgctgttcctcatttctccacatagtgaactcatcccaccccctaggcctctccttaagtgtcatctcttccaggaagattttacttttttaatataactattaaaatataattcaggtaccgtatgatttgccaatttaaagtaaacaaatcaatggtttcagtgcattcacagagctgggcaaccaccatcatgatcaattttaaaacattgtcatcaccccaaaagaaaccctgtatctatgagcaggtacctgccatttcctcctcccactaagccctgacaatctacttttttgagatagagtctctgtcacaggctggagtgcagtggcacaatctcggctcactgcaacctccgcctcccgggttaaagcaattctcctgcctcccgagtagctggaattacagggctatgccaccacgcccatctaattttgtatttttagtagagacagggtttctgtcttcatagatttgcgtgttctggacttttcatataaatgaaatcttataatatatgaccttttctgactagtttcttctacttagcataatattttcatagttcatccgtgttgtagcacgtgttagtacttcattccttttgatgactgaataatattccattgcatggtcaaaccatgttctatttctccactcatcagtagacaagcatttgtgttgttttcactttggcgctattatgaataatgctgctatgagcatttgtgtacaagtttctgcacggacatatattttcatttgtttcataaactggagtggaagtggtgggtcatagaactctgtgtttaagcttttgaagaagtgccagactgtgtaagaaagaaagcctttcctcaccctgtgagactgagctccctctctccatttatacattctctttatgccctttgcttctctttcagagcaattcactttgacctgggtcaccctcaacttaaggctcataactcccctagatcctcagggtccacactaaatgtgatgaaatatgatgcaagccacatatttacttttgcattttgtagtaaccacattttaaaaagtaaaacaaaagaagtgaaggtaattggaataatatcagagatttaaacaaatctatccgaaataccaggtctacaagtataaaatattttaacattaacaaaatactttgctttctttttatattaagtcttcacaatctaatgtgtatttgacacttctcgcacatctcagaatgatggcagcaccccatatggggggccctcccatgatgccaatgatgggccctcctcctcctgggatgatgccagtgggacctgctcctggaatgaggccgcccatgggaggccacatgcccatgatgcctgggtgcccaatgatgagacctcctgcccatctcatgatggtgcccagtcagcccagaatgactcgaccagacagataaggatagaggggaggcctcatacatcagtgttgttttgttgttgttattgttgtgttttctttgtttgtaatgttttgttttgtttttgagacacaatcttcctctgtcgcccaggctggagggcagtggcacgatctcagctcactgaaacctccacctcccgggttcaagcaattcccctgcctcagcctcctgagtagctgggactacaggcgtgtgcaccatgcccgactaattttttttattttagtagagacagggtttcaccatgttggccaggatggtctcaatctcctgacctcgtgacccgctcgcctcagcctcccaaagtgctgggattacaggtgtgagccactgcgcccggcctatatgagttttatatttacctgctcccttcaccaggagatcatgctgctgtgatgccggcttttcttaacagcataaggaagacttgtccccttgccctatcaaagagaatagttttggaggggagaagtgggacaaaaagatgcagtattcatttctattgggaaatatgaaaataaaattgtcaactcttttagttaaaaacaacaacaaaaaaaaggaaacgagatgtggggctgccacatgcaatatcgtgcattaaaaggatcttctactctggaggaaaatatctttgctgatgccagaccaacctaacacaaagaccttttggttttttaatgtgactgtgttttattttacaatgtgtaattcactttagaagggcaaagtacctgtctggggaaaactatttaatttcctgcatttattt

SEQ ID NO: 57592 - DNA, 2022 bp, Homo sapiens
atgaaacgccacttgagaaaaccaggagacgcaggcttgtttagacttcaagttcctccctctttaccgtttggtcgccgtacttctcaaccgcaccgatgggcggcgcaacacgatgaaaccggatccagcagaaacaccacgcctcagatcactaaggtgcaggccaggattccctgccgttcgcggtgccttcccgctcccggatccaccaggcaattcaattcactcatccggcgcagtcgcaaccttataaaccgggggaaggggcgggcaggggcagcgggtaccacagacgccagccaagatctccgctccagaacgcatggactgctttacccgggaggaaggacattgcttcgccaaccaccaggaaaacagtccctgtgcacccggattcctattgccccgcacttcgtgtcaactccagtaccgaggacacgccagagacccaggcctccggacgcgcccggtaccacggctcccgccaaaagggcgggcgcactctgcaaatctcggggcccactgcaccgcaccaagagcacagtgaggtaccaagagcacagtgaggtgccaagaaagaatggagcctacgaaacccacctccaaagcaagcaattcatccaagaaaaaacccgtctcagcgctccgttggtcctctcgcacgggccgcctggccgccctgctcaggcacagctcaaacccctccaccctattccggccctctcacccgagatcaggccgccgcctctagtgccagcccggggcaaaacagggccaccccccgacccgctacaccccacgccctcttgcccccccggccgggtcttggtcgggacaagcgaccgtggtgggggcgttgtgagagaaaggccccgcgcggctgggccggctgttcgccttcggccagccctgacggctctgggtgggtggggcaagagggggcctcgcaggagcccctgtgcggcgagggatccaaaacgctgcctccgcgacagggcggaggaccggagggcgtcccaggatcgtgggccctgggccctgacgcctcggagcactccctgctccgagcgggcccgatgtggtggaagctcgggagcgcgggagccgggggaaggccgcgggccagcggctcgggggtccccgatccgagccccgcggccccgggctggcgatcaggccgccgcctctagtgccagcccggggcaaaacagggccaccccccgacccgctacaccccacgccctcttgcccccccggccgggtcttggtcgggacaagcgaccgtggtgggggcgttgtgagagaaaggccccgcgcggctgggccggctgttcgccttcggccagccctgacggctctgggtgggtggggcaagagggggcctcgcaggagcccctgtgcggcgagggatccaaaacgctgcctccgcgacagggcggaggaccggagggcgtcccaggatcgtgggccctgggccctgacacctctgaactcctgagtagctgggaccccaagcgccagaagaggagcctggctcccccaagtgcccggccagccttgccggccggattccagctgtcaccgcccgcccagggccgcggggctcggatcgtggaccctcgagccgctcgcccgcggccttcccgtggctcccgagctcccgggatcctgccacatccggcccgctcggaacagggagtgctccgaggcgtcacggcccagggcccacgatcctgggaccccttccattcctccgccctgtcgcggatgtatcgttttggatccctcgccgctcagaagatcctgcgaggccccatcttgccccaaccaaccagagccgtcaaggctggcccaaggacgaacagccggcccagcctcgcgggggtttttctcacaacgcccccacaacgttcgcttgtcccgaccaagacccggtctattggcaagagggcgtgggctatagcggttcagggtttggccctgctttgccccgggctggcactagaggcggcggcctga

SEQ ID NO: 57593 - DNA, 5576 bp, Homo sapiens
ctcactctgtcgcccaggctggagtgcagtggggtgatctcagctcactgcaacctgggcaacagagtgagaccctgtctaaaaacaaacaaacaaaaaaaaatgtggtaagatacccatcatatgaaattcaccattaaaaaatagcagggagcatcgtgaatgcgaagtattgatgaggatgatggtgatgttccagaaccttctctgacaccagcctggcgcccccccccccccccagccttacctttcctggcttcatggtgctcatcatactgtactgcaaatgctggtttcctccttctcgccagctagacccgtggtaccccacagggagggaatggcgactcacccaccaggcgcttaataagtgtttgttggccagtggacctcctacgctccctggggagagggactgggactgggactgggactgggacgtgtgtacacacctgcagctacaagactcggtggggagggtgcacagagcctcgaccctgtaagagaggcgatcgggctgaggaagacggggcactggggctggatggatgggacggacatgtggagagggtgggttcgtggatttgttcacccgttcatttattggtttctatgcatccatccatctttcacgccttgagcgtgcgttctgggcagggcctgtaatgggcaccgaatgagtaacatatcgtctctcccttcaaggtacacgcagcctgggtgggtgaggggagagacggtagggtgacatgggaacagtttgggggttgggaagcgctcttgttaaaaattcaaactttgggtcccctctcagatttataaacctaaacgtttgctggtggacctaggactccgcgtatccaggcaggatcctccgctgattggggtgcacgatgacgtcagaacacgtggataacgtgataacttgtgggccaggggctttggaacctcaaagaatgtgataacttttgggtcaggggctttggaacctcaaagacctccgcctgggagatcggggacagctcccggaggaggtgacatctgagtgttaaacacatccgtgacaggcaatgagaaaataaggtgggtccgctgtgctgatcggccctaggggccgcggcggctgtcccggccgggcagcgtcgccttccgaggtgtcttggcctgcggggcactcgtagcccgccgctttcccaggtgaggcacgtcgtcgcccagcgacccaggttggagtccccgcttcagccgccgcggcggatgcggcggccaggcttctccgggccagggcagcgttgcacgtgtggccccgctgggccccgagcagctgcggcaggtcctgaagcgggtgacgaaggcgcagctgctgccgccgcggcccatcaggccgccctccagcgggaccctggcgccgagcccccgtgcccgccacgcctgctgccgccccaggtgaggctccgggagcgacgtggggaaactgaggcccggagggggccgaggccccgcggcggggttagctgcttggccggggtggccagtatccggccccagtcaagactcagggtgtcccgaagctgagccccttagggacggcgttcggcccccacctgccaccaccctggcgttttcaccccaggagcctcacttgaggagccgatgctcacgctgggccctctgcctgggacgccgtcgtgccctctctgcctccacagccctgcccggggctcccctgtgctgcctagctcgtctgacacgcctttgaccactcgttcagcctctgtggggcactcagagacggggttgcccgcactcccacctaagtgcaggaggtgcggccttcaacacactcgaagaacgaacatcaggcaggttctgggagggacagggggccgctttagagtgggtgggcccgtaggccagacgctgcccctgagacctgaatgaattaaaaggaaccaactgagcttttcaggtctcaggcacagcaagtgccacggcccagcattttcttctcttcattgctgcttctcagcattttctttctctctctctctctgtctctgtcactgtttttgcatacagatactatgcttttggggtgggtactctcattgtccttccaggggtcctacacggcgtctgtaaaattccatctcatttcattgctggcgctgtaaataaaattagtcttaacccaaaattgccaaaagaagagggctttttccactagaagagatgcgttagagaatagaatcagcgatcttcactcctgagttttttcgacttcactcgtgattttagctgcctggggttgttgtatccagttcatcatcaagagtggagagttgtcttgctaaggtttaggaaggcaagtatgattctgcccaaatgccacactatctagaggtgtgaccttgggcaactcgacctttttggactgtggtctgggtccgaaggctgcaagacgccatcccgggacagccatctgctgagcctctgctctgtgccgggcagtgttctgggttgcttagctcgcagtagtgtttttgtaccagcattttgcagggaggttgagtggctttgtccaagatccctcaggtgtggctgctctccagagcccttgttctccccagcacaccctgctgtatgtggccacagctttttgggtttggaatggagtcaaaaaatgacatacttttcataaagtaaaagcaaacttagtcaagatcaggcagcatgatgggacttattctgtagctaatctgatggagacgtataaattctacctccaataatgtacctttgtagcacattctgcgaatactttttcagccccagctgtgtcgtggaagccacgaagtcaaaccggatgtgtactttgcccctcagtagctgatgaactaacaggagataaaacatgacccagatacctgctaatcaaggcctgaaagctagtgatgaagaactaaatgtagttagagaaagggagattgtttctggccgaggaaatcacaagcagctttgttgaagaagtggtatctgaactagatttgaaagggtgagtctgagttgaaaatgcagaagaggagaggcaggttctggagcaggtggcggggtgcatttcaacaaccacagcagactgcccagtggttcgctgtgggggatggtgtggatcagaagcacagaccagtggacacacttgggtcagatggaggcccctgtctctccgcatcttccctcttcccaccccccagaaatgtccagttccatccaacatgccaaccccttttcatgcatccatgcatgtacacatttttctttgtactcagaatgccctacctggcaaaaattcccagccttcaaaacgcccctcagagatcactgcttctggtctgttctgcctctttattgcacctgttgtaccatgatgacatttttcccgtctgcctcacctgtctgcattccttagggaaacttgtctgccttcgaaatcgtcagcggagcttttgaaagggcagatcgggtctccgacccaggagatcgattcagcaggtctgcggggactgaggcatggcagggaaactgcccaccatctcaagggtgaggctaggagttggctagtgtgtatgtattccatccagaaatatttagtaaatgttcaccaaacaaaataaaaacacacaagaaagcatgaggcgtaatacccacggggtaagccagtcaggatagaggatgaatacattattaggccggctttgctgctgtggttatcctaaaacaatagggtttaggttgtgtgtctgtgtgtatatgtattttgttgttgttttggggttttgttgagacaaggtgttgcattctcacccaggctggactgatcacggctcactacagcctcaaactcccagactcaaacgatccttccccctcagcctcccgagtatctggggctacaggcatgtaccatcaagcctaattttaaaatgttttgtaggcggggctcggtggctcacccctggaatcccagcactttgggaggcggcggcgggtggatcacctgagatcaggagtttgaggccagtctggccaatgtgatgaaaccccgtctctactaaaaatacaaaaattagccagtcacggtggcgcatgcctgcaatcctagctactagcgaggccaagtcaggaaaatcgcttgaactcgggaggcagaggtttcagggagccaagaatgcaccactgcagtccagcctaggcaacagtgagactctttgttttgggtttttgtgtttttttttaacattttgtagggacagggtcttgctctgttgcccaggctggccctgaactcctggcctcaagcaatcctcccacctcagcatcccaaagcactgctactgcaggtgtgatttgtgtttggcccttagagagagattctgtgtgattggtagtaaaatgaaacagacatcgttcttgaaggatatgcacagccaatctagttgtcatttgatttgcacgtagcccaggaatggggactcccagggttgtggtgccacctcggtacacttgacctctgttatttgtactagtgtataacaagagccagacgagagacacactccagcctgatctcagtgagggtctttattctgtcctgtttgacatttttattgactttctactgtttgagggtcacaccagaaggttgagtccaaagagggccagttggtggtcccaaataagtggttctcaaccgaggacagttttgccccacaaggggcacttggcaatatcttgtcaggactcgggatcactactagcatctagtgggtagaggcagagatgctgctgggcatcctccagccacccatgtcaaaggattatgttctgaaatgttggttgtgaaatcatgctctggatgacgaggtttgcctctttttctccctggaggaaaatgctcattatttctgctctgtgagggcaggagccttgtttcttttgcttcctgaccttctcccctaagctgtatgagaactgtttctctgacacctgtagcagtgtctcatgcacatggtcagtactcaataaatatttgtgggatgttgtcgaaggtagctctcccctttggtaggtgttttgctattacagacagtgctgccttgaacctcatagaacataacatctttatggccatctaagtttttttaattttggaatccaggaagtagaattactgggtcaaaaagcacatgtatttgaaattttgttagatatatttgtaaaaagttgttgaggatattcagcccggccgggcacggtggctcacgcctgtaattccagcacttcgagaggctgaggcgggcggatcacttgaggccaggagttcaaaaccagcctggtcaacatggtgaaaccccatctctactaaaaatacaaaaattagccgaatgtggtggcgggcacctgtaatcccagctacttgggaggctgaggcacaagaatcacttgaacctgggaggcggaggttgcagtgagccgagatggtgccactgcactccagcctgggtgacagagtgagaccc

SEQ ID NO: 57594 - DNA, 1883 bp, Homo sapiens
ctgtttgttattgcccttagaggggctctgagtatctacttgtgggtggccatttcctgacatctgcatgtacctcgtggaattcagccagcttcatgttgcaaatcagaaagctgaccccaagactgcaaatcaatgaaggtattggcattgttaaggacgtagcgtagacaacagcagtcataaataattaggcaggaacttaacccaaatctagttctttgaccacctctaccaccagaacccagcagacactcacatctcctgataagagttgctggactcgatgtttttgttttgcattttctcctctccttccccacttactcagagaatttaaagtctgtagagtcagcacagccccatcagtccaggaacttcccaccaccagcccttgactgtcccattaactgacatggtcagatttccagctccccctactccctgctgtgaaacaatccctctccctgtgagaggaaactgtggagcgtttcttatcgaaggttaaatggactctgctcataaacctcttactgagatgcttcctgatagccaggctggccagagaggggtgcaggggttagatagtaagtggtggtcgtttgtggtcagttacctcaattctgttcattgcagtgcccgtaaaccatgtagaaagctcccagcactgaaaggcaggagtgttagcatctcgctttatccaccataacgtaaagaactgcggtgtgataacagccttcacggggccacggtggaaccaagacagcaggcgaggccatgcctaaacaagtggtctggcacgggcactggccagctgctctctccaagcaggtggcccagatcccacccacgtggactttctcatcaggtgcagcgcctgccactctcagccactgggtgtgtcactctcctcttcatctcagcattctccatcacttcccctccagaaaaacggatggaaggaagccctctgtgacactgcttctgagaagaagcatttccgggaccgatatcatctgtctggtctctgtgaacagcaaggaatcttcttgaccgttcttgggcactggaggctggctaggagttcagtaataaacgtggccttcgtgctgtagggcagagtggatgcagtttgtagctttcagagtgtctcattgagtctagatcattgaaccaacacttaaccaaatgtcccactcccatcacactaggacttgtcattccatgcccctctcctagtggtcatggtttcatatgggcatacaactgctactgaagttatatagccttgaaaactcagtgcaggttgcccttaattttccccaaacccctccatcggcaagtctagttgccctttagcacctaaagatctgcaccccaaaccaatgtcaccataaagagggcacgaagaagagtgggtgtgatcccaacggggttttgtaactgaagaagcccagtgtgagcttctcatcttttcatatacctctaacccccggtactcattgaatcattgatgaggtatctcaattgagatttgcaaggactttgataccatttgaaatggaaaaattttgaacgggctttaacatgtttaagaaatatggatggggccggccacagtggctcacgcctgtaatcccagaactctggaaggctgaggcaggcggatcacctgagatcaggagttcgaggccagcctggccaagatggcaaaaaccccgactctactaaaaatacaaaattagccaggcgtggtggcgtacgcctgtaatcccagctactcaggaggcaggagaatcgcttgagcctgggaggcagaggctgcggtgagccgagatcgtgtcactgcactccagcctgggtgacagagactccatttaaaa

SEQ ID NO: 57595 - DNA, 468 bp, Homo sapiens
atgaagggcaccacagcaacccctggatctctcaagaatgtacctgtttttaacatgctggatcaagtgtcagcactcagtagatgaggaaggggtagagcccgacttgtacagattccgcggatggtaaatggccctctggcgtgtttacaatacagctgtgcattcttaatggctctgccgctgccatgtcagctgtctgcttcagaaagtgagggctccaggaatgaggagaatcttcaagaacttcctcgcactgtgacatgtctgatcccttgctcccatccctgcagcatgaacaagattactctgtggctacgtgaagcatgaactggaggaggcaggagcaggagggctgaaagtcatacaaatgaaatcatacaatcatcgctgttttctgaagcatgtcctttagaagtacctttaatgaatgtttttggaagtaaactttcttattttttgtttgat

SEQ ID NO: 57596 - DNA, 457 bp, Homo sapiens
aaagaccacactgttgacagcgttgggttccagtagcggtaaactaccaaggggctggtttacagaaaatgagtttgctctgtgatgtcatacaagtttgctttgtcctgacgccaacatgacactgaggcagcagaggagggagaacaggaaaattggaaccgtactcttagttaatggtttccagagattatttagcaggacttgaacagagggaggaaaatattgtgaaggattgctgcgaggtgtaccataattgcgtgcagctgtctgcttcagaaagtgagggctccaggaatgaggagaatcttcaagaacttcctcgcactgtgacatgtctgatcccttgctcccatccctgcagcatgaacaaggtggacactcactgacctgtcacaaggttgccccacaaaactttggggtccatgtctgaatggattgccagagccttctcatc

SEQ ID NO: 57597 - DNA, 486 bp, Homo sapiens
gccgccctcgccaccccgcctgcccactcccgccgccgccccgctctcgctttccccccggcctcccctcgccccttcccctcccccttcccggcgcactcggggggctgggaacgagctgccatgtgatgcgcgtcccctccgcgagctttcggtgacccacgaactgcccacctcgccggctgccgggagggggctgcgagccgggaagacgcggggaagaggaggcggaaaaggacgcaaagttctccggcgagataagagtgttgctgttgatcatctttgcctgggaagttgaatgataaagccagaagaaagcatgctttctgatcatttgcagctgtctgcttcagaaagtgagggctccaggaatgaggagaatcttcaagaacttcctcgcactgtgacatgtctgatcccttgctcccatccctgcagcatgaacaaggtggacactcactgacctgtcacaaggttgccccacaa

SEQ ID NO: 57598 - DNA, 2572 bp, Homo sapiens
tacagggaatttcgacaaatctctgcactgatcacctaggtgatgtaactcttgtctaccctctgcctacagggggcgttgtgaaatatctctgcactgatcacccaggtgatgcaactcttgactaggatctgcctacaggaggtattgtgaaatatctctgcactgatcaactaggtgatgtaactcttgtctaagctctgcctgcaggggcgttttcacatatccctgaactgatgacaaaggtgatgtaactcttgcctaggctttgcctacaggggacattgtgacatatctctgcactgatcacccaggtgatgcaactcttctctgtgctctgcctacagggtacattgtgacatatctctgcacagatcacccagtaaactgtttcacgttagacctgtaacccaaggagatgtgtatagagctgaaactgaagaaattcctaaaatattccagatactatatgcaaatgaaggtgaatgtagaaaagatgtagagatggaaccagtacaagaagctgaaaaaactaatttccaaaatcacaaaggccatgagtttattcctacactctaccactttcctgccaattgtgatgcctgtgccaaacctctctggcatgtttttaagccaccccctgccctagagtgtcaaagacgccatgttaagtgccacagagatcacttagataagaaagaggacttaatttgtccatgtaaagtaagttatgatgtaacatcagcaagagatatgctgctgttagcatgttctcaggatgaacaaaaaaaatgggtaactcatttagtaaagaaaatccctaagaatccaccatctggttttgttcgtgcttccccttgaacgctttctacaagatccactgcaaatcagtctttccggaaagtggtcaaaaatacatctggaaaaactagttaaccatgtgaccgagtgccttgtggaatcgtgtgggatgctacctgataaaccaggcttctttaaccatgcagagcagacaggctgtttctttgacacaaatatcacaggcttcagggttaagattgctgtttttctgtccttgctttggcacaacacactgagggttttttttatcgcgggtttgcctacaggtagattagattaattattactatgtaatgcaagtacagttgggggaaagcttaggtagatatattttttttaaaaggtgctgcctttttggatttataagaaaatggctgtcagtcgtgatagaacagagttttcctcatatgagtaagaggaagggactttcactttcaagtggaacggccatcactatcaagatcagctcatggaaggagtaaagaaaatatctcaaaatgagacaaactgaagttttgttttttttttaatgacttaagtttttgtgctcttgcaagactatacaaaactattttaagaaagcagtgatatcacttgaacttcagtgccctcactgtagaatttaaaagccttactgttgattgcccatggtggacttgatggagaaattaaatatctttcattatgctttacaaaatactgtatatgtttcagcaagtttggggaatgggagaggacgaaaaaaagttacatttaatctatgcatttttgccaagccatattgagttattttactactagagacattaggaaactaactgtacaaaagaaccaagtttaaaagcattttgtggggtacatcatttctataattgtataatgtatttctttgtggttttaaatgataaagacattaagttaacaaacatataagaaatgtatgcactgtttgaaatgtaaattattcttagaacactttcaatgggggttgcattgtccttttagtgccttaatttgagataattattttactgccatgagtaagtatagaaatttcaaaaaatgtattttcaaaaaattatgtgtgtccgtgagtttttcattgataattggtttaatttaaaatatttagaggtttgttggactttcataaattgagtacaatctttgcatcaaactacctgctacaataatgactttataaaactgcaaaaaatgtagaaggttgcaccaatataaaaaggaaatatggcaatacatccatgatgttttccagttaacataggaattaccagataaatactgttaaactcttgtccggtaacaagagttgattcatatggacagtatgatttattgtttctttttttaaccaaatacctcctcagtaatttataatggctttgcagtaatgtctatcagataagaagcactggaaaaccgatcgtctctaggatgatatgcatgtttcaagtggtattgaaagccgcactgatgaatatgtaataataaacatatctgttattaatatagtaatgactgtgctcatttaatgagaaataaaagtaatttatggatggatatctttaattttgactgcaatgtgttttctcatggctgaaatgaatggaaaacatacttcaaattagtctctgattgtatataaatgtttgtgaaattccatggttagattaaagtatatttttaaaag

SEQ ID NO: 57599 - DNA, 1584 bp, Homo sapiens
ctcatggtcgtcagcatggcgtgtgttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactggtatcgccagacacctgcatgctgtgattaggtactcagtggccatcatcctctttaccatccttcccttctttctccttcatcgctggtgctccaaaaaaaaagtaagcctcacgaagcagaggccagagaactcagggccctgtgcggaagcaggatgggagcacgcagatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatg

SEQ ID NO: 57600 - DNA, 1883 bp, Homo sapiens
ctgtttgttattgcccttagaggggctctgagtatctacttgtgggtggccatttcctgacatctgcatgtacctcgtggaattcagccagcttcatgttgcaaatcagaaagctgaccccaagactgcaaatcaatgaaggtattggcattgttaaggacgtagcgtagacaacagcagtcataaataattaggcaggaacttaacccaaatctagttctttgaccacctctaccaccagaacccagcagacactcacatctcctgataagagttgctggactcgatgtttttgttttgcattttctcctctccttccccacttactcagagaatttaaagtctgtagagtcagcacagccccatcagtccaggaacttcccaccaccagcccttgactgtcccattaactgacatggtcagatttccagctccccctactccctgctgtgaaacaatccctctccctgtgagaggaaactgtggagcgtttcttatcgaaggttaaatggactctgctcataaacctcttactgagatgcttcctgatagccaggctggccagagaggggtgcaggggttagatagtaagtggtggtcgtttgtggtcagttacctcaattctgttcattgcagtgcccgtaaaccatgtagaaagctcccagcactgaaaggcaggagtgttagcatctcgctttatccaccataacgtaaagaactgcggtgtgataacagccttcacggggccacggtggaaccaagacagcaggcgaggccatgcctaaacaagtggtctggcacgggcactggccagctgctctctccaagcaggtggcccagatcccacccacgtggactttctcatcaggtgcagcgcctgccactctcagccactgggtgtgtgactctcctcttcatctcagcattctccatcacttcccctccagaaaaacggatggaaggaagccctctgtgacactgcttctgagaagaagcatttccgggaccgatatcatctgtctggtctctgtgaacagcaaggaatcttcttgaccgttcttgggcactggaggctggctaggagttcagtaataaacgtggccttcgtgctgtagggcagagtggatgcagtttgtagctttcagagtgtctcattgagtctagatcattgaaccaacacttaaccaaatgtcccactcccatcacactaggacttgtcattccatgcccctctcctagtggtcatggtttcatatgggcatacaactgctactgaagttatatagccttgaaaactcagtgcaggttgcccttaattttccccaaacccctccatcggcaagtctagttgccctttagcacctaaagatctgcaccccaaaccaatgtcaccataaagagggcacgaagaagagtgggtgtgatcccaacggggttttgtaactgaagaagcccagtgtgagcttctcatcttttcatatacctctaacccccggtactcattgaatcattgatgaggtatctcaattgagatttgcaaggactttgataccatttgaaatggaaaaattttgaacgggctttaacatgtttaagaaatatggatggggccggccacagtggctcacgcctgtaatcccagaactctggaaggctgaggcaggcggatcacctgagatcaggagttcgaggccagcctggccaagatggcaaaaaccccgactctactaaaaatacaaaattagccaggcgtggtggcgtacgcctgtaatcccagctactcaggaggcaggagaatcgcttgagcctgggaggcagaggctgcggtgagccgagatcgtgtcactgcactccagcctgggtgacagagactccatttaaaa

SEQ ID NO: 57601 - DNA, 468 bp, Homo sapiens; identical to SEQ ID NO: 57595

SEQ ID NO: 57602 - DNA, 457 bp, Homo sapiens; identical to SEQ ID NO: 57596

SEQ ID NO: 57603 - DNA, 486 bp, Homo sapiens; identical to SEQ ID NO: 57597

SEQ ID NO: 57604 - DNA, 1424 bp, Homo sapiens
gctgtggtaagtgcatcctccttcagtctcagttctgaaaatagatcatcatggtggcaccaaagagtcacacagatgactgggctcctgggcctttctccagtaagccacagaggagtcagctgcaaatattctcttctgttctacagacctctctcctcttcctgctcatgggactaagagcctctggaaaggactcagccccaacagtggtgtcagggatcctagggggttccgtgactctccccctaaacatctcagtagacacagagattgagaacgtcatctggattggtcccaaaaatgctcttgctttcgcacgtcccaaagaaaatgtaaccattatggtcaaaagctacctgggccgactagacatcaccaagtggagttactccctgtgcatcagcaatctgactctgaatgatgcaggatcctacaaagcccagataaaccaaaggaattttgaagtcaccactgaggaggaattcaccctgttcgtctatgcaccatttattgaaaagttgtccgtccacgtcatcgagggtgaccaccgcacactcctggagggcagcggcctggagtccatcatcagcaccctggctgagccacgtgtgagcgtgcgggagggctaggccctcgcccccacctgccactggagaccgctccgccatccccacctcaccgccgcgcagcagagctggaagggtcctgccgatgggaccctgccaggcccagtgccactgccccccgaggctgctagacgtgggcgttaggcgtgtcccacccacccgccgcctcccatggcacgtcgggaacaccggagccgccaacttggagactcctggtctgtgaagagccgctgacgcccgcaggaaccgggctgggccttgtgtgccagtggggtttgtgcttggtctttctccgcttggatttgcttatttattgcattgctggtagagactcccaagcctgtccaccctgcaaagactcctcgggcagcatgcgggtcccgcacactgcacccatttcctggatgtcccctgcaggcgcgggaggccatccgggcctgctggctgcggccccctctcagccaggcctggctcagcccactgcgtgggaggtcaccggccactccccgaggagctgggatccccgggatgcaggcccacagtgcggggctgcacccatgatgcggagctggcctccaaccctgcgggccgcgccaggcaccaactcagtgtttgtcagtgtttgtttttccaagaaatggttcaaattgctgctcagatttttaaatttactgtagctgccagtgtacacgtgtggaccccattttatttttacaccaatttggtgaaaatgctgctttcctcagcctccccacaattaaactgcacatggtctctaaaaaaaaaaaaaaaaaa

SEQ ID NO: 57605 - DNA, 2486 bp, Homo sapiens
gctgtggtaagtgcatcctccttcagtctcagttctgaaaatagatcatcatggtggcaccaaagagtcacacagatgactgggctcctgggcctttctccagtaagccacagaggagtcagctgcaaatattctcttctgttctacagacctctctcctcttcctgctcatgggactaagagcctctggaaaggactcagccccaacagtggtgtcagggatcctagggggttccgtgactctccccctaaacatctcagtagacacagagattgagaacgtcatctggattggtcccaaaaatgctcttgctttcgcacgtcccaaagaaaatgtaaccattatggtcaaaagctacctgggccgactagacatcaccaagtggagttactccctgtgcatcagcaatctgactctgaatgatgcaggatcctacaaagcccagataaaccaaaggaattttgaagtcaccactgaggaggaattcaccctgttcgtctatgagcagctgcaggagccccaagtcaccatgaagtctgtgaaggtgtctgagaacttctcctgtaacatcactctaatgtgctccgtgaagggggcagagaaaagtgttctgtacagctggaccccaagggaaccccatgcttctgagtccaatggaggctccattcttaccgtctcccgaacaccatgtgacccagacctgccatacatctgcacagcccagaaccccgtcagccagagaagctccctccctgtccatgttgggcagttctgtacagatccaggagcctccagaggaggaacaacgggggagactgtggtaggggtcctgggagagccagtcaccctgccacttgcactcccagcctgccgggacacagagaaggttgtctggttgtttaacacatccatcattagcaaagagagggaagaagcagcaacggcagatccactcattaaatccagggatccttacaagaacagggtgtgggtctccagccaggactgctccctgaagatcagccagctgaagatagaggacgccggcccctaccatgcctacgtgtgctcagaggcctccagcgtcaccagcatgacacatgtcaccctgctcatctaccgcaggctgaggaagcccaaaatcacgtggagcctcaggcacagtgaggatggcatctgcaggatcagcctgacctgctccgtggaggacgggggaaacactgtcatgtacacatggaccccgctgcagaaggaagctgttgtgtcccaaggggaatcacacctcaatgtctcatggagaagcagtgaaaatcaccccaacctcacatgcacagccagcaaccctgtcagcaggagttcccaccagtttctttctgagaacatctgttcaggacctgagagaaacacaaagctttggattgggttgttcctgatggtttgccttctgtgcgttgggatcttcagctggtgcatttggaagcgaaaaggacggtgttcagtcccagccttctgttccagccaagctgaggccccagcggatacaccagaacccacagctggccacacgctatactctgtgctctcccaaggatatgagaagctggacactcccctcaggcctgccaggcaacagcctacacccacctcagacagcagctctgacagcaacctcacaactgaggaggatgaggacaggcctgaggtgcacaagcccatcagtggaagatatgaggtatttgaccaggtcactcaggagggcgctggacatgacccagcccctgagggccaagcagactatgatcccgtcactccatatgtcacggaagttgagtctgtggttggagagaacaccatgtatgcacaagtgttcaacttacagggaaagaccccagtttctcagaaggaagagagctcagccacaatctactgctccatacggaaacctcaggtggtgccaccaccacaacagaatgatcttgagattcctgaaagtcctacctatgaaaatttcacctgaaaggaaaagcagctgctgcctctctcctgggaccgtggggttggaaagtcagctggacctcatggggcctggggctcacagacagaagcacctcagaatttccttcagtgcctcagagatgcctggatgtggcccctccccctccttctcacccttaaggactcccaaacccattaatagttcagacacaggctccttcttggagcctatgggcttcagatgtctttgccccatttgtcacctcgcacacttatagcgtttcctcctcgaaattctaccaagactggtcaaatgttgctgaggggcctggaccagctgtcctttacaccaccttctcaacactgctgaaaagaacccaagagaattgtcacacatgacacaagatgtacataatatcatgctcactgcagtgttatttaaaataaaaggcaggaaataaaaaaaaaaaaaaaaaaaaaaaaaaaaaaa

SEQ ID NO: 57606 - DNA, 2443 bp, Homo sapiens
agttctaaagagaggctgtttaccagaacagcataacaagggcaggtctgactgcaaggctgggactgggaggcagagccgccgccaagggggcctcggttaaacactggtcgttcaatcacctgcaagacgaaggaggcaaggatgctgttggcctgggtacaagcattcctcgtcagcaacatgctcctagcagaagcctatggatctggaggctgtttctgggacaacggccacctgtaccgggaggaccagacctcccccgcgccgggcctccgctgcctcaactggctggacgcgcagagcgggctggcctcggcccccgtgtcgggggccggcaatcacagttactgccgaaacccggacgaggacccgcgcgggccctggtgctacgtcagtggcgaggccggcgtccctgagaaacggccttgcgaggacctgcgctgtccagagaccacctcccaggccctgccagccttcacgacagaaatccaggaagcgtctgaagggccaggtgcagatgaggtgcaggtgttcgctcctgccaacgccctgcccgctcggagtgaggcggcagctgtgcagccagtgattgggatcagccagcgggtgcggatgaactccaaggagaaaaaggacctgggaactctgggctacgtgctgggcattaccatgatggtgatcatcattgccatcggagctggcatcatcttgggctactcctacaagagggggaaggatttgaaagaacagcatgatcagaaagtatgtgagagggagatgcagcgaatcactctgcccttgtctgccttcaccaaccccacctgtgagattgtggatgagaagactgtcgtggtccacaccagccagactccagttgaccctcaggagggcaccaccccccttatgggccaggccgggactcctggggcctgagcccccccagtgggcaggagcccatgcagacactggtgcaggacagcccaccctcctacagctaggaggaactaccactttgtgttctggttaaaaccctaccactcccccgcttttttggcgaatcctagtaagagtgacagaagcaggtggccctgtgggctgagggtaaggctgggtagggtcctaacagtgctccttgtccatcccttggagcagattttgtctgtggatggagacagtggcagctcccacagtgatgctgctgctaagggcttccaaacattgcctgcacccctggaactgaaccagggatagacggggagctcccccaggctcctctgtgctttactaagatggcctcagtctccactgtgggcttgagtggcatacactgttattcatggttaaggtaaagcaggtcaagggatggcattgaaaaaatatatttagtttttaaaatatttgggatggaactccctactgacctctgagaactggaaacgagtttgtacagaagtcagaactttgggttgggaatgagatctaggttgtggctgctggtatgcttcagcttgctggcaatgatgtgccttgacaaccgtgggccaggcctgggcccagggactcttcctgtttcataaggaaaggaagaattgcactgagcattccacttaggaagaggatagagaaggatctgctccgcctttggccacaggagcagaggcagacctgggatgccccagtttctcttcagggatggatagtgacctgtcttcattttgcacaggtaagagagtagttagctaacctatgggaattatactgtggggccttgtgagctgcttctaagaggctaacctggaaactaagctcagaggcaaggtaataaagcacttcagggcttgctccccaagtgggcctgatttagcaggtggtcctgcgggcgtccaggtcagcaccttcctgtagggcactggggctagggtcacagcccctaactcataaagcaatcaaagaaccattagaaagggctcattaagccttttggacacaggaccccagagaggaaaaagtgacttgcccaaggtcgtaagcaagctactggcatggcaagagcccagcttcctgacggagcgcaacatttctccactgcactgtgctagcagctcagcagggcctctaacctgtgatgtcacactcaagaggccttggcagctcctagccatagagcttcctttccagaacccttccactgcccaatgtggagacgggttagtggggctttctatggagccatctgctttggggacctagacctcaggtggtctcttggtgttagtgatgctggagaagagaatattactggtttctacttttctataaaggcatttctctatatacatgttttatatacctcattctgacacctgcatatagtgtgggaaattgctctgcatttgacttaattaaaaaaaaaaaagactccaaaaaaaaaaaaaaaaaa

SEQ ID NO: 57607 - DNA, 2671 bp, Homo sapiens
gcagcacccgccctgcgcctcggtggcagccgtccacgccgtcagtgcctggcggttcccgtgggacataccgtccactcgccacgcccctccgcccgcggcgcaccccacgcaccgtgccctggccgcccgcctcacgcaccgctttcctctccgtccagcgctcgctgcagccgggccgtctcgcagtccagcgtgctggccagagaccgcagcttcccgcagaagctccggatagggtccatgctgagcacagcggggaaggactccaggcgtacgcagaccccaccgctcagctcacagcctcccgccactagtttgaatctcggcgccggacgcgtcctcggctctgcgcaggcgcagtcctctctcgcgagagccgaagtctctcgccgaggccccaggagaccccgcgagacgggtgcgcttacgccacggcgtctgctggcggccgcggagacgcagagtcttgagcagcgcggcaggcaccatgttcctgactgcgctcctctggcgcggccgcattcccggccgtcagtggatcgggaagcaccggcggccgcggttcgtgtcgttgcgcgccaagcagaacatgatccgccgcctggagatcgaggcggagaaccattactggctgagcatgccctacatgacccgggagcaggagcgcggccacgccgcggtgcgcaggagggaggccttcgaggccataaaggcggccgccacttccaagttccccccgcatagattcattgcggaccagctcgaccatctcaatgtcaccaagaaatggtcctaatcctgagtcgtcacccttggattttatggatcacggagctgaccatctttacctggtcctggaactgaaaaactgtagcttgtgtgaaaatgagcctttggaccagtctttattaaaacaaacaaacatgagtagtctgcatatcgaatatctagagctctaaacccccaatacttaaaagtctaattgctgtcctgtggtttcattagtctgataggaagatagggatttcctcagtcacagatgatattttgaaggaaagctgcaataaagccacaatgatttgaggtctttgcttaagtatgagatacttgatgggggctttatcatgcaacattagtttgcttaccttaagaattgcccaaaaatgaaagaaaatatgagcttttcagttaaacatactcctaaaaacattttccgggattttactactaaaattggacatttaagcgaagtaaaagaggccgggtgcggtggctcacgcctgtaatcccaacactttaggagtccaaggcgggcggatcacttgaggtcaggagttcaagaccagcttggccaaggtgataaaacccgtctctactaatacaaaaaaaattagctgggtatgttggtgcaggcttgcaatcccagctacttgggacgctgaggtgggaggatcgcctgaacctcagaggcagaggttgcaatgaagcggaggttgcagtgagccgagagcatgccgctgcactccagcctgggagactgcatctcaaaaaagaaaaataaacgaagtaaaagatatttatcagaactgttacaggaaggtgtattttttagctattttggcagggtgctgtggtgcttgcatgtagtcccagctattcaggaatattgcttgagtccagcttgggcaacatagcgagaccctatctaaaataacaataatatatggccaggcgggatggctcacgcctgtaatcccagcactttgggaggctgaggcgggcagatcacttgaggccaggagttcaagaccagcccaaccaacatggtgaaaccctgtctccactgaaaatacataaaattagccgggtgcagtggtgaggcctgtaatcccagctactcaggaggctgaggcaggagaatcgcttgcacccaggaggtggaggctgcagtaagtcgagattgtgtcactgcactctagcctgggcgacagaaaaagaaaatttaggtggggaaaaaaatcagaattgcgtctgtgggaacaggaataaaggagaaaccactattgactgggaagacacacaaagaactttgtcaaagttgtatggctgaggcccacacggtggctcacttctgtaatcccatcactttgggaggcttaggcagaaggatcacctgagatcaggagttccagaccagcctggccaacatggcgaaaccccatctctactaaaaatacaaaaattagccgggcgtggtggcttacgcctgtaatcccagcactttgggaggccaaggtgggcggatcacaaggtcaggagttcgagaccagcctggccaatatggtgaaaccccatctctactaaaaatataaaaatcagcaaaaaaaatttagccaggcttggtcatgcatgcctgtaatcctagctactgggaaggctgaggaaggagaattgcttgaacccaggtggtggaggttgcagtgagctgagatcgtgccactgctctccagcctgcatgacgggagtgagacaccatctcaaaaaatacatataataatataaataaaaatatcttttttgaaaataatttaatataccatgtaatttaccagttgaagatgttcgctttcagaatataataaaaatagtcaaaaaaaaaaaaaaaaaa

SEQ ID NO: 57608 - DNA, 826 bp, Homo sapiens
tcatgtgacaaagcgcaggacccctcactgccccaactgcttgctgttctctctttcttgggctctaaggacccaggagtctgggtgcacagcctccttctctctgagattcaagagtctgatcagcagcctcttcctcctccaggacccagaagccctgagcttatccccatggagctctgccggtccctggccctgctggggggctccctgggcctgatgttctgcctgattgctttgagcaccgatttctggtttgaggctgtgggtcccacccactcagctcactcgggcctctggccaacagggcatggggacatcatatcaggctacatccacgtgacgcagaccttcagcattatggctgttctgtgggccctggtgtccgtgagcttcctggtcctgtcctgcttcccctcactgttccccccaggccacggcccgcttgtctcaaccaccgcagcctttgctgcagccatctccatggtggtggccatggcggtgtacaccagcgagcggtgggaccagcctccacacccccagatccagaccttcttctcctggtccttctacctgggctgggtctcagctatcctcttgctctgtacaggtgccctgagcctgggtgctcactgtggcggtccccgtcctggctatgaaaccttgtgagcagaaggcaagagcggcaagatgagttttgagcgttgtattccaaaggcctcatctggagcctcgggaaagtctggtcccacatctgcccgcccttccagcccttccccagcccctcctcttgtttcttcattcattcaacaaaatttggctggaa

SEQ ID NO: 57609 - DNA, 3447 bp, Homo sapiens
ggccagtccgcccggcggctcgcgcacggctccgcggtcccttttgcctgtccagccggccgcctgtccctgctccctccctccgtgaggtgtccgggttcccttcgcccagctctcccacccctacccgaccccggcgcccgggctcccagagggaactgcacttcggcagagttgaatgaatgaagagagacgcggagaactcctaaggaggagattggacaggctggactccccattgcttttctaaaaatcttggaaactttgtccttcattgaattacgacactgtccacctttaatttcctcgaaaacgcctgtaactcggctgaagccatgccttgtgttcaggcgcagtatgggtcctcgcctcaaggagccagccccgcttctcagagctacagttaccactcttcgggagaatacagctccgatttcttaactccagagtttgtcaagtttagcatggacctcaccaacactgaaatcactgccaccacttctctccccagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctccaacgaggggctgtgcgctgtgtgtggggacaacgcggcctgccaacactacggcgtgcgcacctgtgagggctgcaaaggcttctttaagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaagtggttcgcacagacagtttaaaaggccggagaggtcgtttgccctcgaaaccgaagagcccacaggagccctctcccccttcgcccccggtgagtctgatcagtgccctcgtcagggcccatgtcgactccaacccggctatgaccagcctggactattccaggttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacaggtccaacccagtggagggtaaactcatcttttgcaatggggtggtcttgcacaggttgcaatgcgttcgtggctttggggaatggattgattccattgttgaattctcctccaacttgcagaatatgaacatcgacatttctgccttctcctgcattgctgccctggctatggtcacagagagacacgggctcaaggaacccaagagagtggaagaactgcaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaagacctcctcccaagcacttcaaaggaactggaatgataatggaaactgtcaagagggggcaagtcacatgggcagagatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataatgtataatgggaaatgtttggccatgcttggttgttgcagttcagacaaatgtaacacacacacacatacacacacacacacacacacagagacacatcttaaggggacccacaagtattgccctttaacaagacttcaaagttttctgctgtaaagaaagctgtaatatatagtaaaactaaatgttgcgtgggtggcatgagttgaagaaggcaaaggcttgtaaatttacccaatgcagtttggctttttaaattattttgtgcctatttatgaataaatattacaaattctaaaagataagtgtgtttgcaaaaaaaaagaaaataaatacataaaaaagggacaagcatgttgattctaggttgaaaatgttataggcacttgctacttcagtaatgtctatattatataaatagtatttcagacactatgtagtctgttagattttataaagattggtagttatctgagcttaaacattttctcaattgtaaaataggtgggcacaagtattacacatcagaaaatcctgacaaaagggacacatagtgtttgtaacaccgtccaacattccttgtttgtaagtgttgtatgtaccgttgatgttgataaaaagaaagtttatatcttgattattttgttgtctaaagctaaacaaaacttgcatgcagcagcttttgactgtttccagagtgcttataatatacataactccctggaaataactgagcactttgaattttttttatgtctaaaattgtcagttaatttattattttgtttgagtaagaattttaatattgccatattctgtagtatttttctttgtatatttctagtatggcacatgatatgagtcactgcctttttttctatggtgtatgacagttagagatgctgattttttttctgataaattctttctttgagaaagacaattttaatgtttacaacaataaaccatgtaaatgaaaaaaaaaa

SEQ ID NO: 57610 - DNA, 3393 bp, Homo sapiens
ggccagtccgcccggcggctcgcgcacggctccgcggtcccttttgcctgtccagccggccgcctgtccctgctccctccctccgtgaggtgtccgggttcccttcgcccagctctcccacccctacccgaccccggcgcccgggctcccagagggaactgcacttcggcagagttgaatgaatgaagagagacgcggagaactcctaaggaggagattggacaggctggactccccattgcttttctaaaaatcttggaaactttgtccttcattgaattacgacactgtccacctttaatttcctcgaaaacgcctgtaactcggctgaagccatgccttgtgttcaggcgcagtatgggtcctcgcctcaaggagccagccccgcttctcagagctacagttaccactcttcgggagaatacagctccgatttcttaactccagagtttgtcaagtttagcatggacctcaccaacactgaaatcactgccaccacttctctccccagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctccaacgaggggctgtgcgctgtgtgtggggacaacgcggcctgccaacactacggcgtgcgcacctgtgagggctgcaaaggcttctttaagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaagtggttcgcacagacagtttaaaaggccggagaggtcgtttgccctcgaaaccgaagagcccacaggagccctctcccccttcgcccccggtgagtctgatcagtgccctcgtcagggcccatgtcgactccaacccggctatgaccagcctggactattccaggttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacaggttgcaatgcgttcgtggctttggggaatggattgattccattgttgaattctcctccaacttgcagaatatgaacatcgacatttctgccttctcctgcattgctgccctggctatggtcacagagagacacgggctcaaggaacccaagagagtggaagaactgcaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaagacctcctcccaagcacttcaaaggaactggaatgataatggaaactgtcaagagggggcaagtcacatgggcagagatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataatgtataatgggaaatgtttggccatgcttggttgttgcagttcagacaaatgtaacacacacacacatacacacacacacacacacacagagacacatcttaaggggacccacaagtattgccctttaacaagacttcaaagttttctgctgtaaagaaagctgtaatatatagtaaaactaaatgttgcgtgggtggcatgagttgaagaaggcaaaggcttgtaaatttacccaatgcagtttggctttttaaattattttgtgcctatttatgaataaatattacaaattctaaaagataagtgtgtttgcaaaaaaaaagaaaataaatacataaaaaagggacaagcatgttgattctaggttgaaaatgttataggcacttgctacttcagtaatgtctatattatataaatagtatttcagacactatgtagtctgttagattttataaagattggtagttatctgagcttaaacattttctcaattgtaaaataggtgggcacaagtattacacatcagaaaatcctgacaaaagggacacatagtgtttgtaacaccgtccaacattccttgtttgtaagtgttgtatgtaccgttgatgttgataaaaagaaagtttatatcttgattattttgttgtctaaagctaaacaaaacttgcatgcagcagcttttgactgtttccagagtgcttataatatacataactccctggaaataactgagcactttgaattttttttatgtctaaaattgtcagttaatttattattttgtttgagtaagaattttaatattgccatattctgtagtatttttctttgtatatttctagtatggcacatgatatgagtcactgcctttttttctatggtgtatgacagttagagatgctgattttttttctgataaattctttctttgagaaagacaattttaatgtttacaacaataaaccatgtaaatgaaaaaaaaaa

SEQ ID NO: 57611 - DNA, 3326 bp, Homo sapiens
ggccagtccgcccggcggctcgcgcacggctccgcggtcccttttgcctgtccagccggccgcctgtccctgctccctccctccgtgaggtgtccgggttcccttcgcccagctctcccacccctacccgaccccggcgcccgggctcccagagggaactgcacttcggcagagttgaatgaatgaagagagacgcggagaactcctaaggaggagattggacaggctggactccccattgcttttctaaaaatcttggaaactttgtccttcattgaattacgacactgtccacctttaatttcctcgaaaacgcctgtaactcggctgaagccatgccttgtgttcaggcgcagtatgggtcctcgcctcaaggagccagccccgcttctcagagctacagttaccactcttcgggagaatacagctccgatttcttaactccagagtttgtcaagtttagcatggacctcaccaacactgaaatcactgccaccacttctctccccagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctccaacgaggggctgtgcgctgtgtgtggggacaacgcggcctgccaacactacggcgtgcgcacctgtgagggctgcaaaggcttctttaagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaagtggttcgcacagacagtttaaaaggccggagaggtcgtttgccctcgaaaccgaagagcccacaggagccctctcccccttcgcccccggtgagtctgatcagtgccctcgtcagggcccatgtcgactccaacccggctatgaccagcctggactattccaggttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacagaatatgaacatcgacatttctgccttctcctgcattgctgccctggctatggtcacagagagacacgggctcaaggaacccaagagagtggaagaactgcaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaagacctcctcccaagcacttcaaaggaactggaatgataatggaaactgtcaagagggggcaagtcacatgggcagagatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataatgtataatgggaaatgtttggccatgcttggttgttgcagttcagacaaatgtaacacacacacacatacacacacacacacacacacagagacacatcttaaggggacccacaagtattgccctttaacaagacttcaaagttttctgctgtaaagaaagctgtaatatatagtaaaactaaatgttgcgtgggtggcatgagttgaagaaggcaaaggcttgtaaatttacccaatgcagtttggctttttaaattattttgtgcctatttatgaataaatattacaaattctaaaagataagtgtgtttgcaaaaaaaaagaaaataaatacataaaaaagggacaagcatgttgattctaggttgaaaatgttataggcacttgctacttcagtaatgtctatattatataaatagtatttcagacactatgtagtctgttagattttataaagattggtagttatctgagcttaaacattttctcaattgtaaaataggtgggcacaagtattacacatcagaaaatcctgacaaaagggacacatagtgtttgtaacaccgtccaacattccttgtttgtaagtgttgtatgtaccgttgatgttgataaaaagaaagtttatatcttgattattttgttgtctaaagctaaacaaaacttgcatgcagcagcttttgactgtttccagagtgcttataatatacataactccctggaaataactgagcactttgaattttttttatgtctaaaattgtcagttaatttattattttgtttgagtaagaattttaatattgccatattctgtagtatttttctttgtatatttctagtatggcacatgatatgagtcactgcctttttttctatggtgtatgacagttagagatgctgattttttttctgataaattctttctttgagaaagacaattttaatgtttacaacaataaaccatgtaaatgaaaaaaaaaa

SEQ ID NO: 57612 - DNA, 3269 bp, Homo sapiens
ggccagtccgcccggcggctcgcgcacggctccgcggtcccttttgcctgtccagccggccgcctgtccctgctccctccctccgtgaggtgtccgggttcccttcgcccagctctcccacccctacccgaccccggcgcccgggctcccagagggaactgcacttcggcagagttgaatgaatgaagacagacgcggagaactcctaaggaggagattggacaggctggactccccattgcttttctaaaaatcttggaaactttgtccttcattgaattacgacactgtccacctttaatttcctcgaaaacgcctgtaactcggctgaagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctccaacgaggggctgtgcgctgtgtgtggggacaacgcggcctgccaacactacggcgtgcgcacctgtgagggctgcaaaggcttctttaagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaagtggttcgcacagacagtttaaaaggccggagaggtcgtttgccctcgaaaccgaagagcccacaggagccctctcccccttcgcccccggtgagtctgatcagtgccctcgtcagggcccatgtcgactccaacccggctatgaccagcctggactattccaggttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacaggtccaacccagtggagggtaaactcatcttttgcaatggggtggtcttgcacaggttgcaatgcgttcgtggctttggggaatggattgattccattgttgaattctcctccaacttgcagaatatgaacatcgacatttctgccttctcctgcattgctgccctggctatggtcacagagagacacgggctcaaggaacccaagagagtggaagaactgcaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaagacctcctcccaagcacttcaaaggaactggaatgataatggaaactgtcaagagggggcaagtcacatgggcagagatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataatgtataatgggaaatgtttggccatgcttggttgttgcagttcagacaaatgtaacacacacacacatacacacacacacacacacacagagacacatcttaaggggacccacaagtattgccctttaacaagacttcaaagttttctgctgtaaagaaagctgtaatatatagtaaaactaaatgttgcgtgggtggcatgagttgaagaaggcaaaggcttgtaaatttacccaatgcagtttggctttttaaattattttgtgcctatttatgaataaatattacaaattctaaaagataagtgtgtttgcaaaaaaaaagaaaataaatacataaaaaagggacaagcatgttgattctaggttgaaaatgttataggcacttgctacttcagtaatgtctatattatataaatagtatttcagacactatgtagtctgttagattttataaagattggtagttatctgagcttaaacattttctcaattgtaaaataggtgggcacaagtattacacatcagaaaatcctgacaaaagggacacatagtgtttgtaacaccgtccaacattccttgtttgtaagtgttgtatgtaccgttgatgttgataaaaagaaagtttatatcttgattattttgttgtctaaagctaaacaaaacttgcatgcagcagcttttgactgtttccagagtgcttataatatacataactccctggaaataactgagcactttgaattttttttatgtctaaaattgtcagttaatttattattttgtttgagtaagaattttaatattgccatattctgtagtatttttctttgtatatttctagtatggcacatgatatgagtcactgcctttttttctatggtgtatgacagttagagatgctgattttttttctgataaattctttctttgagaaagacaattttaatgtttacaacaataaaccatgtaaatgaaaaaaaaaa

SEQ ID NO: 57613 - DNA, 4530 bp, Homo sapiens
ctcctttccgtggtgtgtagccggcttggcgtgaccctcgcctgatccagttgttagagttggaagcttggcagttggcctcccttcttcccatggaggacgggggcttaacagcctttgaagaggaccagagatgcctttcccagagcctccccttgccagtgtcagcagagggcccagctgcacagaccactgctgagcccagcaggtcgttttcctcagcccacagacacctgagcagaaggaatgggctttccagactctgccagagcaggacagcgctctctgaagacagatggagctcctattgtctatcatcactggctgcccagaatatttgtacaagtaaactgcactgccctgctgcccctgagcacacggacccgtccgaaccgcggggcagtgtgtcctgctgctccctgctgcggggactgtcctcagggtggtcctcacctctgcttccggcccctgtgtgcaaccctaacaaggccatcttcacggtggatgccaagaccacagagatcctggttgctaacgacaaagcttgcgggctcctggggtacagcagccaggacctgattggccagaagctcacgcagttctttctgaggtcagattctgatgtggtggaggccctcagcgaggagcacatggaggccgacggccacgctgcggtggtgtttggcacggtggtggacatcatcagccgtagtggggagaagattccagtgtctgtgtggatgaagaggatgcggcaggagcgccgcctatgctgcgtggtggtcctggagcccgtggagagggtctcgacctgggtcgctttccagagcgatggcaccgtcacgtcatgtgacagtctctttgctcatcttcacgggtacgtgtctggggaggacgtggctgggcagcatatcacagacctgatcccttctgtgcagctccctccttctggccagcacatcccaaagaatctcaagattcagaggtctgttggaagagccagggacggtaccaccttccctctgagcttaaagctgaaatcccaacccagcagcgaggaggcgaccaccggtgaggcggcccctgtgagcggctaccgggcatctgtctgggtgttctgcaccatcagtggcctcatcaccctcctgccggatgggaccatccacggcatcaaccacagcttcgcgctgacactgtttggttacggaaagacggagctcctgggcaagaatatcactttcctgattcctggtttctacagctacatggaccttgcgtacaacagctcattacagctcccagacctggccagctgcctggacgtcggcaatgagagtgggtgtggggagagaaccttggacccgtggcagggccaggacccagctgaggggggccaggatccaaggattaatgtcgtgcttgctggtggccacgttgtgccccgagatgagatccggaagctgatggaaagccaagacatcttcaccgggactcagactgagctgattgctggaggccagctcctttcctgcctctcacctcagcctgctccaggggtggacaatgtcccagaaggaagcctgccagtgcacggtgaacaggcgctgcccaaggaccagcaaatcactgccttggggagagaggaacctgtggcaatagagagccccggacaggatcttctgggagaaagcaggtctgaaccagtggatgtgaagccatttgcttcctgcgaagattctgaagctccagtcccagctgaggatgggggcagtgatgctggcatgtgtggcctgtgtcagaaggcccagctagagcggatgggagtcagtggtcccagcggttcagacctttgggctggggctgccgtggccaagccccaggccaagggtcagctggcggggggcagcctcctgatgcactgcccttgctatgggagtgaatggggcttgtggtggcgaagccaggacttggcccccagcccctctgggatggcaggcctctcgtttgggacacctactctagatgagccgtggctgggagtggaaaacgaccgagaagagctgcagacctgcttgattaaggagcagctgtcccagttgagccttgcaggagccctggatgtcccccacgccgaactcgttccgacagagtgccaggctgtcaccgctcctgtgtcgtcctgcgatctgggaggcagagacctgtgcggtggctgcacgggcagctcctcagcctgctatgccttggccacggacctccctgggggcctggaagcagtggaggcccaggaggttgatgtgaattcgttttcctggaacctcaaggaactctttttcagtgaccagacagaccaaacgtcatcaaattgttcctgtgctacgtctgaactcagagagacaccctcttccttggcagtgggctccgatccagatgtaggcagtctccaggaacaggggtcgtgtgtcctggatgacagggagctgttactactgaccggcacctgtgttgaccttggccaaggccgacggttccgggagagctgtgtgggacatgatccaacagaaccgcttgaggtttgtttggtgtcctctgagcattatgcagcaagcgacagagaaagcccaggacacgttccttccacgttggatgctggccctgaggacacgtgcccatcagcagaggagccaaggctgaacgtccaggtcacctccacgcccgtgatcgtgatgcgcggggctgctggcctgcagcgggagatccaggagggtgcctactccgggagctgctaccatcgagatggcttacggctgagtatacagtttgaggtgaggcgggtggagctccagggccccacacctctgttctgctgctggctggtgaaagacctcctccacagccaacgcgactcagccgccaggacccgcctgttccttgccagcctgcccggctccacccactctaccgctgctgagctcaccggacccagcctggtggaagtgctcagagccagaccctggtttgaggagccccccaaggctgtggaactggaggggttggcggcctgtgagggcgagtactcccaaaagtacagtaccatgagcccgctgggcagtggggccttcggcttcgtgtggactgctgtggacaaggaaaaaaacaaggaggtggtggtgaagtttattaagaaggagaaggtcttggaggattgttggattgaggatcccaaacttgggaaagttactttagagatcgcaattctatccagggtggagcacgccaatatcatcaaggtattggatatatttgaaaaccaagggttcttccagcttgtgatggagaagcacggctccggcctagacctcttcgctttcatcgaccgccaccccaggctggatgagcccctggcgagctacatcttccgacaactagtgtcagcagtgggatacctgcgcttgaaggacatcatccaccgtgacatcaaggatgagaacatcgtgatcgccgaggacttcacaatcaagctgatagactttggctcggccgcctacttggaaaggggaaaattattttatactttttgtgggaccatcgagtactgtgcaccggaagttctcatggggaatccctacagagggccggagctggagatgtggtctctgggagtcactctgtacacgctggtctttgaggagaaccccttctgtgagctggaggagaccgtggaggctgccatacacccgccatacctggtgtccaaagaactcatgagccttgtgtctgggctgctgcagccagtccctgagagacgcaccaccttggagaagctggtgacagacccgtgggtaacacagcctgtgaatcttgctgactatacatgggaagaggtgtttcgagtaaacaagccagaaagtggagttctgtccgctgcgagcctggagatggggaacaggagcctgagtgatgtggcccaggctcaggagctttgtgggggccccgttccaggcgaggctcctaatggccaaggctgtttgcatcccggggatccccgtctgctgaccagctaaacaccaatttcttcctgcttttctccacttggtttggaaaatcacacagttttcaggctccatctgtttggagaaaatacattctgaagcatccccaattcaccttctaaaaactcatgtgcaggtttgataaacaccagaacagaagacagtgatgctgtattattttagatttattacatagatttggaattcacttttttcatgacctagaaaaaaacattccagtgttcaactgttttatattattaaagggcttttaatttgtgaacttctgaaggcatgagtgttttctctttctacttttgtatatgtgcatgttttgtttcctctgacttggtatatgctcatctgagtgacggatatgtgaaatttgtagaactggttagtcaaatggccagactatttcattaatttatttcctcaaatgcttttcaaattaaagcacctttgttagtaaacagtt

SEQ ID NO: 57614 - DNA, 3650 bp, Homo sapiens
agcactgctgctctcccggcttcccgctctactccggccgggccgggtccgccacgtctggcgcgctgagcaggcccggccgcgcagcgcctaccctttcctcgctccgggccggcagtgtggggcggcgcgctgggggcgcggcgtgtctggggacatcttgtgatgttggcgagaacaggacatgatctcacatggcgagaagctctttagttccttaatcatttcacggtgccttcggacgctttttttccacctaaaacgtttagtttcagctcagtgatcagctaccccagctcggcgggggagcggaaggcttgaattattccgacctgtgagcggcccctggcaccaaaaaaaaaaaaaaaaaaaaaaaaaaaagaaaaaaaaaggcacaaaaaagtggaaacttttccctgtccattccatcaagtcctgaaaaatcaaaatggatttagagaaaaattatccgactcctcggaccagcaggacaggacatggaggagtgaatcagcttgggggggtttttgtgaatggacggccactcccggatgtagtccgccagaggatagtggaacttgctcatcaaggtgtcaggccctgcgacatctccaggcagcttcgggtcagccatggttgtgtcagcaaaattcttggcaggtattatgagacaggaagcatcaagcctggggtaattggaggatccaaaccaaaggtcgccacacccaaagtggtggaaaaaatcgctgaatataaacgccaaaatcccaccatgtttgcctgggagatcagggaccggctgctggcagagcgggtgtgtgacaatgacaccgtgcctagcgtcagttccatcaacaggatcatccggacaaaagtacagcagccacccaaccaaccagtcccagcttccagtcacagcatagtgtccactggctccgtgacgcaggtgtcctcggtgagcacggattcggccggctcgtcgtactccatcagcggcatcctgggcatcacgtcccccagcgccgacaccaacaagcgcaagagagacgaaggtattcaggagtctccggtgccgaacggccactcgcttccgggcagagacttcctccggaagcagatgcggggagacttgttcacacagcagcagctggaggtgctggaccgcgtgtttgagaggcagcactactcagacatcttcaccaccacagagcccatcaagcccgagcagaccacagagtattcagccatggcctcgctggctggtgggctggacgacatgaaggccaatctggccagccccacccctgctgacatcgggagcagtgtgccaggcccgcagtcctaccccattgtgacaggccgtgacttggcgagcacgaccctccccgggtaccctccacacgtcccccccgctggacagggcagctactcagcaccgacgctgacagggatggtgcctgggagtgagttttccgggagtccctacagccaccctcagtattcctcgtacaacgactcctggaggttccccaacccggggctgcttggctccccctactattatagcgctgccgcccgaggagccgccccacctgcagccgccactgcctatgaccgtcactgacccttggagccaggcgggcaccaaacactgatggcacctattgagggtgacagccacccagccctcctgaagatagccagagagcccatgagaccgtcccccagcatcccccacttgcctgaagctcccctcttcctctcttcctccagggactctggggccctttggtggggccgttggacttctggatgcttgtctatttctaaaagccaatctatgagcttctcccgatggccactgggtctctgcaaaccaatagactgtcctgcaaataaccgcagccccagcccagcctgcctgtcctccagctgtctgactatccatccatcataaccaccccagcctgggaaggagagcttgcttttgttgcttcagcagcacccatgtaaataccttcttgcttttctgtgggcctgaaggtccgactgagaagactgctccacccatgatgcatctcgcactcttggtgcatcaccggacatcttagacctatggcagagcatcctctctgccctgggtgaccctggcaggtgcgctcagagctgtcctcaagatggaggatgctgcccttgggccccagcctcctgctcatccctccttctttagtatctttacgaggagtctcactgggctggttgtgctgcaggctccccctgaggcccctctccaagaggagcacactttggggagatgtcctggtttcctgcctccatttctctgggaccgatgcagtatcagcagctcttttccagatcaaagaactcaaagaaaactgtctgggagattcctcagctacttttccgaagcagaatgtcatccgaggtattgattacattgtggactttgaatgtgagggctggatgggacgcaggagatcatctgatcccagccaaggaggggcctgaggctctccctactccctcagcccctggaacggtgttttctgaggcatgcccaggttcaggtcacttcggacacctgccatggacacttcacccaccctccaggaccccagcaagtggattctgggcaagcctgttccggtgatgtagacaataattaacacagaggactttcccccacacccagatcacaaacagcctacagccagaacttctgagcatcctctcggggcagaccctccccgtcctcgtggagcttagcaggcagctgggcatggaggtgctggggctggggcagatgcctaatttcgcacaatgcatgcccacctgttgatctaaggggccgcgatggtcagggccacggccaagggccacgggaacttggagagggagcttggagaactcactgtgggctagggtggtcagaggaagccagcagggaagatctgggggacagaggaaggcctcctgagggaggggcaggagagcagtgaggagctgctgtgtgacctgggagtgattttgacatgggggtgccaggtgccatcatctctttacctggggccttaattccttgcatagtctctcttgtcaagtcagaacagccaggtagagcccttgtccaaacctgggctgaatgacagtgatgagagggggcttggccttcttaggtgacaatgtcccccatatctgtatgtcaccaggatggcagagagccagggcagagagagactggacttgggatcagcaggccaggcaggtcttgtcctggtcctggccacatgtctttgctgtgggacctcagacaaaaccctgcacctctttgagccttggctgccttggtgcagcagggtcatctgtagggccaccccacagctctttccttcccctcctctctccagggagccggggctgtgagaggatcatctggggcaggccctccacttccaagcaagcagatgggggtgggcacctgaggcccaataatatttggaccaagtgggaaacaagaacactcggaggggcgggaatcagaagagcctggaaaaagacctagcccaacttcccttgtgggaaactgaggcccagcttggggaaggccaggaccatgcagggagaaaaag

SEQ ID NO: 57615 - DNA, 4582 bp, Homo sapiens
ccagggtgaaagttcagcgcgccggcggcacttccaacatggcggcggccggggcggcggtagcgcgcagcccgggaatcggagcgggacctgcgctgagagcccggcgctcgcccccgccgcgggccgcacggctgccgcggctgctagtgctgctagcggcggcggcggtggggccgggcgcgggcggtgcggcgcggctgtaccgcgcgggcgaggacgccgtgtgggtgctggacagcggcagcgtgcgcggggccaccgccaacagctcggccgcgtggctcgtgcagttctactcgtcgtggtgtggccactgcatcgcgtacgcgcccacttggcgggccctggctggggatgtgcgagactgggccagtgccattcgcgtcgcagctctggactgcatggaagagaagaaccaggccgtgtgccatgactacgacatccacttctaccccaccttccggtattttaaagcatttacaaaggagtttacaactggagaaaattttaaaggacctgaccgagagctgcgaacagtcagacagacgatgattgacttcctgcagaaccacacggaaggaagccggccccctgcctgcccgcgcctagaccccattcagcccagtgatgttctttcccttcttgacaaccgtggcagccattacgtggctattgtctttgaaagcaacagctcctaccttggacgggaggtgatcttagacctgatcccgtatgaaagcatcgtggtgacccgagcactggacggggacaaagcatttctggagaaacttggtgtttcttcagtcccttcgtgttacctgatctacccaaatgggtcgcatggattgattaacgtcgtgaagcctctgcgggccttcttttcgtcttatttgaagtcattgccggatgtgaggaaaaaatcgcttcccttgcctgaaaagccacacaaagaagaaaattcagaaatcgtggtttggagagaatttgacaagtcgaagctgtacacggtggacctggagtcagggctacactacctcctgcgggtggagctggcagcccacaagtccctggccggagcagagctgaagacgctcaaggactttgtgactgtcttggccaagctgttccctggacggccgccagtcaagaagctgttggagatgctgcaggagtggctggccagccttcccctggacaggatcccctacaacgccgtgcttgacctggtcaacaacaagatgcggatttctggaatattccttactaatcacataaagtgggttggatgtcaaggaagccgatctgagttgaggggttacccgtgttctctctggaaactgttccacactttgactgttgaagcctcgacccacccagatgcactggttggcacaggctttgaagacgacccccaggctgtgctgcagacaatgaggaggtacgttcacaccttctttgggtgtaaggaatgtggtgagcactttgaggaaatggctaaagaatccatggactcggtgaaaaccccagaccaagccatcctctggctgtggaagaagcataatatggtgaacggccgcctggcaggccatctgagtgaggatccccggtttccaaagcttcagtggcccactccggacctctgcccagcctgccatgaggaaattaagggcctggccagctgggatgaaggccacgtgctcacattcttgaagcagcactatggccgcgacaacctcttagacacgtattccgcagaccagggggattccagtgaaggaggaaccctggccaggggtgaggaagaggagaaaagactcactcccccagaggtgtcccatggagaccgagacacccagagcgtccgtccacctggtgcactgggccccaggcctgcccttccagagagcttgcatcacagcttggacgggaaactccagagtctggatgggcccggggcccacaaggaggtgggcggggccgcacccttcctcggggttgacttctccagcctggacatgagtctctgtgtcgtgctgtacgtggcttcatccctgttcctcatggtgatgtacttcttcttccgggtgaggtccaggcggtggaaggtcaagcaccaccacccggccgtgtgagtgcccgggtgctgccagccacggcggaagctcccttggaggcagccctgccccgtgccacctgcagctttaatatttatgatcagggattttataaacatgcgggcctggtttcacatcggatggcaccttttggcttcaaagtcctggttttacaaacgctcttctaacaagggaagaacacggggtaattttgtggggatatttgcattcctggcgtactcaagtctgttcatgctccttttgcaggtcttacagcaaaaagacttctgtatttttactcttctagatgtgaaaagagggtgcagagtccaggccagatagtcttccccacacactttcatctcgtttcctccactccgccccatcctgcagggccttgtttttgtatttggagaacctcgcccatcccccccgcggctcctggctcccccccccccaccttggccctccctgcaccctccactcccctcgctccccctccccccgctccccccacgccccctgctccaggctgccaagtgttttcctttagccgggcggggacagacagagccggaagcgcagtcggcctctgcagcccctccaagcaagtgctccagggactatcctgtgtttgtagctgcttccctagggcaggttcctgagggctctccttgttcctccgggtgttcgacaccagacgtggggatttcaacaggggaggagccaaggaattctgtggctgtgctgcgtttcagaaaataacccccagaggccttgggctgtggacctgggggttggaaggatgggggctcatttaaccctcagaggcagcgcctttgtctgtctatctggtgacaagagagagacaagtaaatgggggccgttgggacggcgggtgcctggagggcagctctgggctcagcgggcagtgcttagagcacaggcccctctgttgggggatggggaggagagcagtctgcccttgggagcgtaggccccagggagacttctaaagccccccctgtcgtctgctcttcacccagcaccacagaggcacctgctgcacacacaagcatctcactcggcccacggagggggccaggcttcctttgcctgaagctgttttgggaagggtctccacacaggcactgatctcccaagcttttgtcatgatgtcttttaccatttgataattttaaacattgtttttaaacccaaaacatttagtggtccgttgcctctgaagatgtaaacaaacaaatacactatttctgggaacatttatattgagattctttgtggctattggtgtgtctcacaggcaaaatttgatttggctaaaataggctcagatgtatttgtgtgcccgtgtgtgtgtgtgtgtgtgtgtgtgtgtgtgtgtgtgtatgagagagagagagactttgacggttgtagatattttttccgctttgcctactttatgttgtataatcatgtgtttactaacaagttgatgacatggatgtattcataagaccatgtaatattgatgtgattgttgtcgcttgagaaaaaaaggcaacagctgattctttcaacaactgtcacagaatggctgggctgagaacgctgcccagggccctgcagctggcgggagaggtgtctggtgggagcggtgtctggtgcgtcagcctgctgcttcgtgtctcactcgagagttgcttctggtttcacactttttaacccctctgtgctttagcagccgtgaccttgccttcattgcttcatccagtgcaggcctgggttattgaagacaccaaagtgtttctcttccagtttgaaaaccaggcaggtttacacgtgggtttcagtgtatttgcctttgaacccttcaaactaaactttagccttttggctggtgttgaatgtctttagctggggtgacctggagtgacctgggacggtgttgtggtttaccgtctccagcttcagcctttccagaaacccttgtggagggcagtgttggctgcaggtttcatcatattgcagtttgaggtcaccactatttggggaacaagcttgcgtcctgctgaggggcaggattttcagcagagcgtcggtggggctgggccgtcgtggaggtggccccaggagtcatatggccatactcagacacaccttgtgtggcctgctcagagctggatgccacctttaggcaatgtttagagtctattttctaaagttttaagtattttaagaggtattgagactaatgaatataatagttcagtaatttaaatgcttatttattttcagtggaaggatttttattaaaaagaagctaattgacatggaaatgtcagtgaaatttcttacctgcaaggaaagtgaacattttgtatttaagtaaactataatgtgcacattttaataaagaaatctgacatttgaaaaaaaaaaaaaaaaaaaaaaaaaaaaaa

SEQ ID NO: 57616 - DNA, 1916 bp, Homo sapiens
acttctgacagtggggaaagcagctgtgtgtgatagcttggaaggtttactgctgcctcaagtcctcttctctgcagttgaggtttcaggtttcaatcctcccaataccacaagacagagcacggggcggctgccgcctccgcctccgcgccttaacctaggcggcttgccgaagatctcagccccgcggccgcgcgctcgccctgccctagaccagggttgggcgcagcggcggaggtggcttctgggctgcgcgagctgggagagctgggaggcggcgatcgcagctgggccgggacttccttcctccaccgcacggcaacaaaacaaccctgcggcaggcactgagtgcttcgcagctgtctgggcgagaggcacagcgatgggctccgtgctgagcaccgacagcggcaaatcggcgcccgcctctgccaccgcgcgggccctggagcgcaggagggacccggagttgcccgtcacgtccttcgactgcgccgtgtgccttgaggtgttacaccagcctgtccggacccgctgtggccacgtattctgccgttcctgtattgctaccagtctaaagaacaacaagtggacctgtccttattgccgggcatatcttccttcagaaggagttccagcaactgatgtagccaaaagaatgaaatcagagtataagaactgcgctgagtgtgacaccctggtttgcctcagtgaaatgagggcacatattcggacttgtcagaagtacatagataagtatggaccactacaagaacttgaggagacagcagcaaggtgtgtatgtcccttttgtcagagggaactgtatgaagacagcttgctggatcattgtattactcatcacagatcggaacggaggcctgtgttctgtccactttgccgtttaatacccgatgagaatccaagcagcttcagtggcagtttaataagacatctgcaagttagtcacactttgttttatgatgatttcatagattttaatataattgaggaagctcttatccgaagagtcttagaccggtcacttcttgaatatgtgaatcactcgaacaccacataattttattaaaacgaagggaaaagggaccactgaattgcaccatttaagatgctgcttgaacaaatgggagggaagttgtcaatgattgatgggcaaaaatgtacaacacagttatgtgtttgtccatgtttattgttatagtgcatttaaaaactgctttaattttaatggtttaaatctgttttacatccttgagattcttacacatctaacaacaaaaaaaattatctacatcagtcattgttacatggaaaagacaggtggtaggcaagtaggtggaggatctcggtttgcaaattagataatactctgtgtataatgctacatatcaataactaccatcatggttaggcacgataactaatctttgttctgtgtaaaaaaatatggagagtgaaacaaagtgcagacattcaaagaaataagaaatctgctccaatgctcttgttctaatctctaataggttaacgttaataatcttgtatgggagttggaaaggaaaattttggaagtcaagaaagtccatttaggccggacgcggtggcttacgcttgtaatcccagcactttgggaggctgaagcaggcggatcacaaggtcaggagttcgagaccagcctggccaacactggtctctgtgaaactccgtctctactaaaaatacaaaaattagctggacgtgttggcgggcatctgtaataccagctacttgggaggctgaggcagaagaatcacttgaacccgggaggcagaggttacagtgagctgagatcgcaccagtacactccagcctgggtaacagagctagactccatctcaaaaaaaaaaaaaaaaaaa

SEQ ID NO: 57617 - DNA, 2641 bp, Homo sapiens
ggcggcccactctgctctgtcagcttcggagctcctccaccctggctgccgaaagccccttcccgccatctaatgatacactctgcatacgcttctgttgagaatttgtggctagacattcctgtgggaccgggaatccaaattcttggtagctagaggaaaaaaaaataaaacaacagccaaccaagtgaatcccaacccaaccccctgaagggctgaaaattctcgccttcttcagagcggggcatggcatcgaacagcatcttcgactccttcccgacctactcgccgaccttcatccgcgacccaagcaccagccgccgcttcacacctccctccccggccttcccctgcggcggcggcggcggcaagatgggcgagaacagcggcgcgctgagcgcgcaggcggccgtggggcccggagggcgcgcccggcccgaggtgcgctcgatggtggacgtgctggcggaccacgcaggcgagctcgtgcgcaccgacagccccaacttcctctgctccgtgctgccctcgcactggcgctgcaacaagacgctgcccgtcgccttcaaggtggtggcattgggggacgtgccggatggtacggtggtgactgtgatggcaggcaatgacgagaactactccgctgagctgcgcaatgcctcggccgtcatgaagaaccaggtggccaggttcaacgaccttcgcttcgtgggccgcagtgggcgagggaagagtttcaccctgaccatcactgtgttcaccaaccccacccaagtggcgacctaccaccgagccatcaaggtgaccgtggacggaccccgggagcccagacggcaccggcagaagctggaggaccagaccaagccgttccctgaccgctttggggacctggaacggctgcgcatgcgggtgacaccgagcacacccagcccccgaggctcactcagcaccacaagccacttcagcagccagccccagaccccaatccaaggcacctcggaactgaacccattctccgacccccgccagtttgaccgctccttccccacgctgccaaccctcacggagagccgcttcccagaccccaggatgcattatcccggggccatgtcagctgccttcccctacagcgccacgccctcgggcacgagcatcagcagcctcagcgtggcgggcatgccggccaccagccgcttccaccatacctacctcccgccaccctacccgggggccccgcagaaccagagcgggcccttccaggccaacccgtccccctaccacctctactacgggacatcctctggctcctaccagttctccatggtggccggcagcagcagtgggggcgaccgctcacctacccgcatgctggcctcttgcaccagcagcgctgcctctgtcgccgccggcaacctcatgaaccccagcctgggcggccagagtgatggcgtggaggccgacggcagccacagcaactcacccacggccctgagcacgccaggccgcatggatgaggccgtgtggcggccctactgaccgccctggtggactcctcccgctggaggcggggaccctaacaaccttcaagaccagtgatgggccggctccgaggctccgggcgggaatgggacctgcgctccagggtggtctcggtcccagggtggtcccagctggtgggagcctctggctgcatctgtgcagccacatccttgtacagaggcataggttaccacccccaccccggcccgggatactgcccccggcccagatcctggccgtctcatcccatacttctgtggggaatcagcctcctgccacccccccggaaggacctcactgtctccagctatgcccagtgctgcatgggacccatgtctcctgggacagaggccatctctcttccagagagaggcagcattggcccacaggataagcctcaggccctgggaaacctcccgacccctgcaccttcgttggagcccctgcatcccctgggtccagccccctctgcatttacacagatttgagtcagaactggaaagtgtcccccacccccaccaccctcgagcggggttcccctcattgtacagatggggcaggacccagcacgctgctggcagagatggtttgagaacacatccaagccagtccccccagcccagcttcccctccgttcctaactgttggctttcccccagccgcacgggtcccaggccccagagaagatgagtctatggcatcaggttcttaaacccaggaaagcacctacagaccggctcctccatgcactttaccagctcaacgcatccactctctgttctcttggcagggcgggggaggggggataggaggtcccctttcccctaggtggtctcataattccatttgtggagagaacaggagggccagatagataggtcctagcagaaggcattgaggtgagggatcattttgggtcagacatcaatgtccctgtcccccctgggtccagccaagctgtgccccatcccccaagcctcctgggaggatccagccaaatcttgcgactcctggcacacacctgtctgtaacctgttttgtgctctgaaagcaaatagtcctgagcaaaaaaaacaaaaaaaacaaaaaaaaaaaaaaaaaa

SEQ ID NO: 57618 - DNA, 3809 bp, Homo sapiens
gccgctgttatgcgtattcccgtagacccaagcaccagccgccgcttcacacctccctccccggccttcccctgcggcggcggcggcggcaagatgggcgagaacagcggcgcgctgagcgcgcaggcggccgtggggcccggagggcgcgcccggcccgaggtgcgctcgatggtggacgtgctggcggaccacgcaggcgagctcgtgcgcaccgacagccccaacttcctctgctccgtgctgccctcgcactggcgctgcaacaagacgctgcccgtcgccttcaaggtggtggcattgggggacgtgccggatggtacggtggtgactgtgatggcaggcaatgacgagaactactccgctgagctgcgcaatgcctcggccgtcatgaagaaccaggtggccaggttcaacgaccttcgcttcgtgggccgcagtgggcgagggaagagtttcaccctgaccatcactgtgttcaccaaccccacccaagtggcgacctaccaccgagccatcaaggtgaccgtggacggaccccgggagcccagacggcaccggcagaagctggaggaccagaccaagccgttccctgaccgctttggggacctggaacggctgcgcatgcgggtgacaccgagcacacccagcccccgaggctcactcagcaccacaagccacttcagcagccagccccagaccccaatccaaggcacctcggaactgaacccattctccgacccccgccagtttgaccgctccttccccacgctgccaaccctcacggagagccgcttcccagaccccaggatgcattatcccggggccatgtcagctgccttcccctacagcgccacgccctcgggcacgagcatcagcagcctcagcgtggcgggcatgccggccaccagccgcttccaccatacctacctcccgccaccctacccgggggccccgcagaaccagagcgggcccttccaggccaacccgtccccctaccacctctactacgggacatcctctggctcctaccagttctccatggtggccggcagcagcagtgggggcgaccgctcacctacccgcatgctggcctcttgcaccagcagcgctgcctctgtcgccgccggcaacctcatgaaccccagcctgggcggccagagtgatggcgtggaggccgacggcagccacagcaactcacccacggccctgagcacgccaggccgcatggatgaggccgtgtggcggccctactgaccgccctggtggactcctcccgctggaggcggggaccctaacaaccttcaagaccagtgatgggccggctccgaggctccgggcgggaatgggacctgcgctccagggtggtctcggtcccagggtggtcccagctggtgggagcctctggctgcatctgtgcagccacatccttgtacagaggcataggttaccacccccaccccggcccgggatactgcccccggcccagatcctggccgtctcatcccatacttctgtggggaatcagcctcctgccacccccccggaaggacctcactgtctccagctatgcccagtgctgcatgggacccatgtctcctgggacagaggccatctctcttccagagagaggcagcattggcccacaggataagcctcaggccctgggaaacctcccgacccctgcaccttcgttggagcccctgcatcccctgggtccagccccctctgcatttacacagatttgagtcagaactggaaagtgtcccccacccccaccaccctcgagcggggttcccctcattgtacagatggggcaggacccagcacgctgctggcagagatggtttgagaacacatccaagccagtccccccagcccagcttcccctccgttcctaactgttggctttcccccagccgcacggtcccaggcccagagaagatgagtctatggcatcaggttcttaaaccaggaaagcacctacagaccggctcctccatgcactttaccagctcaacgcatccactctctgttctcttggcagggcgggggaggggggataggaggtcccctttcccctaggtggtctcataattccatttgtggagagaacaggagggccagatagataggtcctagcagaaggcattgaggtgagggatcattttgggtcagacatcaatgtccctgtcccccctgggtccagccaagctgtgccccatcccccaagcctcctgggaggatccagccaaatcttgcgactcctggcacacacctgtctgtaacctgttttgtgctctgaaagcaaatagtcctgagcaaaaaaaaaaaaaaaaaacaaaaaaacaaaaaaaaaacaaaacagtttttaaaactgattttagaaaaagaagcttaatctaacgttttcaaacacaaggtctcttacaggtatagttccgtgattatgatagctctgtgattataagcaacatccccgccccctctcccccccgcggacccccagctgcctcctgagggtgtggggttattagggtctcaatactttctcaaggggctacactccccatcaggcagcatcccaccagcctgcaccacaggctcccctgggaggacgagggaaacgctgatgagacgctgggcatctctcctctgtggctctaggacatctgtccaggaggctgggcggaggtgggcaggatgtgagaggtggggagtactggctgtgcgtggcaggacagaagcactgtaaagggctctccagcgcagctcagctgcactgcgttccgaggtgaagtcttgcccctgaattttgcaaaatgggaaagtgggcgcttgccaagggccaggctgcatggattctcacatcagagttctctggccctagaaaggcttagaaaaggcgtaagggaactcataaaggctagcagcatgcggtattttaactttctgcctcggcctctgtggatgcagaaatctgccctacaaaatgctcttcattggttgtctctgtgagagcactgtccccacccaacctgtcacaacggccagaaccatacaccagagacacactggcaggttaggcagtccttctggtgatcctattccattccctcctgctgcggtttctcttggcctgtcctcactggaaaaacagtctccatctcctcaaaatagttgctgactccctgcacccaaggggcctctccatgccttcttaggaagcagctatgaatccattgtccttgtagtttcttccctcctgttctctggttatagctggtcccaggtcagcgtgggaggcacctttgggttcccagtgcccagcactttgtagtctcatcccagattactaacccttcctgatcctggagaggcagggatagtaaataaattgctcttcctaccccatcccccatcccctgacaaaaagtgacggcagccgtactgagtctgtaaggcccaaagtgggtacagacagcctgggctggtaaaagtaggtccttatttacaaggctgcgttaaagttgtactaggcaaacacactgatgtaggaagcacgaggaaaggaagacgttttgatatagtgttactgtgagcctgtcagtagtgggtaccaatcttttgtgacatattgtcatgctgaggtgtgacacctgctgcactcatctgatgtaaaaccatcccagagctggcgagaggatggagctgggtggaaactgctttgcactatcgtttgcttggtgtttgtttttaacgcacaacttgcttgtacagtaaactgtcttctgtactatttaactgta

SEQ ID NO: 57619 - DNA, 2499 bp, Homo sapiens
acaaccaggcggcagcggatacaaggccaggcggcggcgggcgggcggacctgcgccctgagcctttctgcgcccgcgggcaccatgagcagccgagtcggggacctgagcccccagcagcaggaagcgctggccaggttccgggagaacctccaggacctgctgcccatactgcccaatgctgatgactacttcctcctgcgctggctgcgagctcgaaactttgacctgcagaaatccgaagacatgctccgaaggcacatggagttccggaagcaacaagacctggacaacattgtcacatggcagccccctgaggtcatccagctgtatgactcgggtggtctttgtggctacgactacgaaggctgccctgtgtacttcaacatcattgggtccctcgaccccaagggtctcctgctgtcagcctccaagcaggatatgatccggaagcgcatcaaagtctgtgagctgctgttgcatgagtgtgagctgcaaactcagaagctgggcaggaagatcgagatggcgctgatggtgtttgacatggaggggctgagcctgaaacacctgtggaagccagctgtggaggtctaccagcagttttttagcatcctggaagcaaattatcctgagaccctgaagaatttaattgttattcgagccccaaaactgttccccgtggccttcaacttggtcaagtcgttcatgagtgaggagacacgcaggaagattgtgattctgggagacaactggaagcaggagctgacaaaattcatcagccccgaccagctgcctgtggagtttggggggaccatgactgaccccgatggcaaccccaagtgcctgaccaagatcaactatgggggtgaggtgcccaagagctactacctgtgcgagcaggtgaggctgcagtatgagcacacgaggtccgtgggccgcggctcctccctgcaggtggagaacgagatcctgttcccgggctgtgtgctcaggtggcagtttgcttcagatggtggggacatcggctttggggttttcctgaagaccaagatgggggagcagcagagtgctagggagatgacggaggtgctgcccagccagcgctacaatgcccacatggtgcctgaggatgggagcctcacctgcctccaggctggcgtctatgtcctgcgcttcgacaacacctacagccggatgcatgccaagaagctcagctacactgtggaggtgctgcttcccgacaaggcctctgaggagacgctgcagagtctcaaggcgatgagaccctccccaacacagtgaagaccccagccacctctacctgtgcactccaaccccttcacacccacccctctgacccctgccttcccaggcagggtggtgctggaggtggctgcagagagccacttgtcccacgtcaccatttcatctcattgtaggctcacctggcacagtggccaagcaggaaggggccaccagtgcatagcccatgctgaagattcagacaggaacctctttccctgttcccagagaatgcggctgagaatgagaacgctgaagatgatccagtccactgaggatgggtcctgcttgcagaagctgccctttcacccatcttgacaagatccagccacccaggactcacccatgcctggtgttccagcttcagggggtgtgcgtggttcctaggtcctgtggacatcacagcttcaggcctgaagagcagagaagccctgttctctgcatgtaggaggtcagcaggggtgggcaggcccagctggaggcagctgggtgagggtcctggttccagcagagcactggggcccatccaagtttgttctgccaccactggatggaaaattggaaatggactgggcgtggtggctcacgcctataatcccagcagtttgggaggctgagttgggcagatcacctgagatcaggagttcgggaccagcctgggcaacatggtgaaaccctgtctctactaaaaatacaaaaattagccgggcatggtggcgtgcacctgtaatcccagctactcaggaggctgaggcaggagaatcgcttgtacccaggaggcggaggttgtagtgagctgagatcgtgccactgcactccagcctgggcaacagagccagactccgtctctaaacaaacaaacaaacaaacaaacaaataaagaaagaacattggacatggagaggtggggcctggcatgggtaaccatcagaggaaaaagccatgctcagccttccagttgagtgggtaacgactgagtctccagggaattcccagtgacctcccctccacacctgctgtgatcctgccaacatttagctttggttctcttggcagctgcaccattcatgggtgcatatacgtagagtctgaacaggtgctctgctgctagaaacagcaaaccatctagattaaactcctaaagccagtgccacgaggcattcctgttccaactgggtgtttgagcagattggc

SEQ ID NO: 57620 - DNA, 2324 bp, Homo sapiens
ctccctttgggcaaggacctgagacccttgtgctaagtcaagaggctcaatgggctgcagaagaactagagaaggaccaagcaaagccatgatatttccatggaaatgtcagagcacccagagggacttatggaacatcttcaagttgtgggggtggacaatgctctgttgtgatttcctggcacatcatggaaccgactgctggacttaccattattctgaaaaacccatgaactggcaaagggctagaagattctgccgagacaattacacagatttagttgccatacaaaacaaggcggaaattgagtatctggagaagactctgcctttcagtcgttcttactactggataggaatccggaagataggaggaatatggacgtgggtgggaaccaacaaatctcttactgaagaagcagagaactggggagatggtgagcccaacaacaagaagaacaaggaggactgcgtggagatctatatcaagagaaacaaagatgcaggcaaatggaacgatgacgcctgccacaaactaaaggcagccctctgttacacagcttcttgccagccctggtcatgcagtggccatggagaatgtgtagaaatcatcaataattacacctgcaactgtgatgtggggtactatgggccccagtgtcagtttgtgattcagtgtgagcctttggaggccccagagctgggtaccatggactgtactcaccctttgggaaacttcagcttcagctcacagtgtgccttcagctgctctgaaggaacaaacttaactgggattgaagaaaccacctgtggaccatttggaaactggtcatctccagaaccaacctgtcaagtgattcagtgtgagcctctatcagcaccagatttggggatcatgaactgtagccatcccctggccagcttcagctttacctctgcatgtaccttcatctgctcagaaggaactgagttaattgggaagaagaaaaccatttgtgaatcatctggaatctggtcaaatcctagtccaatatgtcaaaaattggacaaaagtttctcaatgattaaggagggtgattataaccccctcttcattccagtggcagtcatggttactgcattctctgggttggcatttatcatttggctggcaaggagattaaaaaaaggcaagaaatccaagagaagtatgaatgacccatattaaatcgcccttggtgaaagaaaattcttggaatactaaaaatcatgagatcctttaaatccttccatgaaacgttttgtgtggtggcacctcctacgtcaaacatgaagtgtgtttccttcagtgcatctgggaagatttctacctgaccaacagttccttcagcttccatttcgcccctcatttatccctcaacccccagcccacaggtgtttatacagctcagctttttgtcttttctgaggagaaacaaataagaccataaagggaaaggattcatgtggaatataaagatggctgactttgctctttcttgactcttgttttcagtttcaattcagtgctgtacttgatgacagacacttctaaatgaagtgcaaatttgatacatatgtgaatatggactcagttttcttgcagatcaaatttcacgtcgtcttctgtatactgtggaggtacactcttatagaaagttcaaaaagtctacgctctcctttctttctaactccagtgaagtaatggggtcctgctcaagttgaaagagtcctatttgcactgtagcctcgccgtctgtgaattggaccatcctatttaactggcttcagcctccccaccttcttcagccacctctctttttcagttggctgacttccacacctagcatctcatgagtgccaagcaaaaggagagaagagagaaatagcctgcgctgttttttagtttgggggttttgctgtttccttttatgagacccattcctatttcttatagtcaatgtttcttttatcacgatattattagtaagaaaacatcactgaaatgctagctgcaagtgacatctctttgatgtcatatggaagagttaaaacaggtggagaaattccttgattcacaatgaaatgctctcctttcccctgcccccagaccttttatccacttacctagattctacatattctttaaatttcatctcaggcctccctcaaccccaccacttcttttataactagtcctttactaatccaacccatgatgagctcctcttcctggcttcttactgaaaggttaccctgtaacatgcaattttgcatttgaataaagcctgctttttaagtgttaa

SEQ ID NO: 57621 - DNA, 3363 bp, Homo sapiens
gacatagctgccctaaaaggaatgaggaagcgagagctctccagtgtctggctggctccgtccgtgtgacagcccatgatgttctttccggtctctgtaatattctgaatttccacctgcccgccccttcgcttataatgcagagcatgtgaagggagaccggctcggtctctctctctcccagtggactagaaggagcagagagttatgctgtttctcccattctttacagctcaccggatgtaaaagaactctggctagagaccctccaaggacagaggcacagccacacgggagtgaaatccacccctggacagtcagccgcaatactgatgaagctgagaagcagccacaatgcttcaaaaacactaaacgccaataatatggagacactaatcgaatgtcaatcagagggtgatatcaaggaacatcccctgttggcatcatgtgagagtgaagacagtatttgccagctcattgaagttaagaagagaaagaaggtgctgtcctggccctttctcatgagaaggctctcccctgcatcagatttttctggggctttggagacagacttgaaagcatcgctatttgatcagcccttgtcaattatctgcggtgacagtgacacactccccagacccatccaggacattctcactattctatgccttaaaggcccttcaacggaagggatattcaggagagcagccaacgagaaagcccgtaaggagctgaaggaggagctcaactctggggatgcggtggatctggagaggctccccgtgcacctcctcgctgtggtctttaaggacttcctcagaagtatcccccggaagctactttcaagcgacctctttgaggagtggatgggtgctctggagatgcaggacgaggaggacagaatcgaggccctgaaacaggttgcagataagctcccccggcccaacctcctgctactcaagcacttggtctatgtgctgcacctcatcagcaagaactctgaggtgaacaggatggactccagcaatctggccatctgcattggacccaacatgctcaccctggagaatgaccagagcctgtcatttgaagcccagaaggacctgaacaacaaggtgaagacactggtggaattcctcattgataactgctttgaaatatttggggagaacattccagtgcattccagtatcacttctgatgactccctggagcacactgacagttcagatgtgtcgaccctgcagaatgactcagcctacgacagcaacgaccctgatgtggaatccaacagcagcagtggcatcagctctcccagcaggcagccccaggtgcccatggccacagctgctggcttggatagcgcgggcccacaggatgcccgagaggtcagcccagagcccattgtgagcaccgtggccaggctgaaaagctccctcgcacagcccgataggagatactcagagcccagcatgccatcctcccaggagtgcctcgagagccgggtgacaaaccaaacactaacaaagagtgaaggggacttccccgtgccccgggtaggctctcgtttggaaagtgaggaggctgaagacccatttccagaggaggtcttccctgcagtgcaaggcaaaaccaagaggccggtggacctgaagatcaagaacttggccccgggttcggtgctcccgcgggcactggttctcaaagccttctccagcagctcgctggacgcgtcctctgacagctcgcccgtggcttctccttccagtcccaaaagaaatttcttcagcagacatcagtctttcaccacaaagacagagaaaggcaagcccagccgagaaattaaaaagcactccatgtctttcacctttgcccctcacaaaaaagtgctgaccaaaaacctcagcgcgggctctgggaaatcgcaagactttaccagggaccacgtcccgaggggtgtcagaaaggaaagccagcttgccggccgaatcgtgcaggaaaatgggtgtgaaacccacaaccaaacagcccgcggcttctgcctgagaccccacgccctctcggtggatgatgtgttccagggagctgactgggagaggcctggaagcccaccctcttatgaagaggccatgcagggcccggcagccagactagtggcctccgagagccagaccgtggggagcatgacggtggggagcatgagggcgaggatgctggaggcgcactgcctcctaccccctcttccacctgctcaccacgtagaggactcaagacacaggggcagcaaagagccactccctggccacggactctctcccctgcctgagcgatggaaacagagcagaactgtccatgcttctggggactctctggggcacgtgtctggcccagggagacctgagctcctcccgctgaggaccgtctccgagtccgtgcagaggaataagcgggactgtctcgtgcgacgatgtagccagccggtctttgaggctgaccaattccaatatgccaaagaatcgtatatttaggagggaggccatacgccatgccatagcttgtgctatctgtaaatatgagacttgtaaagaactgcctgtagattgtttttaaaaggtcttgaataagctccttgagaaagttgtggaaagccctcctcagtgaggatagctacaccatggccatggcgcatcagatagtctctgtgtacctggatttgtgcaatatgtaaaaatgtatcaaatgtattatagataaggtgttaggtgcaaaggatgtctaataatccctgcacacgttttgaacttgcagtgaagtacactgctgttccttgcttcctggggcacttttctcttggttagtgtttaaaaattatcttcgcttttttaatgtggcctcaaatgtcatgccaattttcacatcttccacaaactccatttagggagaaatgtttaaatctctggtataagtttactccataccagagtaaactatatattactctatataagcagtcttgcaataactaatcaccaccatagaagaaagaaacagactgcaaggaacagagttgagtgtctggagtcatcaaaggcattaaaaactccagtaaaagctggggccgtagcaaaaatcatgaaaaacacttcaacgtgtcctttcaatcatccaattaaatgtgggtagattaatgaaaatgtattacatcaatattaactcatctatagcactttgagtatctttgtagttcatgatatcctatcctataatgtggaggtaaatgattttatatgcattgggggtcatatataaaacttcaatgtaatttcactacaataaattgccttccttatttgaaagtaaaaa

SEQ ID NO: 57622 - DNA, 3196 bp, Homo sapiens
gacatagctgccctaaaaggaatgaggaagcgagagctctccagtgtctggctggctccgtccgtgtgacagcccatgatgttctttccggtctctgtaatattctgaatttccacctgcccgccccttcgcttataatgcagagcatgtgaagggagaccggctcggtctctctctctcccagtggactagaaggagcagagagttatgctgtttctcccattctttacagctcaccggatgtaaaagaactctggctagagaccctccaaggacagaggcacagccacacgggagtgaaatccacccctggacagtcagccgcaatactgatgaagctgagaagcagccacaatgcttcaaaaacactaaacgccaataatatggagacactaatcgaatgtcaatcagagggtgatatcaaggaacatcccctgttggcatcatgtgagagtgaagacagtatttgccagctcattggacattctcactattctatgccttaaaggcccttcaacggaagggatattcaggagagcagccaacgagaaagcccgtaaggagctgaaggaggagctcaactctggggatgcggtggatctggagaggctccccgtgcacctcctcgctgtggtctttaaggacttcctcagaagtatcccccggaagctactttcaagcgacctctttgaggagtggatgggtgctctggagatgcaggacgaggaggacagaatcgaggccctgaaacaggttgcagataagctcccccggcccaacctcctgctactcaagcacttggtctatgtgctgcacctcatcagcaagaactctgaggtgaacaggatggactccagcaatctggccatctgcattggacccaacatgctcaccctggagaatgaccagagcctgtcatttgaagcccagaaggacctgaacaacaaggtgaagacactggtggaattcctcattgataactgctttgaaatatttggggagaacattccagtgcattccagtatcacttctgatgactccctggagcacactgacagttcagatgtgtcgaccctgcagaatgactcagcctacgacagcaacgaccctgatgtggaatccaacagcagcagtggcatcagctctcccagcaggcagccccaggtgcccatggccacagctgctggcttggatagcgcgggcccacaggatgcccgagaggtcagcccagagcccattgtgagcaccgtggccaggctgaaaagctccctcgcacagcccgataggagatactcagagcccagcatgccatcctcccaggagtgcctcgagagccgggtgacaaaccaaacactaacaaagagtgaaggggacttccccgtgccccgggtaggctctcgtttggaaagtgaggaggctgaagacccatttccagaggaggtcttccctgcagtgcaaggcaaaaccaagaggccggtggacctgaagatcaagaacttggccccgggttcggtgctcccgcgggcactggttctcaaagccttctccagcagctcgctggacgcgtcctctgacagctcgcccgtggcttctccttccagtcccaaaagaaatttcttcagcagacatcagtctttcaccacaaagacagagaaaggcaagcccagccgagaaattaaaaagcactccatgtctttcacctttgcccctcacaaaaaagtgctgaccaaaaacctcagcgcgggctctgggaaatcgcaagactttaccagggaccacgtcccgaggggtgtcagaaaggaaagccagcttgccggccgaatcgtgcaggaaaatgggtgtgaaacccacaaccaaacagcccgcggcttctgcctgagaccccacgccctctcggtggatgatgtgttccagggagctgactgggagaggcctggaagcccaccctcttatgaagaggccatgcagggcccggcagccagactagtggcctccgagagccagaccgtggggagcatgacggtggggagcatgagggcgaggatgctggaggcgcactgcctcctaccccctcttccacctgctcaccacgtagaggactcaagacacaggggcagcaaagagccactccctggccacggactctctcccctgcctgagcgatggaaacagagcagaactgtccatgcttctggggactctctggggcacgtgtctggcccagggagacctgagctcctcccgctgaggaccgtctccgagtccgtgcagaggaataagcgggactgtctcgtgcgacgatgtagccagccggtctttgaggctgaccaattccaatatgccaaagaatcgtatatttaggagggaggccatacgccatgccatagcttgtgctatctgtaaatatgagacttgtaaagaactgcctgtagattgtttttaaaaggtcttgaataagctccttgagaaagttgtggaaagccctcctcagtgaggatagctacaccatggccatggcgcatcagatagtctctgtgtacctggatttgtgcaatatgtaaaaatgtatcaaatgtattatagataaggtgttaggtgcaaaggatgtctaataatccctgcacacgttttgaacttgcagtgaagtacactgctgttccttgcttcctggggcacttttctcttggttagtgtttaaaaattatcttcgcttttttaatgtggcctcaaatgtcatgccaattttcacatcttccacaaactccatttagggagaaatgtttaaatctctggtataagtttactccataccagagtaaactatatattactctatataagcagtcttgcaataactaatcaccaccatagaagaaagaaacagactgcaaggaacagagttgagtgtctggagtcatcaaaggcattaaaaactccagtaaaagctggggccgtagcaaaaatcatgaaaaacacttcaacgtgtcctttcaatcatccaattaaatgtgggtagattaatgaaaatgtattacatcaatattaactcatctatagcactttgagtatctttgtagttcatgatatcctatcctataatgtggaggtaaatgattttatatgcattgggggtcatatataaaacttcaatgtaatttcactacaataaattgccttccttatttgaaagtaaaaa

SEQ ID NO: 57623 - DNA, 1027 bp, Homo sapiens
gggcaagagttgggcaaaaaaatcaaggtatttggtcccggaacaaagcttatcattacagataaacaacttgatgcagatgtttcccccaagcccactatttttcttccttcaattgctgaaacaaagctccagaaggctggaacatacctttgtcttcttgagaaatttttccctgatgttattaagatacattggcaagaaaagaagagcaacacgattctgggatcccaggaggggaacaccatgaagactaacgacacatacatgaaatttagctggttaacggtgccagaaaagtcactggacaaagaacacagatgtatcgtcagacatgagaataataaaaacggagttgatcaagaaattatctttcctccaataaagacagatgtcatcacaatggatcccaaagacaattgttcaaaagatgcaaatgatacactactgctgcagctcacaaacacctctgcatattacatgtacctcctcctgctcctcaagagtgtggtctattttgccatcatcacctgctgtctgcttagaagaacggctttctgctgcaatggagagaaatcataacagacggtggcacaaggaggccatcttttcctcatcggttattgtccctagaagcgtcttctgaggatctagttgggctttctttctgggtttgggccatttcagttctcatgtgtgtactattctatcattattgtataacggttttcaaaccagtgggcacacagagaacctcactctgtaataacaatgaggaatagccacggcgatctccagcaccaatctctccatgttttccacagctcctccagccaacccaaatagcgcctgctatagtgtagacatcctgcggcttctagccttgtccctctcttagtgttctttaatcagataactgcctggaagcctttcattttacacgccctgaagcagtcttctttgctagttgaattatgtggtgtgtttttccgtaataagcaaaataaatttaaaaaaatgaaaagtt

SEQ ID NO: 57624 - DNA, 1027 bp, Homo sapiens; identical to SEQ ID NO: 57623

SEQ ID NO: 57625 - DNA, 1977 bp, Homo sapiens
acgggccgcagcggcagtgacgtagggttggcgcacggatccgttgcggctgcagctctgcagtcgggccgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctgacagaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccatcgtggtactccttgggatcgcctttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtggaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatca

SEQ ID NO: 57626 - DNA, 4446 bp, Homo sapiens
tgccttgaccaggacttgggactttgcgaaaggatcgcggggcccggagaggtgttggagagcacaatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggctaaccggaaacaggtgggtcacctcctgcaagaagtggggcctcgagctgtcagtcatcatggtgctatcctctgaacccctcagctgccactgcaacagtgggcttaagggtgtctgagcaggagaggaaagataagctcttcgtggtgcccacgatgctcaggtttggtaacccgggagtgttcccaggtggccttagaaagcaaagcttgtaactggcaagggatgatgtcagattcagcccaaggttcctcctctcctaccaagcaggaggccaggaacttctttggacttggaaggtgtgcggggactggccgaggcccctgcaccctgcgcatcaggactgcttcatcgtcttggctgagaaagggaaaagacacacaagtcgcgtgggttggagaagccagagccattccacctcccctcccccagcatctctcagagatgtgaagccagatcctcatggcagcgaggccctctgcaagaagctcaaggaagctcagggaaaatggacgtattcagagagtgtttgtagttcatggtttttccctacctgcccggttcctttcctgaggacccggcagaaatgcagaaccatccatggactgtgattctgaggctgctgagactgaacatgttcacattgacagaaaaacaagctgctctttataatatgcaccttttaaaaaattagaatattttactgggaagacgtgtaactctttgggttattactgtctttacttctaaagaagttagcttgaactgaggagtaaaagtgtgtacatatataatatacccttacattatgtatgagggatttttttaaattatattgaaatgctgccctagaagtacaataggaaggctaaataataataacctgttttctggttgttgttggggcatgagcttgtgtatacactgcttgcataaactcaaccagctgcctttttaaagggagctctagtcctttttgtgtaattcactttatttattttattacaaacttcaagattatttaagtgaagatatttcttcagctctggggaaaatgccacagtgttctcctgagagaacatccttgctttgagtcaggctgtgggcaagttcctgaccacagggagtaaattggcctctttgatacacttttgcttgcctccccaggaaagaaggaattgcatccaaggtatacatacatattcatcgatgtttcgtgcttctccttatgaaactccagctatgtaataaaaaactatactctgtgttctgttaatgcctctgagtgtcctacctccttggagatgagatagggaaggagcagggatgagactggcaatggtcacagggaaagatgtggccttttgtgatggttttattttctgttaacactgtgtcctgggggggctgggaagtcccctgcatcccatggtaccctggtattgggacagcaaaagccagtaaccatgagtatgaggaaatctctttctgttgctggcttacagtttctctgtgtgctttgtggttgctgtcatatttgctctagaagaaaaaaaaaaaaggaggggaaatgcattttccccagagataaaggctgccattttgggggtctgtacttatggcctgaaaatatttgtgatccataactctacacagcctttactcatactattaggcacactttccccttagagccccctaagtttttcccagacgaatctttataatttctttccaaagataccaaataaacttcagtgttttcatctaattctcttaaagttgatatcttaatattttgtgttgatcattatttccattcttaatgtgaaaaaaagtaattatttatacttattataaaaagtatttgaaatttgcacatttaattgtccctaatagaaagccacctattctttgttggatttcttcaagtttttctaaataaatgtaacttttcacaagagtcaacattaaaaaataaattatttaagaacaaaaaaaaaaaaaaa

SEQ ID NO: 57627 - DNA, 1695 bp, Homo sapiens
gaggcacagataaagataagttttactgtcatgctgcttttaacataacagagcaacatcacctaggaaaaaagtttgtaggaggatttttaatccatatatttgtcttatggctagataaagatttctctgaaaaaaagaagcatgtcaggaatctctgggtgcccctttttcctctggggacttctagcattgttgggcttggctttggttatatcactgatcttcaatatttcccactatgtggaaaagcaacgacaagataaaatgtacagctactccagtgaccacaccagggttgatgagtattatattgaagacacaccaatttatggtaacttagatgatatgatttcagaaccaatggatgaaaattgctatgaacaaatgaaagcccgaccagagaaatctgtaaataagatgcaggaagccaccccatctgcacaggcaaccaatgaaacacagatgtgctacgcctcacttgatcacagcgttaaggggaagcgtagaaagcccaggaaacagaatactcatttctcagacaaggatggagatgagcaactacatgcaatagatgccagcgtttctaagaccaccttagtagacagtttctccccagaaagccaggcagtagaggaaaacattcatgatgatcccatcagactgtttggattgatccgtgctaagagagaacctataaactagctggaccatgatctagttcaatgatttggctcctattgaagatggcttctaagaaaacaagatgcacagaggacacagaaggacttggcagcagggtgatgacctgatcatttgttgatgggatggtggcttacctcttattcacagcttacacttatgcatgccaaatgtaaggccatgaaaatcagtatttcaaataacttaaaaaatgctttactactaaaatgtaaaaaattaatgtgctcacctcggcagcacatatactaaaaattaataagacccagcttgaaaattgagcctgataacaagattacaaattcacaatacctaatacttagggaaatataaaaatttaagcatgaatgcgttctggaacacgttagaagaaaaataaaagccaatgagtttttttttaattctcctttctcaccaatgggcaatagcccataattgaaataaatttctgattgaaaggtataggaaacattaaaatgcattactaagagaagtaatataattttcttacaaagtatttttcccaaagatagctttactatttcaaaaattgtcaaattaatgcatgctccttacaacaaacaaatatcaaaaagagtttaggaattctactagccagagatagtcacttggagaaactttctatatatccttctaaatatttttctgggcatgcttatgtatgtacatcagttgtttctttttattttgaaccaaaaatgtggtttcttttgtacacattacttaaactttctttccagtcaacaatatattgtggatttattttcactgttatatttaactatatataaatacgcatatattgtaattttaatgtctgcttagcaccccactgataaccaaatcacagtttatttaaataattttaatgacttttcaaaaacaatttattgatgcaaaaagcaaggttgagatgacaatgtttctttcaataattaaaaaatactgcttcac

SEQ ID NO: 57628 - DNA, 2528 bp, Homo sapiens
gagttccagcagtccgcgagctgccgtcggctccgcggggggggcgggccgggcaccccggggcgcggaggagcgctcctcgcttctctccttcccccctgccgcactccgccggaccctcccgccggcccgcgccgctgcactcgccctctcctctcgccccccggcaaactttcggcccctccccgcccctcgcccgttattcgtcgtggctcaagcccggccacgccgccccaagggctcctcccgacctcccggcctgccgctccggccactgcgggatccagaaacatgtcgaccacacttctgtccgccttctacgatgtcgacttcttgtgcaagacagagaaatccctggccaacctcaacctgaacaacatgctggacaagaaggcggtggggacgcctgtggccgccgcccccagctcgggcttcgcgccgggattcctccgacggcactcggccagcaacctgcatgcactcgcccaccccgcgcccagccccggcagctgctcgcccaagttcccgggcgccgctaacggcagcagctgcggcagcgcggcggccggcggtccgacctcctacggcacccttaaggagccgtcggggggcggcggcacagccctgctcaacaaggagaacaaattccgggaccgctcgtttagcgagaacggcgatcgcagccagcacctcctgcacctgcagcagcagcagaaggggggcggcggctcccagatcaactccacgcgctacaagaccgagctgtgccggcccttcgaggagagcggcacgtgcaagtacggcgaaaagtgccagttcgcgcatggcttccacgagctgcgcagcctgactcgccatccgaagtacaagaccgagctgtgccgcacctttcataccatcggcttctgcccctatgggccgcgctgccacttcatccacaacgcggacgagcggcggcccgcgccgtcggggggcgcctccggggacctgcgtgcctttggcacgcgcgatgcgttgcacctgggcttcccgcgggagccgcggcccaagttgcaccacagcctcagcttctcgggcttcccgtcgggccaccatcagcccccgggcggcctcgagtcgccgctgctgctcgacagccccacgtcgcgcacgccgccgccgccctcctgctcttcggcctcgtcctgctcctcctccgcctcctcctgttcctcggcctccgcggcctccacgccctcgggcgccccgacatgctgcgcctccgcggcggccgcggctgcggccgctctgctgtacggcaccgggggcgccgaggacctgctggcgccgggggccccgtgcgcggcctgctcgtcggcctcgtgcgccaacaacgccttcgccttcggtccggagctcagcagcctcatcacgccgctcgccatccagacccacaactttgccgccgtggccgccgccgcctactaccgcagtcagcagcagcagcagcagcagggcctggcgccccccgcgcagccgccggcgccgcccagcgcgaccctccccgccggggccgccgcacctccctcgccgcccttcagcttccagctgccgcgccgcctgtccgactcgcccgtgttcgacgcgccccccagccccccggactcgctgtcggaccgcgacagctacctaagcggctccctgagctccggcagcctcagcggctctgagtctcccagcctcgaccctggccgccgcctgccaatcttcagccgcctctccatctccgacgactgaggcaagagggcgccagtgaggaggaagggaaggcggttcagagatgttggaggacacccctcgccatctcgcccttgctgggggcacgggagtggggggggtgacatgggccctaggcagactgcaagcccgaccgagcacttggactcgaactctgtgccgggaggggcccccacccctcctttttcggtttcctcttgtctttttttttttatttttattacgaagtttcattctttttgagcaaaaaagtcgaactttttctgttgaacaaaatattcacaacagggcagttgtgatacgaatagaacaaaaaaaaaaaaaaaacacttaaactttgttaggactccgatgagtttgggacttcaggaaaaatcaacccagcaccagcagctaccaaccaccattccatctcttcacttgaacagcattagttaagtccagatgtgggaacccttctcttggaagaagttcctaattgtgtctcagaccggtgtaaacaaaccagccagccgccaccttgctaaacctataagctttttaaaatccaatatattctgccaagaatatgccttgatagttagccctcagcccataggtgttttttgttttttaacagaattatatatgtctgggggtgaaaaaacccttgcattccaaaggtccatactggttacttggtttcattgccaccacttagtggatgttcagtttagaaccattttgtctgctccctctggaagccttgcgca

SEQ ID NO: 57629 - DNA, 1604 bp, Homo sapiens
cctccgcccgcccgcctgcctgcctgcccgcccgctcgctcgcccggcccgcgactcatgtcccgccgcaaggccggcagcgcgccccgccgagtagagcccgcgcccgccgccaacccagacgacgagatggaaatgcaggacctcgtcatcgaactcaagcccgagccagacgcgcagccccaacaggccccaaggctggggcccttctccccgaaggaggtgtcctcggcggggcggttcggcggcgaaccccaccactcccctggccccatgcccgccggggccgccctcctcgccctcggcccgcggaacccgtggaccctgtggacgccgttgaccccgaactatcccgaccgccagccctggaccgacaaacacccagatctgttgacctgcggccgctgcctgcagaccttcccgttggaggccatcactgccttcatggaccacaagaagctgggctgtcagctcttcagaggccccagccgcggccagggctcagaacgagaggagctgaaggccttgagctgcctgcgctgtggcaaacagttcacagtggcctggaagctgctgcgtcacgcccagtgggaccacggactgtccatctaccagacagaatcagaggccccggaggccccgctcctgggcctggccgaggtggctgcagccgtgtcggcagtggtggggccagcagctgaggccaagagcccccgtgcaagtggcagcggcctcacccggcggagccccacctgtcctgtgtgcaagaagaccctcagctccttcagcaacctcaaagtgcacatgcgctcacacacaggcgagcggccctatgcttgcgaccagtgtccctacgcctgcgcccagagcagcaagctcaaccgccacaagaagacccaccggcaggtgccgccccagagccccctcatggccgacaccagccaggagcaggcctctgcagcccctccggagccggctgtccatgctgctgcccccaccagcacccttccatgcagcggtggtgagggggctggagccgccgccacagcaggtgtccaggaacccggggctcctggcagtggggctcaagccggccctggtggagacacttggggagccatcaccacggaacaaagaactgaccctgcaaacagccagaaggcatcacccaaaaagatgcccaagtcagggggcaagagccgcgggcccgggggcagctgtgagttctgcgggaagcattttaccaacagcagcaacctgacggtgcaccggcgctcacacaccggggagcgcccctacacctgtgagttctgcaactacgcctgcgcccagagcagtaagctcaaccgccaccgccgcatgcacggcatgacgcctggcagcacccgcttcgagtgcccccactgccatgtgcccttcggcctgcgagccaccctggacaaacacctgcggcagaagcaccctgaggcggccggcgaggcctgagcccaggaaagcccccctcactgtccctggtaccgctgccaacacccattgacctcctcgtttttgcccgccttctccaagtaaattttcccttttatttaaaaaaaaaaaaaaaaaaa

SEQ ID NO: 57630 - DNA, 2259 bp, Homo sapiens
gtaggcgcaaagctgaggaaaggagagtgtggagaggggcctggtgtggtggggcccggtgtttgggaccggagggtgttgacggctgatgagttccttgggtttgctctttcttcacctgaaaagaagactccaggaagggcagcacatgccggagaaagatgaattccagcttgaccgcccagaggcgcggcagtgacgccgagttgggaccctgggtgatggctgcgaggtccaaggacgcggcgccgtcccaacgcgacggacttttgcccgtgaaagtggaggaagactcacccggaagttgggagcccaactatcccgcggcttcgccggaccccgaaacttctcgactgcactttaggcagctgcgttaccaggaggtggctggaccggaagaggcgctgagccggctccgagaactctgtcgtcggtggctgagacccgagctgctctccaaggagcagatcctggagctgctggtgctggagcagttcctcaccatcctgcccgaggagcttcaagcctgggtgcgagagcactgcccagagagcggggaggaggcggtggccgtggtgcgggctctgcagcgagcgctcgatggaacctcatcccaggggatggtgactttcgaggacacggctgtgtctctaacctgggaggagtgggagcgcctggacccagcacggagggacttctgcagagagagtgcgcagaaggattccgggagcacagttccgccgagtttggaaagcagagtggagaacaaagagttgattccaatgcaacaaattttagaagaagcggagccacaggggcaactacaagaagcgttccaggggaagcgccccctgttttctaagtgtggcagtacccatgaggacagggtggaaaagcagtccggagaccccttgcccctgaaacttgaaaattctcctgaagcagaaggactcaacagcatctcagatgtcaataagaatggttccatagaaggggaagactctaaaaataatgaattgcagaacagtgccaggtgttccaaccttgttctatgtcagcacatcccgaaagcagagaggcccactgacagtgaggaacacgggaacaagtgcaagcaaagtttccacatggtgacgtggcacgtgctgaaacctcacaagtctgacagtggagacagtttccatcattccagcctttttgagacccagaggcagctccatgaagaaagaccttataaatgtggtaactgtgggaagagtttcaaacaacgctctgacctctttagacaccagagaatccacacaggtgagaaaccctatggctgccaagaatgtgggaaaagcttcagccagagtgctgccctgaccaagcaccagaggacacacacaggcgagaagccgtacacctgtctgaaatgtggggagcgcttcaggcagaattcacacctaaatcgtcatcaaagtacccacagtagagacaaacattttaaatgtgaggaatgcggggaaacctgtcatatttccaacctttttagacatcagagactacataaaggggaaagaccctataagtgtgaagaatgcgagaagagcttcaaacagcgctctgacctctttaaacaccacagaatccacactggggagaagccctatggatgttccgtctgtgggaaacgcttcaatcagagtgcaaccctcattaaacaccagagaattcacactggggaaaagccttacaaatgtcttgaatgtggggaaagatttagacaaagtacacaccttatccgacaccaaagaattcatcaaaataaagtgctgtcggctgggcgtggtggctcacgcctataatcccagcactttgggaggccaaggcaggcagatcatttgagatcaggagtttgaaaccagcctggccaacatggtaaaatcctgtctctactaaaaatacaaaaatgagccgggcatggtggtgcatgcctgtaagcccagctattcgggaggctgaggtaggagaatcacttgaacccaggaggcggaagttgcagtgagctgagatcatgccactgcactccagcctgggcaacagagcgagactccatctcaaaaaagaaataaagtgctgtcattttgatatgtttctatgtgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 57631 - DNA, 2996 bp, Homo sapiens
agtttagcgtaaaccgggaagcggatcgcgtggagtgaaagtcaccgcagcggagatggacaaaccatgtgggtgccctccaggtgtgtgcgaccatgaaatgggagactagcaggacccacgttggccaaccgtggacctggtccctccagtaggagtcgtgagccagctgaatttgaatgcaaagatggagcaagggccgactggagtcacactgacatccacccccataacatggggacagatcaagaaaacaaagcaggaagctgagaaaatgctggagcatccatgtgcttggccatgttagcagtagtgtcctgtgaggattgatttccaaaaactcctgttacatgaggaagacaccaagaagagcaaagaaaaggagccagggtggctcttcctcagctatctcttccaaatgcatgacaaggaagttctcatcaagaaggcaaggcaatacagaagtgttccacacagggacattgcaaagacaagcaagtcatcacactggagatttttccttccaggaaattgagaaagattttcaggactttgagtttcagtggcaagaagatgaaagaaatggccatgaagcactcatgacagagataaaaaagttgacaggtaatacagactgatattatcaaaggcatgctggaaacaaacctattaaagatcagcttggatcaagctttcattcacatctgcctgaactgcatatattgcagagcaaagggaaaattgatagtcaagatgagaagtctgtcaatgatgcttcctcagtttcagcatcccaaagaatttcttgtattcctaaaacccatatttctaataagtatgggaataatttcctccaggaagcacacatgagagaaaaatctttccaatgtaatgagagtggcaaagcctttaattgtagctcactgttaaaaaaatgtcagataatccatttaggagagaaaaaatataaatgtgatatatgtggcaaggtctttaatcagaagcgataccttgcataccatcatagatgtcacactggtgagaaaccttacaagtgtaatcagtgtggcaagaccttcagttacaagtcatcccttgtaattcacaaggcaattcatactggagagaaacctcacaagtgtaatgaatgtggcaaggtttttaatcaaaaagcatatcttgcaagtcatcatagacttcatactggagagaaaccttacaaatgtgaagaatgtgacaaagtttttagtcgctaatcacaccttgaaagacataggagaattcatactggagagaaaccgtacaaatgtaaggtttgtgacaaggctttcagacgtgattcacacctggcacaacatattgtaattcacactggagagaaaccttacaagtgtaatgagtgtggcaagacctttgttcaaaattcatctcttgtaatgcataaggtcattcatactggagagaaatgttacaagtgtaatgaatgtggcaaggtttttaatcacaaatcaaaccttgcatgtcatcatagacttcatactggagagaaaccttacaagtgtaatgaatgtggcaaggtttttaattgaaaatcaaaccttgaacatcatcatagagttcatatcggagaaaaaccttacaaatgtgaagaatgtgacaaagttttcaatttcaattcacgccttgaaatacataggagagttcatactggagagaaaccatagaaatgtaaggtttgtgacaaggcattcgggtgtgattcacacctggcacaacatactagaattcacactggagagaaaccgtgcaagtgtgatgagtgtgacagagccttcagtggtcagtcaacacttattcaccatcaagcaatccatgtcatagggaaactttactaatgtaatgattgtcacaaagtcctcagtaatgctacaaccattgcaaattattggagaatgcataatgaagtgagaacttacaagtgttataaatgtggcaaatttttcagacttcgttcataccttgcagtttatcagcgaactcatactggagagaaaccttacaaatgtgatgattgtggcaaggtcttcagtcaagcttcatcttatgcaaaacacaggtgaattcatacaagaaagaaacctcacaagggtgatgattgtgtcaaagcctttatttcaggttcatgcctcattacacatcagagaatccatactagacagagatcttacaaaagtcatatgtgtggcaagatctttagtctgaggtcactccttgcaggacatcaggaaattcatttttgaggtaataatttcaaatgcaatgagtatagcaaaccatcaagcacaattgatgttagattcaaatcagcattgagttcagtttgagttgacttaacattgagttcaagtatttgttgagattaaagtgtttatgttaagaggattaggccaggtgcggtggctcacacctgtaatcccagcactttgggaggccaagacaggtagatcacttgagatcaggagtttgagagcagcctggccaacagaggtgagcacctttcccagtctgttttttgtttcttcaacaaaaactgatagagatttttatgggtattgtgttgaatcaaaatcacattgggttatgtaatcatttaacagtattaatttttccaaaacatcaatatgggttatatctttatatatgtttttaatcattttgatcaatgtttgtagatttcaatgtatgaatttctcacttctttccatttattcctatttcttactttaagttctctagcaaatggaagtgtttttaaattttcatttaaaattgtttattgttaatgtatgaaaattcaacgaatttttggtgctgatattgtattgtgcaaatctactgatgtgtttattagtcacagtagtattttggttgactctttgtgattttctacacagaagatcatgtcatctacaaaaaatataattttactttttctg

SEQ ID NO: 57632 - DNA, 3759 bp, Homo sapiens
ccttttgtgggagtccggtctgtccacttgccggtccctcagaccgtcggcggtctctgtccgcttcgggacctgtccgctggtcgctccgcgtccgatggctcctggccgcggaaccttaggcctggccctggtctccgagcgcgggttcgccgggaggagcgtgtggcgggggtgtgccggggcgtgagtgcgccgagcatggggctgagcctggtgtggggagtgggtatctgcggagccggcctgaaccccacctcagccgggcgcggggagggggctccgtgcgtgtgatcgtgcagctgtgagcgcgtggccgccccgcggggctccgctgcaggcccctcagccccaggagcagtactcgctcttcagggcctgccctggatcctggaggctacacagctgcccactcctcctggggaggctgccgtggaggccatggagatccctgccccggagcccgagaagacaggtacagcttcactcttgtagtcagtatgtctgtggatttgcacttgaggatattgacactcagagagatcaggccagtttcccagaagcatccagcatcttttttttttttttttaaatggaatctcactctgtcacccaggcgggagtggtgcaatggcttgatcttccgctcactgcaacctctgcttcccgggttcaaactattctcccgcctcaacctcccaagtagttgggattgcaggcacgcgccaccacgcccggctaatgtttgtatttttagtagagacggggttttgccatgtttcccaggctggtcttaagctcaagcgatccgcccgcctcggcctcccaaagtgctgggattacaggcgtgagccgatcggctcctggcctcctgcttctttcttccccgcgcccaatcatttgttcccactcagacgtgcttgattggcggtagcagctcttttcgtcatgaattggagtgtctgagacacaggcagattattcctcgatgctgtttctgttggtgctagctactggggctcgttccccacctggccttgctggcaggttctgcctcctctctgattctcacttgtgccacgacaggtgggctttaagctcagccgtgagcctggtagccgtgaccttgactcatttctccttcgccagctctttcctctcaggatcctgctctttccctgaaagagaatctcgaggatatatcgggttggggtcttcccgaagccaggtccaaggaatcggtgagtttcaaggatgtggctgtggacttcacccaggaggagtggggtcaactagactcccctcagagggccttgtaccgggatgtgatgttggagaactaccagaaccttcttgccctaggacctccactgcacaagccagatgtgatctctcatctggaacgaggcgaggagccatggagcatgcagagggaagtccccagagggccctgtccagaatgggagctgaaggcggtgccctctcaacagcagggcatttgcaaagaagaaccggcccaggagcccatcatggagcggcccctcggcggggcgcaggcgtgggggcgccaggcaggtgctctgcagaggagtcaggctgcgcctgggcgccgcacctgccatggtctgggacgtcctgtagaggaattccccctcaggtgtcccctcttcgcccagcaacgcgttcccgaggggggacccttgctggacacacgcaagaacgtccaggccactgagggcagaaccaaggcccccgcgagactgtgtgcaggggaaaacgcctccacgccaagtgagccagaaaagttcccccaggtgcgccggcagcgcggggcgggcgccggggagggcgagttcgtgtgcggcgagtgcgggaaggcgttccgccagagctcctccctcacgctgcaccggcgctggcacagccgggagaaggcttacaagtgcgatgaatgcggcaaggccttcacctggagcaccaaccttctggagcaccggcgcatccacaccggcgagaagcccttcttctgcggcgagtgcgggaaggccttcagctgccactcgtccctcaacgtgcaccagcgcatccacacgggcgagcggccctacaagtgcagcgcctgcgagaaggccttcagctgcagctcgctgctcagcatgcacctgcgggtgcacaccggcgagaagccctaccggtgcggcgagtgcggcaaggccttcaaccagcgtacacacctcacacgccaccaccgcatccacacgggcgagaagccctaccagtgcggctcctgcggcaaggccttcacctgccactcatccctcaccgtgcatgagaagatccacagcggggacaagccgttcaagtgcagcgactgcgagaaggccttcaacagccgctcgcgcctcaccctccaccagaggacgcacacgggcgagaagcccttcaagtgcgccgactgcgggaagggcttcagctgccacgcgtacctgctcgtgcaccggcgcatccacagcggcgagaagcccttcaagtgcaacgagtgcggcaaagccttcagctcccacgcctacctcatcgtgcaccggcgcatccacacaggcgagaagcccttcgactgcagccagtgttggaaggccttcagctgccactcgtccctcatcatgcaccagcgcatccacaccggtgagaagccctacaagtgcagcgagtgcggcagagccttcagccagaaccactgtctcattaaacatcagaaaatccactccggggagaagtcgtttaagtgtgagaaatgtggggagatgttcaactggagctcgcacctcactgagcaccagaggctgcacagcgaggggaagcccttggccatccagttcaacaaacacctgctcagcacatactacgtgcctggcagcctgctgggtgcaggggatgctggactgagggacgtggatcccatcgacgcgctggatgtggcaaagctcttgtgcgtggttccccccagagctggcaggaatttctccctggggagcaaacctcgaaactaacatgatgtgctttggtgtcagtagctgctttctgagctactcaacaaggaaagcaccctggtcctccctggctcctagatccagaccaccttcctccaggtgtgggagccttgccttatcaccccaatcaggtctgcatgccagggtgcctcctctagttaaagtcagtcacctccccagaagggccacactccaggaggagtgttgagagtcatttgaggtagtcttgccacctgttttccttgatgggcctggaagttgttgacaaggggaaagatctttcttgccaataaaaagaagggatatcgttgggtgccatggctcacacctgtaatcttaacactgtgggaggccaaggcaaggggatcacttgagcccaggagtctaggaccagcctggacaacatggtgagacctcgtctctacaaaaaatgcaaaaattagccagatgtggcggcatgtccctgtggtcccagctactcaggaggctgaggtgggaggatcatttgagcctaggaggtcaaggctgcagtgagccatgattcacagcactgcactgcagcctgggtgacaaagcaagaccctgtgtgaaattaaaaggaggtatatcaactgttgtatcctcggacgggctcctgacatggctttaatcaggagtttcctccataaactattattttcagaataataataaaacaagaattatgactagc

SEQ ID NO: 57633 - DNA, 2997 bp, Homo sapiens
gtctctcgctgcagccggcgctccacgtctagtcttcactgctctgcgtcctgtgctgataaaggctcgccgctgtgaccctgttacctgcaagaacttggaggttcacagctaagacgccaggaccccctggaagcctagaaatggtattgctgtctctaagccagacctgatcacctggctggagcaaggaaaagagccctggaatctgaagagacatgagatggtagacaaaaccccagttatgtgttctcattttgcccaagatgtttggccagagcacagcataaaagattctttccaaaaagtgatactgagaacatatggaaaatatggacatgagaatttacagctaagaaaagaccataaaagtgtggatgcatgtaaggtgtacaaaggaggttataatggacttaaccagtgtttgacaactactgacagcaagatatttcagtgtgataaatatgtgaaagtctttcataaatttccaaatgtaaatagaaataagataagacatactggaaagaaacctttcaaatgtaaaaaccgtggcaaatcattttgcatgctttcacaattaactcaacataagaaaattcatactagagagtattcttacaaatgtgaagaatgtggtaaagcctttaactggtcctcaacccttactaaacataagataattcatactggagaaaaaccctacaaatgtgaagaatgtggcaaagcttttaaccggtcctcaaatcttactaaacataaaataattcatactggagagaaaccctacaaatgtgaagaatgtggcaaagcttttaaccggtcctcaacccttactaaacataaaagaattcatacagaagagaaaccctacaaatgtgaagaatgtggcaaggcctttaaccagttctcgattcttaataaacataagagaattcatatggaagataaaccctacaaatgtgaagaatgtggcaaagcctttagagtattctcaattcttaaaaaacataagataatccatactggggaaaaaccatacaaatgtgaagaatgtggcaaagcctttaaccagttctcaaaccttactaaacataagataattcatactggagagaaaccctacaaatgtgatgaatgtggcaaagcctttaaccagtcctcaacccttactaaacataaaagaattcatacgggagaaaaaccctacaaatgtgaagaatgtggcaaagcttttaaacagtcctcaacccttactgaacataagataattcatactggagagaaaccctacaaatgtgaaaaatgtggcaaggcctttagctggtcctcagcttttactaaacataagagaaatcatatggaagataaaccctacaaatgtgaagaatgtggcaaagcctttagtgtattctcaacccttactaaacataaaataattcatactagagaaaaaccctacaaatgtgaagaatgtggcaaagcctttaaccagtcctcaatttttactaaacataagataattcacactgaagggaaatcctacaaatgtgaaaaatgtggcaatgcttttaaccagtcctcaaaccttactgcacgtaagataatttatactggagagaaaccctacaaatatgaagaatgtgacaaagcctttaacaagttctcaacccttattacacatcagataatttatactggagagaaaccctgcaaacatgaatgtggcagagcctttaacaaatcctcaaattatactaaagagaaactacaaacctgaaagatgtgacaatgattttcactacacctcaaacttttctaaacataaaccatattggtgccctagaaatgtgaggaatatgacaaggactttaaatggttgtcacgcttgattgtaggtaagataatttatattggagaaaaatcctccaagtatgaagaatgtggcaaacttttaaccaatcctcacaccttattgcacaggaaagcatttatacttgagaaaaattgtataaagaatatggaaaagccatttatatctgctcacatgtaaaaacatcagttcatacttaataaaatgcaattaccgtcaaatctttcagaaaatataagcctttaatacgaggaagagtattcttaagatgaacattacaaatagaaagagggttgtagtacctttagttttatgatagatcttattgtacacattttgtaccagaggaaaaccctaaagcattagttgctcaaactttgttcgacatcagggaatttgtattggagaaaaaccctgcaaatgtaataaatatggaaaaacattttttcaaaaactacagcttggaaaacatcagagagttcatactaaaatatatttttgcagatgcagtaaatatgaaaaatatttaatcccaaattaagtctatgtaaatatcagaattcacagtagaaatcataaggcataaggcactgatacttcagacattacactaaattagagtgttgagtataggagatccaaaactaaaattgttaggtaagttatttatatataactttaaaagaagtagaagattttttggagatttataattacattcaaagtatacttttttcttgaaaaaaattacagattttttgaaaagcaattgatgtaatttaactctcaaattcatgtttttcttcattcctattatattcacatgtgaaagcaagtgatctgttgttgctgaatcagagatatgagagattcttttttataggtgggcattatttatgcccctttctgtggaagagtaagaaaattaaaatacaagatgcatgaggaaaatgtagagatgctctttgtgattaacttagaatattaagtgctacttgaggtacatgttcagactaacattcttttgcagtatagtgagaaaaaaacattttaaaattaattatcattttgttgattgtgcttttatgtaataaaatgcagtactttaaaacatttaaaaaaaaaaa

SEQ ID NO: 57634 - DNA, 3125 bp, Homo sapiens
gtctctcgctgcagccggcgctccacgtctagtcttcactgctctgcgtcctgtgctgataaaggctcgccgctgtgaccctgttacctgcaagaacttggaggttcacagctaagacgccaggaccccctggaagcctagaaatgggaccactgacatttagggatgtgaaaatagaattctctctagaggaatggcaatgcctggacactgcgcagcggaatttatatagagatgtgatgttagagaactacagaaacctggtcttccttggtattgctgtctctaagccagacctgatcacctggctggagcaaggaaaagagccctggaatctgaagagacatgagatggtagacaaaaccccagttatgtgttctcattttgcccaagatgtttggccagagcacagcataaaagattctttccaaaaagtgatactgagaacatatggaaaatatggacatgagaatttacagctaagaaaagaccataaaagtgtggatgcatgtaaggtgtacaaaggaggttataatggacttaaccagtgtttgacaactactgacagcaagatatttcagtgtgataaatatgtgaaagtctttcataaatttccaaatgtaaatagaaataagataagacatactggaaagaaacctttcaaatgtaaaaaccgtggcaaatcattttgcatgctttcacaattaactcaacataagaaaattcatactagagagtattcttacaaatgtgaagaatgtggtaaagcctttaactggtcctcaacccttactaaacataagataattcatactggagaaaaaccctacaaatgtgaagaatgtggcaaagcttttaaccggtcctcaaatcttactaaacataaaataattcatactggagagaaaccctacaaatgtgaagaatgtggcaaagcttttaaccggtcctcaacccttactaaacataaaagaattcatacagaagagaaaccctacaaatgtgaagaatgtggcaaggcctttaaccagttctcgattcttaataaacataagagaattcatatggaagataaaccctacaaatgtgaagaatgtggcaaagcctttagagtattctcaattcttaaaaaacataagataatccatactggggaaaaaccatacaaatgtgaagaatgtggcaaagcctttaaccagttctcaaaccttactaaacataagataattcatactggagagaaaccctacaaatgtgatgaatgtggcaaagcctttaaccagtcctcaacccttactaaacataaaagaattcatacgggagaaaaaccctacaaatgtgaagaatgtggcaaagcttttaaacagtcctcaacccttactgaacataagataattcatactggagagaaaccctacaaatgtgaaaaatgtggcaaggcctttagctggtcctcagcttttactaaacataagagaaatcatatggaagataaaccctacaaatgtgaagaatgtggcaaagcctttagtgtattctcaacccttactaaacataaaataattcatactagagaaaaaccctacaaatgtgaagaatgtggcaaagcctttaaccagtcctcaatttttactaaacataagataattcacactgaagggaaatcctacaaatgtgaaaaatgtggcaatgcttttaaccagtcctcaaaccttactgcacgtaagataatttatactggagagaaaccctacaaatatgaagaatgtgacaaagcctttaacaagttctcaacccttattacacatcagataatttatactggagagaaaccctgcaaacatgaatgtggcagagcctttaacaaatcctcaaattatactaaagagaaactacaaacctgaaagatgtgacaatgattttcactacacctcaaacttttctaaacataaaccatattggtgccctagaaatgtgaggaatatgacaaggactttaaatggttgtcacgcttgattgtaggtaagataatttatattggagaaaaatcctccaagtatgaagaatgtggcaaacttttaaccaatcctcacaccttattgcacaggaaagcatttatacttgagaaaaattgtataaagaatatggaaaagccatttatatctgctcacatgtaaaaacatcagttcatacttaataaaatgcaattaccgtcaaatctttcagaaaatataagcctttaatacgaggaagagtattcttaagatgaacattacaaatagaaagagggttgtagtacctttagttttatgatagatcttattgtacacattttgtaccagaggaaaaccctaaagcattagttgctcaaactttgttcgacatcagggaatttgtattggagaaaaaccctgcaaatgtaataaatatggaaaaacattttttcaaaaactacagcttggaaaacatcagagagttcatactaaaatatatttttgcagatgcagtaaatatgaaaaatatttaatcccaaattaagtctatgtaaatatcagaattcacagtagaaatcataaggcataaggcactgatacttcagacattacactaaattagagtgttgagtataggagatccaaaactaaaattgttaggtaagttatttatatataactttaaaagaagtagaagattttttggagatttataattacattcaaagtatacttttttcttgaaaaaaattacagattttttgaaaagcaattgatgtaatttaactctcaaattcatgtttttcttcattcctattatattcacatgtgaaagcaagtgatctgttgttgctgaatcagagatatgagagattcttttttataggtgggcattatttatgcccctttctgtggaagagtaagaaaattaaaatacaagatgcatgaggaaaatgtagagatgctctttgtgattaacttagaatattaagtgctacttgaggtacatgttcagactaacattcttttgcagtatagtgagaaaaaaacattttaaaattaattatcattttgttgattgtgcttttatgtaataaaatgcagtactttaaaacatttaaaaaaaaaaaa

SEQ ID NO: 57635 - protein, 1439 aa, Homo sapiens
MASSETEIRWAEPGLGKGPQRRRWAWAEDKRDVDRSSSQSWEEERLFPNATSPELLEDFRLAQQHLPPLEWDPHPQPDGHQDSESGETSGEEAEAEDVDSPASSHEPLAWLPQQGRQLDMTEEEPDGTLGSLEVEEAGESSSRLGYEAGLSLEGHGNTSPMALGHGQARGWVASGEQASGDKLSEHSEVNPSVELSPARSWSSGTVSLDHPSDSLDSTWEGETDGPQPTALAETLPEGPSHHLLSPDGRTGGSVARATPMEFQDSSAPPAQSPQHATDRWRRETTRFFCPQPKEHIWKQTKTSPKPLPSRFIGSISPLNPQPRPTRQGRPLPRQGATLAGRSSSNAPKYGRGQLNYPLPDFSKVGPRVRFPKDESYRPPKSRSHNRKPQAPARPLIFKSPAEIVQEVLLSSGEAALAKDTPPAHPITRVPQEFQTPEQATELVHQLQEDYHRLLTKYAEAENTIDQLRLGAKVNLFSDPPQPNHSIHTGMVPQGTKVLSFTIPQPRSAEWWPGPAEDPQASAASGWPSARGDLSPSSLTSMPTLGWLPENRDISEDQSSAEQTQALASQASQFLAKVESFERLIQAGRLMPQDQVKGFQRLKAAHAALEEEYLKACREQHPAQPLAGSKGTPGRFDPRRELEAEIYRLGSCLEELKEHIDQTQQEPEPPGSDSALDSTPALPCLHQPTHLPAPSGQAPMPAIKTSCPEPATTTAAASTGPCPLHVNVEVSSGNSEVEDRPQDPLARLRHKELQMEQVYHGLMERYLSVKSLPEAMRMEEEEEGEEEEEEEGGGDSLEVDGVAATPGKAEATRVLPRQCPVQAEKSHGAPLEEATEKMVSMKPPGFQASLARDGHMSGLGKAEAAPPGPGVPPHPPGTKSAASHQSSMTSLEGSGISERLPQKPLHRGGGPHLEETWMASPETDSGFVGSETSRVSPLTQTPEHRLSHISTAGTLAQPFAASVPRDGASYPKARGSLIPRRATEPSTPRSQAQRYLSSPSGPLRQRAPNFSLERTLAAEMAVPGSEFEGHKRISEQPLPNKTISPPPAPAPAAAPLPCGPTETIPSFLLTRAGRDQAICELQEEVSRLRLRLEDSLHQPLQGSPTRPASAFDRPARTRGRPADSPATWGSHYGSKSTERLPGEPRGEEQIVPPGRQRARSSSVPREVLRLSLSSESELPSLPLFSEKSKTTKDSPQAARDGKRGVGSAGWPDRVTFRGQYTGHEYHVLSPKAVPKGNGTVSCPHCRPIRTQDAGGAVTGDPLGPPPADTLQCPLCGQVGSPPEADGPGSATSGAEKATTRRKAPSTPSPKQRSKQAGSSPRPPPGLWYLATAPPAPAPPAFAYISSVPIMPYPPAAVYYAPAGPTSAQPAAKWPPTASPPPARRHRHSIQLDLGDLEELNKALSRAVQAAESVRSTTRQMRSSLSADLRQAHSLRGSCLF

SEQ ID NO: 57636 - protein, 604 aa, Homo sapiens
MNIVENSIFLSNLMKSANTFELKYDLSCELYRMSTYSTFPAGVPVSERSLARAGFYYTGVNDKVKCFCCGLMLDNWKRGDSPTEKHKKLYPSCRFVQSLNSVNNLEATSQPTFPSSVTNSTHSLLPGTENSGYFRGSYSNSPSNPVNSRANQDFSALMRSSYHCAMNNENARLLTFQTWPLTFLSPTDLAKAGFYYIGPGDRVACFACGGKLSNWEPKDNAMSEHLRHFPKCPFIENQLQDTSRYTVSNLSMQTHAARFKTFFNWPSSVLVNPEQLASAGFYYVGNSDDVKCFCCDGGLRCWESGDDPWVQHAKWFPRCEYLIRIKGQEFIRQVQASYPHLLEQLLSTSDSPGDENAESSIIHFEPGEDHSEDAIMMNTPVINAAVEMGFSRSLVKQTVQRKILATGENYRLVNDLVLDLLNAEDEIREEERERATEEKESNDLLLIRKNRMALFQHLTCVIPILDSLLTAGIINEQEHDVIKQKTQTSLQARELIDTILVKGNIAATVFRNSLQEAEAVLYEHLFVQQDIKYIPTEDVSDLPVEEQLRRLQEERTCKVCMDKEVSIVFIPCGHLVVCKDCAPSLRKCPICRSTIKGTVRTFLS

SEQ ID NO: 57637 - protein, 295 aa, Homo sapiens
MMAKKPPKPAPRRIFQERLKITALPLYFEGFLLIKRSGYREYEHYWTELRGTTLFFYTDKKSIIYVDKLDIVDLTCLTEQNSTEKNCAKFTLVLPKEEVQLKTENTESGEEWRGFILTVTELSVPQNVSLLPGQVIKLHEVLEREKKRRIETEQSTSVEKEKEPTEDYVDVLNPMPACFYTVSRKEATEMLQKNPSLGNMILRPGSDSRNYSITIRQEIDIPRIKHYKVMSVGQNYTIELEKPVTLPNLFSVIDYFVKETRGNLRPFICSTDENTGQEPSMEGRSEKLKKNPHIA

SEQ ID NO: 57638 - protein, 1104 aa, Homo sapiens
MARRGKKPVVRTLEDLTLDSGYGGAADSVRSSNLSLCCSDSHPASPYGGSCWPPLADSMHSRHNSFDTVNTALVEDSEGLDCAGQHCSRLLPDLDEVPWTLQELEALLLRSRDPRAGPAVPGGLPKDALAKLSTLVSRALVRIAKEAQRLSLRFAKCTKYEIQSAMEIVLSWGLAAHCTAAALAALSLYNMSSAGGDRLGRGKSARCGLTFSVGRVYRWMVDSRVALRIHEHAAIYLTACMESLFRDIYSRVVASGVPRSCSGPGSGSGSGPGPSSGPGAAPAADKEREAPGGGAASGGACSAASSASGGSSCCAPPAAAAAAVPPAAAANHHHHHHHALHEAPKFTVETLEHTVNNDSEIWGLLQPYQHLICGKNASGVLCLPDSLNLHRDPQRSNKPGELPMFSQSELRTIEQSLLATRVGSIAELSDLVSRAMHHLQPLNAKHHGNGTPLHHKQGALYWEPEALYTLCYFMHCPQMEWENPNVEPSKVNLQVERPFLVLPPLMEWIRVAVAHAGHRRSFSMDSDDVRQAARLLLPGVDCEPRQLRADDCFCASRKLDAVAIEAKFKQDLGFRMLNCGRTDLVKQAVSLLGPDGINTMSEQGMTPLMYACVRGDEAMVQMLLDAGADLNVEVVSTPHKYPSVHPETRHWTALTFAVLHGHIPVVQLLLDAGAKVEGSVEHGEENYSETPLQLAAAVGNFELVSLLLERGADPLIGTMYRNGISTTPQGDMNSFSQAAAHGHRNVFRKLLAQPEKEKSDILSLEEILAEGTDLAETAPPPLCASRNSKAKLRALREAMYHSAEHGYVDVTIDIRSIGVPWTLHTWLESLRIAFQQHRRPLIQCLLKEFKTIQEEEYTEELVTQGLPLMFEILKASKNEVISQQLCVIFTHCYGPYPIPKLTEIKRKQTSRLDPHFLNNKEMSDVTFLVEGRPFYAHKVLLFTASPRFKALLSSKPTNDGTCIEIGYVKYSIFQLVMQYLYYGGPESLLIKNNEIMELLSAAKFFQLEALQRHCEIICAKSINTDNCVDIYNHAKFLGVTELSAYCEGYFLKNMMVLIENEAFKQLLYDKNGEGTGQDVLQDLQRTLAIRIQSIHLSSSKGSVV

SEQ ID NO: 57639 - protein, 635 aa, Homo sapiens
MVSQSTVRQDSPVEPWEGISDHSGIIDGSPRLLNTDHPPCQLDIRLMRHKAVWINPQDVQQQPQDLQSQVPAAGNSGTHFVTDAASPSGPSPSCLGDSLAETTLSEDTTDSVGSASPHGSSEKSSSFSLSSTEVHMVRPGYSHRVSLPTSPRILATSPYPETDSAFFEPSHLTSAADEGAVQVSRRTISSNSFSPEVFVLPVDVEKENAHFYVADMIISAMEKMKCNILSQQQTESWSKEVSGLLGSDQPDSEMTFDTNIKQESGSSTSSYSGYEGCAVLQVSPVTETRTYHDVKEICKCDVDEFVILELGDFNDITETCSCSCSSSKSVTYEPDFNSAELLAKELYRVFQKCWILSVVNSQLAGSLSAAGSIVVNEECVRKDFESSMNVVQEIKFKSRIRGTEDWAPPRFQIIFNIHPPLKRDLVVAAQNFFCAGCGTPVEPKFVKRLRYCEYLGKYFCDCCHSYAESCIPARILMMWDFKKYYVSNFSKQLLDSIWHQPIFNLLSIGQSLYAKAKELDRVKEIQEQLFHIKKLLKTCRFANSCVKERALFVNFARIRLSSSHFRQQHVEDVQRAGLAFTNSASSPPSAPGVRGSQRGENFWKVWPLQQHDAPEYCEKDCSTCLMITPICVYYW

SEQ ID NO: 57640 - protein, 193 aa, Homo sapiens
MVVLRAGKKTFLPALCRAFACRGCQLAPERGAERRDTAPSGVSRFCPPRKSCHDWIGPPDKYSNLRPVHFYIPENESPLEQKLRKLRQETQEWNQQFWANQNLTFSKEKEEFIHSRLKTKGLGLRTESGQKATLNAEEMADFYKEFLSKNFQKHMYYNRDWYKRNFAITFFMGKVALERIWNKLKQKQKKRSN

SEQ ID NO: 57641 - protein, 404 aa, Homo sapiens
MLRAIAEERGRLSLRREVCGLGCFKDDRIVFWTWMFSTYFMEKWAPRQDDMLFYVRRKLAYSGSESGADGRKAAEPEVEVEVYRRDSKKLPGLGDPDIDWEESVCLNLILQKLDYMVTCAVCTRADGGDIHIHKKKSQQVFASPSKHPMDSKGEESKISYPNIFFMIDSFEEVFSDMTVGEGEMVCVELVASDKTNTFQGVIFQGSIRYEALKKVYDNRVSVAARMAQKMSFGFYKYSNMEFVRMKGPQGKGHAEMAVSRVSTGDTSPCGTEEDSSPASPMHERVTSFSTPPTPERNNRPAFFSPSLKRKVPRNRIAEMKKSHSANDSEEFFREDDGGADLHNATNLRSRSLSGTGRSLVGSWLKLNRADGNFLLYAHLTYVTLPLHRILTDILEVRQKPILMT

SEQ ID NO: 57642 - protein, 409 aa, Homo sapiens
MGSQAAAEWRNWASWEVSSSLSGCSMGCFKDDRIVFWTWMFSTYFMEKWAPRQDDMLFYVRRKLAYSGSESGADGRKAAEPEVEVEVYRRDSKKLPGLGDPDIDWEESVCLNLILQKLDYMVTCAVCTRADGGDIHIHKKKSQQVFASPSKHPMDSKGEESKISYPNIFFMIDSFEEVFSDMTVGEGEMVCVELVASDKTNTFQGVIFQGSIRYEALKKVYDNRVSVAARMAQKMSFGFYKYSNMEFVRMKGPQGKGHAEMAVSRVSTGDTSPCGTEEDSSPASPMHERVTSFSTPPTPERNNRPAFFSPSLKRKVPRNRIAEMKKSHSANDSEEFFREDDGGADLHNATNLRSRSLSGTGRSLVGSWLKLNRADGNFLLYAHLTYVTLPLHRILTDILEVRQKPILMT

SEQ ID NO: 57643 - protein, 374 aa, Homo sapiens
MSGESMNFSDVFDSSEDYFVSVNTSYYSVDSEMLLCSLQEVRQFSRLFVPIAYSLICVFGLLGNILVVITFAFYKKARSMTDVYLLNMAIADILFVLTLPFWAVSHATGAWVFSNATCKLLKGIYAINFNCGMLLLTCISMDRYIAIVQATKSFRLRSRTLPRSKIICLVVWGLSVIISSSTFVFNQKYNTQGSDVCEPKYQTVSEPIRWKLLMLGLELLFGFFIPLMFMIFCYTFIVKTLVQAQNSKRHKAIRVIIAVVLVFLACQIPHNMVLLVTAANLGKMNRSCQSEKLIGYTKTVTEVLAFLHCCLNPVLYAFIGQKFRNYFLKILKDLWCVRRKYKSSGFSCAGRYSENISRQTSETADNDNASSFTM

SEQ ID NO: 57644 - protein, 374 aa, Homo sapiens; identical to SEQ ID NO: 57643

SEQ ID NO: 57645 - protein, 220 aa, Homo sapiens
MLRLLLALNLFPSIQVTGNKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 57646 - protein, 281 aa, Homo sapiens
MSAQESCLSLIKYFLFVFNLFFFVLGSLIFCFGIWILIDKTSFVSFVGLAFVPLQIWSKVLAISGIFTMGIALLGCVGALKELRCLLGLYFGMLLLLFATQITLGILISTQRAQLERSLRDVVEKTIQKYGTNPEETAAEESWDYVQFQLRCCGWHYPQDWFQVLILRGNGSEAHRVPCSCYNLSATNDSTILDKVILPQLSRLGHLARSRHSADICAVPAESHIYREGCAQGLQKWLHNNLISIVGICLGVGLLELGFMTLSIFLCRNLDHVYNRLARYR

SEQ ID NO: 57647 - protein, 163 aa, Homo sapiens
MKWKALFTAAILQAQLPITEAQSFGLLDPKLCYLLDGILFIYGVILTALFLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 57648 - protein, 164 aa, Homo sapiens
MKWKALFTAAILQAQLPITEAQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 57649 - protein, 495 aa, Homo sapiens
MPMGSLQPLATLYLLGMLVASCLGRLSWYDPDFQARLTRSNSKCQGQLEVYLKDGWHMVCSQSWGRSSKQWEDPSQASKVCQRLNCGVPLSLGPFLVTYTPQSSIICYGQLGSFSNCSHSRNDMCHSLGLTCLEPQKTTPPTTRPPPTTTPEPTAPPRLQLVAQSGGQHCAGVVEFYSGSLGGTISYEAQDKTQDLENFLCNNLQCGSFLKHLPETEAGRAQDPGEPREHQPLPIQWKIQNSSCTSLEHCFRKIKPQKSGRVLALLCSGFQPKVQSRLVGGSSICEGTVEVRQGAQWAALCDSSSARSSLRWEEVCREQQCGSVNSYRVLDAGDPTSRGLFCPHQKLSQCHELWERNSYCKKVFVTCQDPNPAGLAAGTVASIILALVLLVVLLVVCGPLAYKKLVKKFRQKKQRQWIGPTGMNQNMSFHRNHTATVRSHAENPTASHVDNEYSQPPRNSRLSAYPALEGVLHRSSMQPDNSSDSDYDLHGAQRL

SEQ ID NO: 57650 - protein, 668 aa, Homo sapiens
MWLFFGITGLLTAALSGHPSPAPPDQLNTSSAESELWEPGERLPVRLTNGSSSCSGTVEVRLEASWEPACGALWDSRAAEAVCRALGCGGAEAASQLAPPTPELPPPPAAGNTSVAANATLAGAPALLCSGAEWRLCEVVEHACRSDGRRARVTCAENRALRLVDGGGACAGRVEMLEHGEWGSVCDDTWDLEDAHVVCRQLGCGWAVQALPGLHFMPGRGPIHRDQVNCSGAEAYLWDCPGLPGQHYCGHKEDAGVVCSEHQSWRLTGGADRCEGQVEVHFRGVWNTVCDSEWYPSEAKVLCQSLGCGTAVERPKGLPHSLSGRMYYSCNGEELTLSNCSWRFNNSNLCSQSLAARVLCSASRSLHNLSTPEVPASVQTVTIESSVTVKIENKESRELMLLIPSIVLGILLLGSLIFIAFILLRIKGKYALPVMVNHQHLPTTIPAGSNSYQPVPITIPKEVFMLPIQVQAPPPEDSDSGSDSDYEHYDFSAQPPVALTTFYNSQRHRVTDEEVQQSRFQMPPLEEGLEELHASHIPTANPGHCITDPPSLGPQYHPRSNSESSTSSGEDYCNSPKSKLPPWNPQVFSSERSSFLEQPPNLELASTQPAFSAGPPADDSSSTSSGEWYQNFQPPPQPPSEEQFGCPGSPSPQPDSTDNDDYDDISAA

SEQ ID NO: 57651 - protein, 205 aa, Homo sapiens
MSRGLQLLLLSCAYSLAPATPEVKVACSEDVDLPCTAPWDPQVPYTVSWVKLLEGGEERMETPQEDHLRGQHYHQKGQNGSFDAPNERPYSLKIRNTTSCNSGTYRCTLQDPDGQRNLSGKVILRVTGCPAQRKEETFKKYRAEIVLLLALVIFYLTLIIFTCKFARLQSIFPDFSKAGMERAFLPVTSPNKHLGLVTPHKTELV

SEQ ID NO: 57652 - protein, 2997 aa, Homo sapiens
MADPGMMSLFGEDGNIFSEGLEGLGECGYPENPVNPMGQQMPIDQGFASLQPSLHHPSTNQNQTKLTHFDHYNQYEQQKMHLMDQPNRMMSNTPGNGLASPHSQYHTPPVPQVPHGGSGGGQMGVYPGMQNERHGQSFVDSSSMWGPRAVQVPDQIRAPYQQQQPQPQPPQPAPSGPPAQGHPQHMQQMGSYMARGDFSMQQHGQPQQRMSQFSQGQEGLNQGNPFIATSGPGHLSHVPQQSPSMAPSLRHSVQQFHHHPSTALHGESVAHSPRFSPNPPQQGAVRPQTLNFSSRSQTVPSPTINNSGQYSRYPYSNLNQGLVNNTGMNQNLGLTNNTPMNQSVPRYPNAVGFPSNSGQGLMHQQPIHPSGSLNQMNTQTMHPSQPQGTYASPPPMSPMKAMSNPAGTPPPQVRPGSAGIPMEVGSYPNMPHPQPSHQPPGAMGIGQRNMGPRNMQQSRPFIGMSSAPRELTGHMRPNGCPGVGLGDPQAIQERLIPGQQHPGQQPSFQQLPTCPPLQPHPGLHHQSSPPHPHHQPWAQLHPSPQNTPQKVPVHQHSPSEPFLEKPVPDMTQVSGPNAQLVKSDDYLPSIEQQPQQKKKKKKNNHIVAEDPSKGFGKDDFPGGVDNQELNRNSLDGSQEEKKKKKRSKAKKDPKEPKEPKEKKEPKEPKTPKAPKIPKEPKEKKAKTATPKPKSSKKSSNKKPDSEASALKKKVNKGKTEGSENSDLDKTPPPSPPPEEDEDPGVQKRRSSRQVKRKRYTEDLEFKISDEEADDADAAGRDSPSNTSQSEQQESVDAEGPVVEKIMSSRSVKKQKESGEEVEIEEFYVKYKNFSYLHCQWASIEDLEKDKRIQQKIKRFKAKQGQNKFLSEIEDELFNPDYVEVDRIMDFARSTDDRGEPVTHYLVKWCSLPYEDSTWERRQDIDQAKIEEFEKLMSREPETERVERPPADDWKKSESSREYKNNNKLREYQLEGVNWLLFNWYNMRNCILADEMGLGKTIQSITFLYEIYLKGIHGPFLVIAPLSTIPNWEREFRTWTELNVVVYHGSQASRRTIQLYEMYFKDPQGRVIKGSYKFHAIITTFEMILTDCPELRNIPWRCVVIDEAHRLKNRNCKLLEGLKMMDLEHKVLLTGTPLQNTVEELFSLLHFLEPSRFPSETTFMQEFGDLKTEEQVQKLQAILKPMMLRRLKEDVEKNLAPKEETIIEVELTNIQKKYYRAILEKNFTFLSKGGGQANVPNLLNTMMELRKCCNHPYLINGAEEKILEEFKETHNAESPDFQLQAMIQAAGKLVLIDKLLPKLKAGGHRVLIFSQMVRCLDILEDYLIQRRYPYERIDGRVRGNLRQAAIDRFSKPDSDRFVFLLCTRAGGLGINLTAADTCIIFDSDWNPQNDLQAQARCHRIGQSKSVKIYRLITRNSYEREMFDKASLKLGLDKAVLQSMSGRENATNGVQQLSKKEIEDLLRKGAYGALMDEEDEGSKFCEEDIDQILLRRTHTITIESEGKGSTFAKASFVASGNRTDISLDDPNFWQKWAKKAELDIDALNGRNNLVIDTPRVRKQTRLYSAVKEDELMEFSDLESDSEEKPCAKPRRPQDKSQGYARSECFRVEKNLLVYGWGRWTDILSHGRYKRQLTEQDVETICRTILVYCLNHYKGDENIKSFIWDLITPTADGQTRALVNHSGLSAPVPRGRKGKKVKAQSTQPVVQDADWLASCNPDALFQEDSYKKHLKHHCNKVLLRVRMLYYLRQEVIGDQADKILEGADSSEADVWIPEPFHAEVPADWWDKEADKSLLIGVFKHGYEKYNSMRADPALCFLERVGMPDAKAIAAEQRGTDMLADGGDGGEFDREDEDPEYKPTRTPFKDEIDEFANSPSEDKEESMEIHATGKHSESNAELGQLYWPNTSTLTTRLRRLITAYQRSYKRQQMRQEALMKTDRRRRRPREEVRALEAEREAIISEKRQKWTRREEADFYRVVSTFGVIFDPVKQQFDWNQFRAFARLDKKSDESLEKYFSCFVAMCRRVCRMPVKPDDEPPDLSSIIEPITEERASRTLYRIELLRKIREQVLHHPQLGERLKLCQPSLDLPEWWECGRHDRDLLVGAAKHGVSRTDYHILNDPELSFLDAHKNFAQNRGAGNTSSLNPLAVGFVQTPPVISSAHIQDERVLEQAEGKVEEPENPAAKEKCEGKEEEEETDGSGKESKQECEAEASSVKNELKGVEVGADTGSKSISEKGSEEDEEEKLEDDDKSEESSQPEAGAVSRGKNFDEESNASMSTARDETRDGFYMEDGDPSVAQLLHERTFAFSFWPKDRVMINRLDNICEAVLKGKWPVNRRQMFDFQGLIPGYTPTTVDSPLQKRSFAELSMVGQASISGSEDITTSPQLSKEDALNLSVPRQRRRRRRKIEIEAERAAKRRNLMEMVAQLRESQVVSENGQEKVVDLSKASREATSSTSNFSSLSSKFILPNVSTPVSDAFKTQMELLQAGLSRTPTRHLLNGSLVDGEPPMKRRRGRRKNVEGLDLLFMSHKRTSLSAEDAEVTKAFEEDIETPPTRNIPSPGQLDPDTRIPVINLEDGTRLVGEDAPKNKDLVEWLKLHPTYTVDMPSYVPKNADVLFSSFQKPKQKRHRCRNPNKLDINTLTGEERVPVVNKRNGKKMGGAMAPPMKDLPRWLEENPEFAVAPDWTDIVKQSGFVPESMFDRLLTGPVVRGEGASRRGRRPKSEIARAAAAAAAVASTSGINPLLVNSLFAGMDLTSLQNLQNLQSLQLAGLMGFPPGLATAATAGGDAKNPAAVLPLMLPGMAGLPNVFGLGGLLNNPLSAATGNTTTASSQGEPEDSTSKGEEKGNENEDENKDSEKSTDAVSAADSANGSVGAATAPAGLPSNPLAFNPFLLSTMAPGLFYPSMFLPPGLGGLTLPGFPALAGLQNAVGSSEEKAADKAEGGPFKDGETLEGSDAEESLDKTAESSLLEDEIAQGEELDSLDGGDEIENNENDE

SEQ ID NO: 57653 - protein, 1142 aa, Homo sapiens
MRLTGPWKLWLWMSIFLLPASTSVTVRDKTEESCPILRIEGHQLTYDNINKLEVSGFDLGDSFSLRRAFCESDKTCFKLGSALLIRDTIKIFPKGLPEEYSVAAMFRVRRNAKKERWFLWQVLNQQNIPQISIVVDGGKKVVEFMFQATEGDVLNYIFRNRELRPLFDRQWHKLGISIQSQVISLYMDCNLIARRQTDEKDTVDFHGRTVIATRASDGKPVDIELHQLKIYCSANLIAQETCCEISDTKCPEQDGFGNIASSWVTAHASKMSSYLPAKQELKDQCQCIPNKGEAGLPGAPGSPGQKGHKGEPGENGLHGAPGFPGQKGEQGFEGSKGETGEKGEQGEKGDPALAGLNGENGLKGDLGPHGPPGPKGEKGDTGPPGPPALPGSLGIQGPQGPPGKEGQRGRRGKTGPPGKPGPPGPPGPPGIQGIHQTLGGYYNKDNKGNDEHEAGGLKGDKGETGLPGFPGSVGPKGQKGEPGEPFTKGEKGDRGEPGVIGSQGVKGEPGDPGPPGLIGSPGLKGQQGSAGSMGPRGPPGDVGLPGEHGIPGKQGIKGEKGDPGGIIGPPGLPGPKGEAGPPGKSLPGEPGLDGNPGAPGPRGPKGERGLPGVHGSPGDIGPQGIGIPGRTGAQGPAGEPGIQGPRGLPGLPGTPGTPGNDGVPGRDGKPGLPGPPGDPIALPLLGDIGALLKNFCGNCQASVPGLKSNKGEEGGAGEPGKYDSMARKGDIGPRGPPGIPGREGPKGSKGERGYPGIPGEKGDEGLQGIPGIPGAPGPTGPPGLMGRTGHPGPTGAKGEKGSDGPPGKPGPPGPPGIPFNERNGMSSLYKIKGGVNVPSYPGPPGPPGPKGDPGPVGEPGAMGLPGLEGFPGVKGDRGPAGPPGIAGMSGKPGAPGPPGVPGEPGERGPVGDIGFPGPEGPSGKPGINGKDGIPGAQGIMGKPGDRGPKGERGDQGIPGDRGSQGERGKPGLTGMKGAIGPMGPPGNKGSMGSPGHQGPPGSPGIPGIPADAVSFEEIKKYINQEVLRIFEERMAVFLSQLKLPAAMLAAQAYGRPGPPGKDGLPGPPGDPGPQGYRGQKGERGEPGIGLPGSPGLPGTSALGLPGSPGAPGPQGPPGPSGRCNPEDCLYPVSHAHQRTGGN

SEQ ID NO: 57654 - protein, 120 aa, Homo sapiens
MAVTGDDTDEETELAPSHMAAATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 57655 - protein, 108 aa, Homo sapiens
MAVTGDDTAATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 57656 - protein, 112 aa, Homo sapiens
MNRTQELSGQLSAATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 57657 - protein, 95 aa, Homo sapiens
MPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 57658 - protein, 102 aa, Homo sapiens
MAAATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 57659 - protein, 95 aa, Homo sapiens; identical to SEQ ID NO: 57657

SEQ ID NO: 57660 - protein, 299 aa, Homo sapiens
MSKCARKKYIKTNPRQMTMETVESQHDGSITASLTESKSAHVQTQTGQNSIPALAQVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQGLQALTMTNSGAPPPGATIVQYAAQSADGTQQFFVPGSQVVVQAATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 57661 - protein, 236 aa, Homo sapiens
MSKCARKKYIKTNPRQMTMETVESQHDGSITASLTESKSAHVQTQTGQNSIPALAQVAAIAETDESAESEGVIDSHKRREILSRRPSYRKILNELSSDVPGVPKIEEERSEEEGTPPSIATMAVPTSIYQTSTGQYTATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 57662 - protein, 248 aa, Homo sapiens
MSKCARKKYIKTNPRQMTMETVESQHDGSITASLTESKSAHVQTQTGQNSIPALAQVAAIAETDESAESEGVIDSHKRREILSRRPSYRKILNELSSDVPGVPKIEEERSEEEGTPPSIATMAVPTSIYQTSTGQYNEETELAPSHMAAATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 57663 - protein, 516 aa, Homo sapiens
MIEALGVLEPRGSPVPWHDGSLSDLSLTGEEPLPGGSPGGSGSALSAQSTEALEGLSGRGPKAGGRQDEAGTPRRGLGARLQQLLTPSRHSPASRIPPPELPPDLPPPARRSPMDSLLHPRERPGSTASESSASLGSEWDLSESSLSNLSLRRSSERLSDTPGSFQSPSLEILLSSCSLCRACDSLVYDEEIMAGWAPDDSNLNTTCPFCACPFVPLLSVQTLDSRPSVPSPKSAGASGSKDAPVPGGPGPVLSDRRLCLALDEPQLCNGHMGGASRRVESGAWAYLSPLVLRKELESLVENEGSEVLALPELPSAHPIIFWNLLWYFQRLRLPSILPGLVLASCDGPSHSQAPSPWLTPDPASVQVRLLWDVLTPDPNSCPPLYVLWRVHSQIPQRVVWPGPVPASLSLALLESVLRHVGLNEVHKAVGLLLETLGPPPTGLHLQRGIYREILFLTMAALGKDHVDIVAFDKKYKSAFNKLASSMGKEELRHRRAQMPTPKAIDCRKCFGAPPEC

SEQ ID NO: 57664 - protein, 516 aa, Homo sapiens; identical to SEQ ID NO: 57663

SEQ ID NO: 57665 - protein, 314 aa, Homo sapiens
MGLEAARELECAALGTLLRDPREAERTLLLDCRPFLAFCRRHVRAARPVPWNALLRRRARGPPAAVLACLLPDRALRTRLVRGELARAVVLDEGSASVAELRPDSPAHVLLAALLHETRAGPTAVYFLRGGFDGFQGCCPDLCSEAPAPALPPTGDKTSRSDSRAPVYDQGGPVEILPYLFLGSCSHSSDLQGLQACGITAVLNVSASCPNHFEGLFRYKSIPVEDNQMVEISAWFQEAIGFIDWVKNSGGRVLVHCQAGISRSATICLAYLMQSRRVRLDEAFDFVKQRRGVISPNFSFMGQLLQFETQVLCH

SEQ ID NO: 57666 - protein, 361 aa, Homo sapiens [sequence omitted]

SEQ ID NO: 57667 - protein, 183 aa, Homo sapiens
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTGQFPMVPSGLTPQPAQDWYLLDDDPRLLTLSASSKVPVTLAAV

SEQ ID NO: 57668 - protein, 390 aa, Homo sapiens
MDFWLWPLYFLPVSGALRILPEVKVEGELGGSVTIKCPLPEMHVRIYLCREMAGSGTCGTVVSTTNFIKAEYKGRVTLKQYPRKNLFLVEVTQLTESDSGVYACGAGMNTDRGKTQKVTLNVHSEYEPSWEEQPMPETPKWFHLPYLFQMPAYASSSKFVTRVTTPAQRGKVPPVHHSSPTTQITHRPRVSRASSVAGDKPRTFLPSTTASKISALEGLLKPQTPSYNHHTRLHRQRALDYGSQSGREGQGFHILIPTILGLFLLALLGLVVKRAVERRKALSRRARRLAVRMRALESSQRPRGSPRPRSQNNIYSACPRRARGADAAGTGEAPVPGPGAPLPPAPLQVSESPWLHAPSLKTSCEYVSLYHQPAAMMEDSDSDDYINVPA

SEQ ID NO: 57669 - protein, 429 aa, Homo sapiens
MLPRLLLLICAPLCEPAELFLIASPSHPTEGSPVTLTCKMPFLQSSDAQFQFCFFRDTRALGPGWSSSPKLQIAAMWKEDTGSYWCEAQTMASKVLRSRRSQINVHRVPVADVSLETQPPGGQVMEGDRLVLICSVAMGTGDITFLWYKGAVGLNLQSKTQRSLTAEYEIPSVRESDAEQYYCVAENGYGPSPSGLVSITVRIPVSRPILMLRAPRAQAAVEDVLELHCEALRGSPPILYWFYHEDITLGSRSAPSGGGASFNLSLTEEHSGNYSCEANNGLGAQRSEAVTLNFTVPTGARSNHLTSGVIEGLLSTLGPATVALLFCYGLKRKIGRRSARDPLRSLPSPLPQEFTYLNSPTPGQLQPIYENVNVVSGDEVYSLAYYNQPEQESVAAETLGTHMEDKVSLDIYSRLRKANITDVDYEDAM

SEQ ID NO: 57670 - protein, 211 aa, Homo sapiens
MRLFLWNAVLTLFVTSLIGALIPEPEVKIEVLQKPFICHRKTKGGDLMLVHYEGYLEKDGSLFHSTHKHNNGQPIWFTLGILEALKGWDQGLKGMCVGEKRKLIIPPALGYGKEGKGKIPPESTLIFNIDLLEIRNGPRSHESFQEMDLNDDWKLSKDEVKAYLKKEFEKHGAVVNESHHDALVEDIFDKEDEDKDGFISAREFTYKHDEL

SEQ ID NO: 57671 - protein, 314 aa, Homo sapiens
MSAAEAGGVFHRARGRTLDAFPAEKESEWKGPFYFILGADPQFGLIKAWSTGDCDNGGDEWEQEIRLTEQAVQAINELNPKPKFFVLCGDLIHAMPGKPWRTEQTEDLKRVLRAVDRAIPLVLVSGNHDIGNTPTAETVEEFCRTWGDDYFSFWVGGVLFLVLNSQFYENPSKCPSLKQAQDQWLDEQLSIARQRHCQHAIVFQHIPLFLESIDEDDDYYFNLSKSTRKELADKFIHAGVRVVFSGHYHRNAGGTYQNLDMVVSSAIGCQLGRDPHGLRVVVVTAEKIVHRYYSLDELSEKGIEDDLMDLIKKK

SEQ ID NO: 57672 - protein, 194 aa, Homo sapiens [sequence omitted]

SEQ ID NO: 57673 - protein, 194 aa, Homo sapiens [sequence omitted]

SEQ ID NO: 57674 - protein, 194 aa, Homo sapiens [sequence omitted]

SEQ ID NO: 57675 - protein, 89 aa, Homo sapiens
MEPAMEPETLEARINRATNPLNKELDWASINGFCEQLNEDFEGPPLATRLLAHKIQSPQEWEAIQALTVRRGEATIRPPPCDDTKGGQD

SEQ ID NO: 57676 - protein, 380 aa, Homo sapiens
MCPMLLKNGYNGNATPVTTTAPWASLGLSAKTCNNVSFEESRIVLVVVYSAVCTLGVPANCLTAWLALLQVLQGNVLAVYLLCLALCELLYTGTLPLWVIYIRNQHRWTLGLLACKVTAYIFFCNIYVSILFLCCISCDRFVAVVYALESRGRRRRRTAILISACIFILVGIVHYPVFQTEDKETCFDMLQMDSRIAGYYYARFTVGFAIPLSIIAFTNHRIFRSIKQSMGLSAAQKAKVKHSAIAVVVIFLVCFAPYHLVLLVKAAAFSYYRGDRNAMCGLEERLYTASVVFLCLSTVNGVADPIIYVLATDHSRQEVSRIHKGWKEWSMKTDVTRLTHSRDTEELQSPVALADHYTFSRPVHPPGSPCPAKRLIEESC

SEQ ID NO: 57677 - protein, 395 aa, Homo sapiens
MTLRRLRKLQQKEEAAATPDPAARTPDSEVAPAAPVPTPGPPAAAATPGPPADELYAALEDYHPAELYRALAVSGGTLPRRKGSGFRWKNLSQSPEQQRKVLTLEKEDNQTFGFEIQTYGLHHREEQRVEMVTFVCRVHESSPAQLAGLTPGDTIASVNGLNVEGIRHREIVDIIKASGNVLRLETLYGTSIRKAELEARLQYLKQTLYEKWGEYRSLMVQEQRLVHGLVVKDPSIYDTLESVRSCLYGAGLLPGSLPFGPLLAVPGRPRGGARRARGDADDAVYHTCFFGDSEPPALPPPPPPARAFGPGPAETPAVGPGPGPRAALSRSASVRCAGPGGGGGGGAPGALWTEAREQALCGPGLRKTKYRSFRRRLLKFIPGLNRSLEEEESQL

SEQ ID NO: 57678 - protein, 264 aa, Homo sapiens
MTKFSSFSLFFLIVGAYMTHVCFNMEIIGGKEVSPHSRPFMASIQYGGHHVCGGVLIDPQWVLTAAHCQYRFTKGQSPTVVLGAHSLSKNEASKQTLEIKKFIPFSRVTSDPQSNDIMLVKLQTAAKLNKHVKMLHIRSKTSLRSGTKCKVTGWGATDPDSLRPSDTLREVTVTVLSRKLCNSQSYYNGDPFITKDMVCAGDAKGQKDSCKGDSGGPLICKGVFHAIVSGGHECGVATKPGIYTLLTKKYQTWIKSNLVPPHTN

SEQ ID NO: 57679 - protein, 478 aa, Homo sapiens
MLLWVQQALLALLLPTLLAQGEARRSRNTTRPALLRLSDYLLTNYRKGVRPVRDWRKPTTVSIDVIVYAILNVDEKNQVLTTYIWYRQYWTDEFLQWNPEDFDNITKLSIPTDSIWVPDILINEFVDVGKSPNIPYVYIRHQGEVQNYKPLQVVTACSLDIYNFPFDVQNCSLTFTSWLHTIQDINISLWRLPEKVKSDRSVFMNQGEWELLGVLPYFREFSMESSNYYAEMKFYVVIRRRPLFYVVSLLLPSIFLMVMDIVGFYLPPNSGERVSFKITLLLGYSVFLIIVSDTLPATAIGTPLIGVYFVVCMALLVISLAETIFIVRLVHKQDLQQPVPAWLRHLVLERIAWLLCLREQSTSQRPPATSQATKTDDCSAMGNHCSHMGGPQDFEKSPRDRCSPPPPPREASLAVCGLLQELSSIRQFLEKRDEIREVARDWLRVGSVLDKLLFHIYLLAVLAYSITLVMLWSIWQYA

SEQ ID NO: 57680 - protein, 510 aa, Homo sapiens
MLLWVQQALLALLLPTLLAQGEARRSRNTTRPALLRLSDYLLTNYRKGVRPVRDWRKPTTVSIDVIVYAILNVDEKNQVLTTYIWYRQYWTDEFLQWNPEDFDNITKLSIPTDSIWVPDILINEFVDVGKSPNIPYVYIRHQGEVQNYKPLQVVTACSLDIYNFPFDVQNCSLTFTSWLHTIQDINISLWRLPEKVKSDRSVFMNQGEWELLGVLPYFREFSMESSNYYAEMKFYVVIRRRPLFYVVSLLLPSIFLMVMDIVGFYLPPNSGERVSFKITLLLGYSVFLIIVSDTLPATAIGTPLIGKAPPGSRAQSGEKPAPSHLLHVSLASALGCTGVYFVVCMALLVISLAETIFIVRLVHKQDLQQPVPAWLRHLVLERIAWLLCLREQSTSQRPPATSQATKTDDCSAMGNHCSHMGGPQDFEKSPRDRCSPPPPPREASLAVCGLLQELSSIRQFLEKRDEIREVARDWLRVGSVLDKLLFHIYLLAVLAYSITLVMLWSIWQYA

SEQ ID NO: 57681 - protein, 199 aa, Homo sapiens
MKSGLWYFFLFCLRIKVLTGEINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKFWLPIGCAAFVVVCILGCILICWLTKKKYSSSVHDPNGEYMFMRAVNTAKKSRLTDVTL

SEQ ID NO: 57682 - protein, 538 aa, Homo sapiens
MPRGWAAPLLLLLLQGGWGCPDLVCYTDYLQTVICILEMWNLHPSTLTLTWQDQYEELKDEATSCSLHRSAHNATHATYTCHMDVFHFMADDIFSVNITDQSGNYSQECGSFLLAESIKPAPPFNVTVTFSGQYNISWRSDYEDPAFYMLKGKLQYELQYRNRGDPWAVSPRRKLISVDSRSVSLLPLEFRKDSSYELQVRAGPMPGSSYQGTWSEWSDPVIFQTQSEELKEGWNPHLLLLLLLVIVFIPAFWSLKTHPLWRLWKKIWAVPSPERFFMPLYKGCSGDFKKWVGAPFTGSSLELGPWSPEVPSTLEVYSCHPPRSPAKRLQLTELQEPAELVESDGVPKPSFWPTAQNSGGSAYSEERDRPYGLVSIDTVTVLDAEGPCTWPCSCEDDGYPALDLDAGLEPSPGLEDPLLDAGTTVLSCGCVSAGSPGLGGPLGSLLDRLKPPLADGEDWAGGLPWGGRSPGGVSESEAGSPLAGLDMDTFDSGFVGSDCSSPVECDFTSPGDEGPPRSYLRQWVVIPPPLSSPGPQAS

SEQ ID NO: 57683 - protein, 538 aa, Homo sapiens; identical to SEQ ID NO: 57682

SEQ ID NO: 57684 - protein, 538 aa, Homo sapiens; identical to SEQ ID NO: 57682

SEQ ID NO: 57685 - protein, 551 aa, Homo sapiens
MAAPALSWRLPLLILLLPLATSWASAAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDTIPWLGHLLVGLSGAFGFIILVYLLINCRNTGPWLKKVLKCNTPDPSKFFSQLSSEHGGDVQKWLSSPFPSSSFSPGGLAPEISPLEVLERDKVTQLLLQQDKVPEPASLSSNHSLTSCFTNQGYFFFHLPDALEIEACQVYFTYDPYSEEDPDEGVAGAPTGSSPQPLQPLSGEDDAYCTFPSRDDLLLFSPSLLGGPSPPSTAPGGSGAGEERMPPSLQERVPRDWDPQPLGPPTPGVPDLVDFQPPPELVLREAGEEVPDAGPREGVSFPWSRPPGQGEFRALNARLPLNTDAYLSLQELQGQDPTHLV

SEQ ID NO: 57686 - protein, 227 aa, Homo sapiens
MGWLCSGLLFPVSCLVLLQVASSGNMKVLQEPTCVSDYMSISTCEWKMNGPTNCSTELRLLYQLVFLLSEAHTCIPENNGGAGCVCHLLMDDVVSADNYTLDLWAGQQLLWKGSFKPSEHVKPRAPGNLTVHTNVSDTLLLTWSNPYPPDNYLYNHLTYAVNIWSENDPADFRIYNVTYLEPSLRIAASTLKSGISYRARVRAWAQCYNTTWSEWSPSTKWHNSNIC

SEQ ID NO: 57687 - protein, 540 aa, Homo sapiens
MSRQFTYKSGAAAKGGFSGCSAVLSGGSSSSYRAGGKGLSGGFSSRSLYSLGGARSISFNVASGSGWAGGYGFGRGRASGFAGSMFGSVALGSVCPSLCPPGGIHQVTINKSLLAPLNVELDPEIQKVRAQEREQIKVLNNKFASFIDKVRFLEQQNQVLETKWELLQQLDLNNCKNNLEPILEGYISNLRKQLETLSGDRVRLDSELRSVREVVEDYKKRYEEEINKRTTAENEFVVLKKDVDAAYTSKVELQAKVDALDGEIKFFKCLYEGETAQIQSHISDTSIILSMDNNRNLDLDSIIAEVRAQYEEIARKSKAEAEALYQTKFQELQLAAGRHGDDLKHTKNEISELTRLIQRLRSEIESVKKQCANLETAIADAEQRGDCALKDARAKLDELEGALQQAKEELARMLREYQELLSVKLSLDIEIATYRKLLEGEECRMSGEYTNSVSISVINSSMAGMAGTGAGFGFSNAGTYGYWPSSVSGGYSMLPGGCVTGSGNCSPRGEARTRLGSASEFRDSQGKTLALSSPTKKTMR

SEQ ID NO: 57688 - protein, 348 aa, Homo sapiens
MSLMVVSMACVGFFLLQGAWPHEGVHRKPSLLAHPGRLVKSEETVILQCWSDVRFEHFLLHREGKFKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHECRFSAGPKVNGTFQADFPLGPATHGGTYRCFGSFRDSPYEWSNSSDPLLVSVIGNPSNSWPSPTEPSSKTGNPRHLHILIGTSVVIILFILLFFLLHRWCSNKKNAAVMDQESAGNRTANSEDSDEQDPQEVTYTQLNHCVFTQRKITRPSQRPKTPPTDIIVYAELPNAESRSKVVSCP

SEQ ID NO: 57689 - protein, 243 aa, Homo sapiens
MSLMVVSMVCVGFFLLQGAWPHEGVHRKPSLLAHPGPLVKSEETVILQCWSDVRFQHFLLHREGKFKDTLHLIGEHHDGVSKANFSIGPMMQDLAGTYRCYGSVTHSPYQLSAPSDPLLVSVTGNPSNSWPSPTEPSSETGNPRHLHVLIGTSVVIILFILLLFFLLHRWCCNKKNAVVMDQEPAGNRTVNREDSDEQDPQEVTYAQLNHCVFTQRKITRPSQRPKTPPTDIIVYTELPNAEP

SEQ ID NO: 57690 - protein, 341 aa, Homo sapiens
MSLMVVSMVCVGFFLLQGAWPHEGVHRKPSLLAHPGPLVKSEETVILQCWSDVRFQHFLLHREGKFKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHERRFSAGPKVNGTFQADFPLGPATHGGTYRCFGSFRDSPYEWSNSSDPLLVSVTGNPSNSWPSPTEPSSETGNPRHLHVLIGTSVVIILFILLLFFLLHRWCCNKKNAVVMDQEPAGNRTVNREDSDEQDPQEVTYAQLNHCVFTQRKITRPSQRPKTPPTDIIVYTELPNAEP

SEQ ID NO: 57691 - protein, 377 aa, Homo sapiens
MSMSPTVIILACLGFFLDQSVWAHVGGQDKPFCSAWPSAVVPQGGHVTLRCHYRRGFNIFTLYKKDGVPVPELYNRIFWNSFLISPVTPAHAGTYRCRGFHPHSPTEWSAPSNPLVIMVTGLYEKPSLTARPGPTVRTGENVTLSCSSQSSFDIYHLSREGEAHELRLPAVPSINGTFQADFPLGPATHGETYRCFGSFHGSPYEWSDASDPLPVSVTGNPSSSWPSPTEPSFKTGIARHLHAVIRYSVAIILFTILPFFLLHRWCSKKKNAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 57692 - protein, 375 aa, Homo sapiens
MSLMVISMACVGFFLLQGAWTHEGGQDKPLLSAWPSAVVPRGGHVTLLCRSRLGFTIFSLYKEDGVPVPELYNKIFWKSILMGPVTPAHAGTYRCRGSHPRSPIEWSAPSNPLVIVVTGLFGKPSLSAQPGPTVRTGENVTLSCSSRSSFDMYHLSREGRAHEPRLPAVPSVNGTFQADFPLGPATHGGTYTCFGSLHDSPYEWSDPSDPLLVSVTGNSSSSSSSPTEPSSKTGIRRHLHILIGTSVAIILFIILFFFLLHCCCSNKKNAAVMDQEPAGDRTVNREDSDDQDPQEVTYAQLDHCVFTQTKITSPSQRPKTPPTDTTMYMELPNAKPRSLSPAHKHHSQALRGSSRETTALSQNRVASSHVPAAGI

SEQ ID NO: 57693 - protein, 375 aa, Homo sapiens
MSLMVISMACVGFFLLQGAWTHEGGQDKPLLSAWPSAVVPRGGHVTLLCRSRLGFTIFSLYKEDGVPVPELYNKIFWKSILMGPVTPAHAGTYRCRGSHPRSPIEWSAPSNPLVIVVTGLFGKPSLSAQPGPTVRTGENVALSCSSRSSFDMYHLSREGRAHEPRLPAVPSVDGTFQADFPLGPATHGGTYTCFSSLHDSPYEWSDPSDPLLVSVTGNSSSSSSSPTEPSSKTGIRRHLHILIGTSVAIILFIILFFFLLHCCCSNKKNAAVMDQGPAGDRTVNREDSDDQDPQEVTYAQLDHCVFTQTKITSPSQRPKAPPTDTTMYMELPNAKPRSLSPAHKHHSQALRGSSRETTALSQNRVASSHVPAAGI

SEQ ID NO: 57694 - protein, 304 aa, Homo sapiens
MSLMVVSMACVGFFLLQGAWPHEGVHRKPSLLAHPGPLVKSEETVILQCWSDVRFEHFLLHREGKYKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHERRFSAGPKVNGTFQADFPLGPATHGGTYRCFGSFRDSPYEWSNSSDPLLVSVTGNPSNSWPSPTEPSSKTGNPRHLHVLIGTSVVKIPFTILLFFLLHRWCSNKKNAAVMDQEPAGNRTVNSEDSDEQDHQEVSYA

SEQ ID NO: 57695 - protein, 304 aa, Homo sapiens
MSLMVISMACVGFFWLQGAWPHEGFRRKPSLLAHPGRLVKSEETVILQCWSDVMFEHFLLHREGTFNDTLRLIGEHIDGVSKANFSIGRMRQDLAGTYRCYGSVPHSPYQFSAPSDPLDIVITGLYEKPSLSAQPGPTVLAGESVTLSCSSWSSYDMYHLSTEGEAHERRFSAGPKVNGTFQADFPLGPATQGGTYRCFGSFHDSPYEWSKSSDPLLVSVTGNPSNSWPSPTEPSSKTGNPRHLHVLIGTSVVKLPFTILLFFLLHRWCSDKKNASVMDQGPAGNRTVNREDSDEQDHQEVSYA

SEQ ID NO: 57696 - protein, 239 aa, Homo sapiens
MSLMVIIMACVGFFLLQGAWPQEGVHRKPSFLALPGHLVKSEETVILQCWSDVMFEHFLLHREGKFNNTLHLIGEHHDGVSKANFSIGPMMPVLAGTYRCYGSVPHSPYQLSAPSDPLDMVIIGLYEKPSLSAQPGPTVQAGENVTLSCSSIYPGKGRPMNVGSLQCAASTEHSRPTFLWALPPTEGPTDASALSVTLPTSGQTRVIHCLFPSQETLQIVGLHPLNQAPKPVTPDTYMF

SEQ ID NO: 57697 - protein, 232 aa, Homo sapiens
MACVGFFLLQGAWPQEGVHRKPSFLALPGHLVKSEETVILQCWSDVMFEHFLLHREGKFNNTLHLIGEHHDGVSKANFSIGPMMPVLAGTYRCYGSVPHSPYQLSAPSDPLDMVIIGLYEKPSLSAQPGPTVQAGENVTLSCSSIYPGKGRPMNVGSLQCAASTEHSRPTFLWALPPTEGPTDASALSVTLPTSGQTRVIHCLFPSQETLQIVGLHPLNQAPKPVTPDTYMF

SEQ ID NO: 57698 - protein, 444 aa, Homo sapiens
MLLMVVSMACVGFFLVQRAGPHVGGQDKPFLSAWPSAVVPRGGHVTLRCHYRHRFNNFMLYKEDRIHVPIFHGRLFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTPYQLSAPSDPLDIVVTGPYEKPSLSAQPGPKVQAGESVTLSCSSRSSYDMYHLSRERGAHERRLPAVRKVNRTFQADFPLGPATHGGTYRCFGSFRHSPYEWSDPSDPLLVSVTGNPSSSWPSPTEPSSKSGNPRHLHILIGTSVVIILFILLLFFLLHLWCSNKKNAAVMDQEPAGNRTANSEDSDEQDPEEVTYAQLDHCVFTQRKITRPSQRPKTPPTDTILYTELPNAKPRSKVVSCP

SEQ ID NO: 57699 - protein, 455 aa, Homo sapiens
MSLTVVSMACVGFFLLQGAWPLMGGQDKPFLSARPSTVVPRGGHVALQCHYRRGFNNFMLYKEDRSHVPIFHGRIFQESFIMGPVTPAHAGTYRCRGSRPHSLTGWSAPSNPLVIMVTGNHRKPSLLAHPGPLLKSGETVILQCWSDVMFEHFFLHRDGISEDPSRLVGQIHDGVSKANFSIGPLMPVLAGTYRCYGSVPHSPYQLSAPSDPLDIVITGLYEKPSLSAQPGPTVQAGENVTLSCSSWSSYDIYHLSREGEAHERRLRAVPKVNRTFQADFPLGPATHGGTYRCFGSFRALPCVWSNSSDPLLVSVTGNPSSSWPSPTEPSSKSGICRHLHVLIGTSVVIFLFILLLFFLLYRWCSNKKNAAVMDQEPAGDRTVNRQDSDEQDPQEVTYAQLDHCVFIQRKISRPSQRPKTPLTDTSVYTELPNAEPRSKVVSCPRAPQSGLEGVF

SEQ ID NO: 57700 - protein, 1995 aa, Homo sapiens
MADYALLEDCPYVDDCVFAAEFMTDDYVRVTQLYCDGVGKQYKDYVQSERNLEFDICSIWCSKPISVLQDYCDAIKINIFWPLLFQHQNSSVISRLHPCVDANNSRASEINLKRLQHLELMEDIVDLAKKAANDSLLIGGLLRIGYKIENKILAMEEALNWIKYAGDVTILTKLGSIDNCWPMLSIFFTEYKYHITKIVMEDCNLLEELKTQSCMDCIEQGELMKMKGNEEFSKERFDIAIIYYTRAIEYRPENHLLYGNRALCFLRTGQFRNALGDGKRATILKNTWPKGHYRYCDALSMLGEYNWALQANITAQKLCKNDPEGIKDLIQQHVKLQKQIEDLQGRTANKNPIKAFYENRAYTPRSLSAPVFSTSLNFVEKERDFRKINHEMANGGNQNLKVMDEALMVDDCDCHPEFSPPSSQPPKHKGKQKSRNNESEKFSSSSQLTLPADLKNILEKQFSKSSRGAHQDFANIMTMLRSLIQDGYTALLEQRCRSAAHAFTELLNGLDPQKIKQLNLAMINYVLVVYGLAISLLGIGQPEELSEAENQFKRIIEHYHNEGLDCLAYCGIGKVYLKKNRFLEALNHFEKARTLIYRLPGVLTWPTSNVIIEESQPEKIKMLLEKFVEECKFPPVPDAICCYQKCCGYSKIQIYITDPDFKGFIRISCCQYCKIEFHMNCWKKLKTTTFNDKIDKDFLQGICLTPDCEGVISKIIIFSSGGQVKCEFEHKVIKEKVPPRPILKQKCSSLEKLRLKEDKKLKRKIQKKEAKKLAQERMEEDLRESNPPKNEEQKETVDNVQHCQFLDDRILQCIKQYADKIKSGIWNTATLLKELLSWKVLSTEDYTTCFSSRNFLNEAVDYVIRHLIQEKNRVKTRIFLHVLSELKEVEPKLAAWIRKLNSFGLDATGPFFSRYEASLKQLDFSIMTFLWNEKYGHKLDSIEGKQLDYFFEPTSSKEARCLIWLLEEHRDKFPALHSALDEFFDIMDSRCTVLRKQDSGEAPFSSTKVKNKGKKKKPKDSKPMLVGSGTTSVTPNNEIITSSEDHSNQNSDTAGPFAVPDHLRQDVEEFEALYDQHSNEYVVRNKKLWDMNPKQKCSTLYDYFSQLLEEHGPLDMSHKMFSEEYEFFPEETRPILEKAGGLKSFLLGCPRFVVIDNCIALKKVASRLKKKRKKKNIKTKVEDISKAGEYLQVKLPLNSAAREFKPDVKSKPVSGSSSAPASEDVKPKPLSANSPKPACEDVKAKPVSDNSSRQVSEDGKPKGFSSNSPKPGSEDANYKRVSSNSPKPVLEDVKPTYWAQSHLVTGYCTYLPFQRFDNTRTSPAYINVLPGLPQYTSIYTPLVSLSPEYQLPRSVPVVPSFVANDRADKNATAYFEGHHLNAENAAGHQIASETQILEDSSLISVKSQCSTGDAHTVLSESNRKDGHCGNSNNKCEVIPESTSAVTNIPQVQMVAIQVSWNITHQEVNTEPYNPFEKQQGEISRIEKEYQVLQDQLKEAYENYEQIKLKGLEETRDLEEKLKRHLEENKISKTELDWLLQDLEREIKKWQEEKKEIQKTLKSLKKKIKKVSNANEMYTQKNDGNDKEHELHLDQSLEISNTLTNEKMKIEECIKKGKKDYEESHQRAVAAEVSVLENWKESEVYKLQIMQSQAEAYLKKLELISHDPAAYPDMESDICSWELFLSNVTKETEKAKYQFEEQIKAIKNGSRLSELSKVQISELSFPACNTVHPELLPESSGHDDQGFMTSASDVTGNQAALHRDPSVFSAGDSPGEAPSALLPGPPPSQPEATQLPGPKGAGQAALSEQSPAADQKQPVPPGCAACSSQSPKKPFNSIIEHLSVVFPCYNSTELAGFIKKVRSKNKNSLSGLSIDEIVQRVTEHILDEQKKKKPNPGKDKRTYEPSSAAHVTRSSQGPPLAVVAPSPKTKGQKAEDVPVRVALGASSCEICHEVFKSKNVRVLKCGHKYHKGCFKQWLKGQSACPACQTCDLLSEE

SEQ ID NO: 57701 - protein, 249 aa, Homo sapiens
MDEERSSMLPTMAAGPNSILFAINIDNKDLNGQSKFAPTVSDLLKESTQNVTLLKESTQGVSSVFREITASSAISILIKPEQETDPLPVVSRNVSADAKCKKERKKKKQVTNIISFDDEEDEQNSGDMFKKTPGAGESSEDNSDHSSVNIMSAFESPFGPNSNGSQSSNSWKIDSLSLNREFGYQKLDVKSIDDEDVDENEDDVYGNSSGRKHRGHSESPEKNGAHSVTQAGVQWHDLGSLQPLPPGFR

SEQ ID NO: 57702 - protein, 73 aa, Homo sapiens [sequence omitted]

SEQ ID NO: 57703 - protein, 218 aa, Homo sapiens
MTLGSITVPPGTGTDYKKLFGSGTTLVVTDKQLDADVSPKPTIFLPSIAETKLQKAGTYLCLLEKFFPDIIKIHWQEKKSNTILGSQEGNTMKTNDTYMKFSWLTVPEESLDKEHRCIVRHENNKNGIDQEIIFPPIKTDVTTVDPKYNYSKDANDVITMDPKDNWSKDANDTLLLQLTNTSAYYMYLLLLLKSVVYFAIITCCLLRRTAFCCNGEKS

SEQ ID NO: 57704 - protein, 105 aa, Homo sapiens
MRRPGFSGPGQRCTCGPAGPRAAAAGPEAGDEGAAAAAAAHQAALQRDPGAEPPCPPRLLPPQVRLRERRGETEARRGPRPRGGVSCLAGVASIRPQSRLRVSRS

SEQ ID NO: 57705 - protein, 73 aa, Homo sapiens [sequence omitted]

SEQ ID NO: 57706 - protein, 68 aa, Homo sapiens
MAAPHMGGPPMMPMMGPPPPGMMPVGPAPGMRPPMGGHMPMMPGCPMMRPPAHLMMVPSQPRMTRPDR

SEQ ID NO: 57707 - protein, 961 aa, Homo sapiens
MGCFTRGKDIASPATGKTGPVHPGFPMPSRCVSTTPVPRTRQRPRPPGPPGATAPAKRAGALCKSRGPPQGTQSTGRCQERQEPTKPTSKASNSSKKTPASALRWSSRTDRLDPVFWAQPKPPPPYPGLLKRALPNGAGRFLSKALSPEIRPPPLVPARGKTGPPPDPLHPTPSCPPGRVLVGTSDRGGGVVRERPRAAGPAVRLRPALTALGGWGKRGPRRSPCAARDPKRCLRDRAEDRRASQDRGPWALTPRSTPCSERARCGGSSGAREPGEGRGPAARGSPIRAPRPRAGGSPCYPTSPDSAPPLPPTYTPAAAAAGVLLLGVRPYCTPARQQHPTASASPPPRQEPGSSLGGQGAGPQRRSRWVPCRSRCLPAPGTPRRFNSPIGRRRRTLPNRGKGRAGAAGATDASQDVGSGTHGLLYPGEGHCFASHRENRPCAPGIPNAPRFVSTTPVPRTRQRPRPPGPPGATAPAKRAGALCKSRGPPQGTQSTGSCQERQEPTKPTSKASNSSKKTPASALRWSSRTDRLAPVFWAQPKPPPPYPDLLKTALSPEIRPPPLVPARGKTGPPPDPLHPTPSCPPGRVLVGTSDRGGGVVRERPRAAGPAVRLRPALTALGGWGKRGPRRSPCAARDPKRCLRDRAEDRRASQDRGPWALTPRSTPCSERARCGGSSGARELGEGRGPAARGSPIRAPRPRAGGVGCNPAGTAGPGWALGAASRSRGPPAGGPPLLHAGPAAASHRFRLAAAPPGARLQPGRAGGRTPKAQPLGSLPFAVPSRSRNAQAIQFTHRAPSSHPSKPGEGAGRGSGCHRRQPRRRLRNAWAALPGGRTLLRQPPGKQALCTRDSQCPPLRVDDSSPEDSPETQASGPARCHGSRQTGGRALQISGPAARHPEHREVPRKAGAYETHLQSKQFIQENARLSAPLVLSHGPPGPRVLGAAQAPSTLSRPAQEGAA

SEQ ID NO: 57708 - protein, 1995 aa, Homo sapiens; identical to SEQ ID NO: 57700

SEQ ID NO: 57709 - protein, 68 aa, Homo sapiens; identical to SEQ ID NO: 57706

SEQ ID NO: 57710 - protein, 673 aa, Homo sapiens
MKRHLRKPGDAGLFRLQVPPSLPFGRRTSQPHRWAAQHDETGSSRNTTPQITKVQARIPCRSRCLPAPGSTRQFNSLIRRSRNLINRGKGRAGAAGTTDASQDLRSRTHGLLYPGGRTLLRQPPGKQSLCTRIPIAPHFVSTPVPRTRQRPRPPDAPGTTAPAKRAGALCKSRGPLHRTKSTVRYQEHSEVPRKNGAYETHLQSKQFIQEKTRLSAPLVLSHGPPGRPAQAQLKPLHPIPALSPEIRPPPLVPARGKTGPPPDPLHPTPSCPPGRVLVGTSDRGGGVVRERPRAAGPAVRLRPALTALGGWGKRGPRRSPCAARDPKRCLRDRAEDRRASQDRGPWALTPRSTPCSERARCGGSSGAREPGEGRGPAARGSPIRAPRPRAGDQAAASSASPGQNRATPRPATPHALLPPRPGLGRDKRPWWGRCERKAPRGWAGCSPSASPDGSGWVGQEGASQEPLCGEGSKTLPPRQGGGPEGVPGSWALGPDTSELLSSWDPKRQKRSLAPPSARPALPAGFQLSPPAQGRGARIVDPRAARPRPSRGSRAPGILPHPARSEQGVLRGVTAQGPRSWDPFHSSALSRMYRFGSLAAQKILRGPILPQPTRAVKAGPRTNSRPSLAGVFLTTPPQRSLVPTKTRSIGKRAWAIAVQGLALLCPGLALEAAA

SEQ ID NO: 57711 - protein, 105 aa, Homo sapiens; identical to SEQ ID NO: 57704

SEQ ID NO: 57712 - protein, 91 aa, Homo sapiens [sequence omitted]

SEQ ID NO: 57713 - protein, 68 aa, Homo sapiens
MVNGPLACLQYSCAFLMALPLPCQLSASESEGSRNEENLQELPRTVTCLIPCSHPCSMNKITLWLREA

SEQ ID NO: 57714 - protein, 70 aa, Homo sapiens
MVSRDYLAGLEQREENIVKDCCEVYHNCVQLSASESEGSRNEENLQELPRTVTCLIPCSHPCSMNKVDTH

SEQ ID NO: 57715 - protein, 47 aa, Homo sapiens
MLSDHLQLSASESEGSRNEENLQELPRTVTCLIPCSHPCSMNKVDTH

SEQ ID NO: 57716 - protein, 118 aa, Homo sapiens
MEPVQEAEKTNFQNHKGHEFIPTLYHFPANCDACAKPLWHVFKPPPALECQRRHVKCHRDHLDKKEDLICPCKVSYDVTSARDMLLLACSQDEQKKWVTHLVKKIPKNPPSGFVRASP

SEQ ID NO: 57717 - protein, 390 aa, Homo sapiens
MACVGFFLDQSVWAHVGGQDKPFCSAWPSAVVPQGGHVTLRCHYRRGFNIFTLYKKDGVPVPELYNRIFWNSFLISPVTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTGNPSSSWPSPTEPSFKTGIARHLHAVIRYSVAIILFTILPFFLLHRWCSKKKVSLTKQRPENSGPCAEAGWEHADAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 57718 - protein, 91 aa, Homo sapiens
MPKQVVWHGHWPAALSKQVAQIPPTWTFSSGAAPATLSHWVCDSPLHLSILHHFPSRKTDGRKPSVTLLLRRSISGTDIICLVSVNSKESS

SEQ ID NO: 57719 - protein, 68 aa, Homo sapiens; identical to SEQ ID NO: 57713

SEQ ID NO: 57720 - protein, 70 aa, Homo sapiens; identical to SEQ ID NO: 57714

SEQ ID NO: 57721 - protein, 47 aa, Homo sapiens; identical to SEQ ID NO: 57715

SEQ ID NO: 57722 - protein, 193 aa, Homo sapiens
MVAPKSHTDDWAPGPFSSKPQRSQLQIFSSVLQTSLLFLLMGLRASGKDSAPTVVSGILGGSVTLPLNISVDTEIENVIWIGPKNALAFARPKENVTIMVKSYLGRLDITKWSYSLCISNLTLNDAGSYKAQINQRNFEVTTEEEFTLFVYAPFIEKLSVHVIEGDHRTLLEGSGLESIISTLAEPRVSVREG

SEQ ID NO: 57723 - protein, 655 aa, Homo sapiens
MVAPKSHTDDWAPGPFSSKPQRSQLQIFSSVLQTSLLFLLMGLRASGKDSAPTVVSGILGGSVTLPLNISVDTEIENVIWIGPKNALAFARPKENVTIMVKSYLGRLDITKWSYSLCISNLTLNDAGSYKAQINQRNFEVTTEEEFTLFVYEQLQEPQVTMKSVKVSENFSCNITLMCSVKGAEKSVLYSWTPREPHASESNGGSILTVSRTPCDPDLPYICTAQNPVSQRSSLPVHVGQFCTDPGASRGGTTGETVVGVLGEPVTLPLALPACRDTEKVVWLFNTSIISKEREEAATADPLIKSRDPYKNRVWVSSQDCSLKISQLKIEDAGPYHAYVCSEASSVTSMTHVTLLIYRRLRKPKITWSLRHSEDGICRISLTCSVEDGGNTVMYTWTPLQKEAVVSQGESHLNVSWRSSENHPNLTCTASNPVSRSSHQFLSENICSGPERNTKLWIGLFLMVCLLCVGIFSWCIWKRKGRCSVPAFCSSQAEAPADTPEPTAGHTLYSVLSQGYEKLDTPLRPARQQPTPTSDSSSDSNLTTEEDEDRPEVHKPISGRYEVFDQVTQEGAGHDPAPEGQADYDPVTPYVTEVESVVGENTMYAQVFNLQGKTPVSQKEESSATIYCSIRKPQVVPPPQQNDLEIPESPTYENFT

SEQ ID NO: 57724 - protein, 263 aa, Homo sapiens
MLLAWVQAFLVSNMLLAEAYGSGGCFWDNGHLYREDQTSPAPGLRCLNWLDAQSGLASAPVSGAGNHSYCRNPDEDPRGPWCYVSGEAGVPEKRPCEDLRCPETTSQALPAFTTEIQEASEGPGADEVQVFAPANALPARSEAAAVQPVIGISQRVRMNSKEKKDLGTLGYVLGITMMVIIIAIGAGIILGYSYKRGKDLKEQHDQKVCEREMQRITLPLSAFTNPTCEIVDEKTVVVHTSQTPVDPQEGTTPLMGQAGTPGA

SEQ ID NO: 57725 - protein, 102 aa, Homo sapiens
MFLTALLWRGRIPGRQWIGKHRRPRFVSLRAKQNMIRRLEIEAENHYWLSMPYMTREQERGHAAVRRREAFEAIKAAATSKFPPHRFIADQLDHLNVTKKWS

SEQ ID NO: 57726 - protein, 165 aa, Homo sapiens
MELCRSLALLGGSLGLMFCLIALSTDFWFEAVGPTHSAHSGLWPTGHGDIISGYIHVTQTFSIMAVLWALVSVSFLVLSCFPSLFPPGHGPLVSTTAAFAAAISMVVAMAVYTSERWDQPPHPQIQTFFSWSFYLGWVSAILLLCTGALSLGAHCGGPRPGYETL

SEQ ID NO: 57727 - protein, 598 aa, Homo sapiens
MPCVQAQYGSSPQGASPASQSYSYHSSGEYSSDFLTPEFVKFSMDLTNTEITATTSLPSFSTFMDNYSTGYDVKPPCLYQMPLSGQQSSIKVEDIQMHNYQQHSHLPPQSEEMMPHSGSVYYKPSSPPTPTTPGFQVQHSPMWDDPGSLHNFHQNYVATTHMIEQRKTPVSRLSLFSFKQSPPGTPVSSCQMRFDGPLHVPMNPEPAGSHHVVDGQTFAVPNPIRKPASMGFPGLQIGHASQLLDTQVPSPPSRGSPSNEGLCAVCGDNAACQHYGVRTCEGCKGFFKRTVQKNAKYVCLANKNCPVDKRRRNRCQYCRFQKCLAVGMVKEVVRTDSLKGRRGRLPSKPKSPQEPSPPSPPVSLISALVRAHVDSNPAMTSLDYSRFQANPDYQMSGDDTQHIQQFYDLLTGSMEIIRGWAEKIPGFADLPKADQDLLFESAFLELFVLRLAYRSNPVEGKLIFCNGVVLHRLQCVRGFGEWIDSIVEFSSNLQNMNIDISAFSCIAALAMVTERHGLKEPKRVEELQNKIVNCLKDHVTFNNGGLNRPNYLSKLLGKLPELRTLCTQGLQRIFYLKLEDLVPPPAIIDKLFLDTLPF

SEQ ID NO: 57728 - protein, 580 aa, Homo sapiens
MPCVQAQYGSSPQGASPASQSYSYHSSGEYSSDFLTPEFVKFSMDLTNTEITATTSLPSFSTFMDNYSTGYDVKPPCLYQMPLSGQQSSIKVEDIQMHNYQQHSHLPPQSEEMMPHSGSVYYKPSSPPTPTTPGFQVQHSPMWDDPGSLHNFHQNYVATTHMIEQRKTPVSRLSLFSFKQSPPGTPVSSCQMRFDGPLHVPMNPEPAGSHHVVDGQTFAVPNPIRKPASMGFPGLQIGHASQLLDTQVPSPPSRGSPSNEGLCAVCGDNAACQHYGVRTCEGCKGFFKRTVQKNAKYVCLANKNCPVDKRRRNRCQYCRFQKCLAVGMVKEVVRTDSLKGRRGRLPSKPKSPQEPSPPSPPVSLISALVRAHVDSNPAMTSLDYSRFQANPDYQMSGDDTQHIQQFYDLLTGSMEIIRGWAEKIPGFADLPKADQDLLFESAFLELFVLRLAYRLQCVRGFGEWIDSIVEFSSNLQNMNIDISAFSCIAALAMVTERHGLKEPKRVEELQNKIVNCLKDHVTFNNGGLNRPNYLSKLLGKLPELRTLCTQGLQRIFYLKLEDLVPPPAIIDKLFLDTLPF

SEQ ID NO: 57729 - protein, 455 aa, Homo sapiens
MPCVQAQYGSSPQGASPASQSYSYHSSGEYSSDFLTPEFVKFSMDLTNTEITATTSLPSFSTFMDNYSTGYDVKPPCLYQMPLSGQQSSIKVEDIQMHNYQQHSHLPPQSEEMMPHSGSVYYKPSSPPTPTTPGFQVQHSPMWDDPGSLHNFHQNYVATTHMIEQRKTPVSRLSLFSFKQSPPGTPVSSCQMRFDGPLHVPMNPEPAGSHHVVDGQTFAVPNPIRKPASMGFPGLQIGHASQLLDTQVPSPPSRGSPSNEGLCAVCGDNAACQHYGVRTCEGCKGFFKRTVQKNAKYVCLANKNCPVDKRRRNRCQYCRFQKCLAVGMVKEVVRTDSLKGRRGRLPSKPKSPQEPSPPSPPVSLISALVRAHVDSNPAMTSLDYSRFQANPDYQMSGDDTQHIQQFYDLLTGSMEIIRGWAEKIPGFADLPKADQDLLFESAFLELFVLRLAYRI

SEQ ID NO: 57730 - protein, 535 aa, Homo sapiens
MDNYSTGYDVKPPCLYQMPLSGQQSSIKVEDIQMHNYQQHSHLPPQSEEMMPHSGSVYYKPSSPPTPTTPGFQVQHSPMWDDPGSLHNFHQNYVATTHMIEQRKTPVSRLSLFSFKQSPPGTPVSSCQMRFDGPLHVPMNPEPAGSHHVVDGQTFAVPNPIRKPASMGFPGLQIGHASQLLDTQVPSPPSRGSPSNEGLCAVCGDNAACQHYGVRTCEGCKGFFKRTVQKNAKYVCLANKNCPVDKRRRNRCQYCRFQKCLAVGMVKEVVRTDSLKGRRGRLPSKPKSPQEPSPPSPPVSLISALVRAHVDSNPAMTSLDYSRFQANPDYQMSGDDTQHIQQFYDLLTGSMEIIRGWAEKIPGFADLPKADQDLLFESAFLELFVLRLAYRSNPVEGKLIFCNGVVLHRLQCVRGFGEWIDSIVEFSSNLQNMNIDISAFSCIAALAMVTERHGLKEPKRVEELQNKIVNCLKDHVTFNNGGLNRPNYLSKLLGKLPELRTLCTQGLQRIFYLKLEDLVPPPAIIDKLFLDTLPF

SEQ ID NO: 57731 - protein, 1323 aa, Homo sapiens
MEDGGLTAFEEDQRCLSQSLPLPVSAEGPAAQTTAEPSRSFSSAHRHLSRRNGLSRLCQSRTALSEDRWSSYCLSSLAAQNICTSKLHCPAAPEHTDPSEPRGSVSCCSLLRGLSSGWSSPLLPAPVCNPNKAIFTVDAKTTEILVANDKACGLLGYSSQDLIGQKLTQFFLRSDSDVVEALSEEHMEADGHAAVVFGTVVDIISRSGEKIPVSVWMKRMRQERRLCCVVVLEPVERVSTWVAFQSDGTVTSCDSLFAHLHGYVSGEDVAGQHITDLIPSVQLPPSGQHIPKNLKIQRSVGRARDGTTFPLSLKLKSQPSSEEATTGEAAPVSGYRASVWVFCTISGLITLLPDGTIHGINHSFALTLFGYGKTELLGKNITFLIPGFYSYMDLAYNSSLQLPDLASCLDVGNESGCGERTLDPWQGQDPAEGGQDPRINVVLAGGHVVPRDEIRKLMESQDIFTGTQTELIAGGQLLSCLSPQPAPGVDNVPEGSLPVHGEQALPKDQQITALGREEPVAIESPGQDLLGESRSEPVDVKPFASCEDSEAPVPAEDGGSDAGMCGLCQKAQLERMGVSGPSGSDLWAGAAVAKPQAKGQLAGGSLLMHCPCYGSEWGLWWRSQDLAPSPSGMAGLSFGTPTLDEPWLGVENDREELQTCLIKEQLSQLSLAGALDVPHAELVPTECQAVTAPVSSCDLGGRDLCGGCTGSSSACYALATDLPGGLEAVEAQEVDVNSFSWNLKELFFSDQTDQTSSNCSCATSELRETPSSLAVGSDPDVGSLQEQGSCVLDDRELLLLTGTCVDLGQGRRFRESCVGHDPTEPLEVCLVSSEHYAASDRESPGHVPSTLDAGPEDTCPSAEEPRLNVQVTSTPVIVMRGAAGLQREIQEGAYSGSCYHRDGLRLSIQFEVRRVELQGPTPLFCCWLVKDLLHSQRDSAARTRLFLASLPGSTHSTAAELTGPSLVEVLRARPWFEEPPKAVELEGLAACEGEYSQKYSTMSPLGSGAFGFVWTAVDKEKNKEVVVKFIKKEKVLEDCWIEDPKLGKVTLEIAILSRVEHANIIKVLDIFENQGFFQLVMEKHGSGLDLFAFIDRHPRLDEPLASYIFRQLVSAVGYLRLKDIIHRDIKDENIVIAEDFTIKLIDFGSAAYLERGKLFYTFCGTIEYCAPEVLMGNPYRGPELEMWSLGVTLYTLVFEENPFCELEETVEAAIHPPYLVSKELMSLVSGLLQPVPERRTTLEKLVTDPWVTQPVNLADYTWEEVFRVNKPESGVLSAASLEMGNRSLSDVAQAQELCGGPVPGEAPNGQGCLHPGDPRLLTS

SEQ ID NO: 57732 - protein, 391 aa, Homo sapiens
MDLEKNYPTPRTSRTGHGGVNQLGGVFVNGRPLPDVVRQRIVELAHQGVRPCDISRQLRVSHGCVSKILGRYYETGSIKPGVIGGSKPKVATPKVVEKIAEYKRQNPTMFAWEIRDRLLAERVCDNDTVPSVSSINRIIRTKVQQPPNQPVPASSHSIVSTGSVTQVSSVSTDSAGSSYSISGILGITSPSADTNKRKRDEGIQESPVPNGHSLPGRDFLRKQMRGDLFTQQQLEVLDRVFERQHYSDIFTTTEPIKPEQTTEYSAMASLAGGLDDMKANLASPTPADIGSSVPGPQSYPIVTGRDLASTTLPGYPPHVPPAGQGSYSAPTLTGMVPGSEFSGSPYSHPQYSSYNDSWRFPNPGLLGSPYYYSAAARGAAPPAAATAYDRH

SEQ ID NO: 57733 - protein, 698 aa, Homo sapiens
MAAAGAAVARSPGIGAGPALRARRSPPPRAARLPRLLVLLAAAAVGPGAGGAARLYRAGEDAVWVLDSGSVRGATANSSAAWLVQFYSSWCGHCIAYAPTWRALAGDVRDWASAIRVAALDCMEEKNQAVCHDYDIHFYPTFRYFKAFTKEFTTGENFKGPDRELRTVRQTMIDFLQNHTEGSRPPACPRLDPIQPSDVLSLLDNRGSHYVAIVFESNSSYLGREVILDLIPYESIVVTRALDGDKAFLEKLGVSSVPSCYLIYPNGSHGLINVVKPLRAFFSSYLKSLPDVRKKSLPLPEKPHKEENSEIVVWREFDKSKLYTVDLESGLHYLLRVELAAHKSLAGAELKTLKDFVTVLAKLFPGRPPVKKLLEMLQEWLASLPLDRIPYNAVLDLVNNKMRISGIFLTNHIKWVGCQGSRSELRGYPCSLWKLFHTLTVEASTHPDALVGTGFEDDPQAVLQTMRRYVHTFFGCKECGEHFEEMAKESMDSVKTPDQAILWLWKKHNMVNGRLAGHLSEDPRFPKLQWPTPDLCPACHEEIKGLASWDEGHVLTFLKQHYGRDNLLDTYSADQGDSSEGGTLARGEEEEKRLTPPEVSHGDRDTQSVRPPGALGPRPALPESLHHSLDGKLQSLDGPGAHKEVGGAAPFLGVDFSSLDMSLCVVLYVASSLFLMVMYFFFRVRSRRWKVKHHHPAV

SEQ ID NO: 57734 - protein, 232 aa, Homo sapiens
MGSVLSTDSGKSAPASATARALERRRDPELPVTSFDCAVCLEVLHQPVRTRCGHVFCRSCIATSLKNNKWTCPYCRAYLPSEGVPATDVAKRMKSEYKNCAECDTLVCLSEMRAHIRTCQKYIDKYGPLQELEETAARCVCPFCQRELYEDSLLDHCITHHRSERRPVFCPLCRLIPDENPSSFSGSLIRHLQVSHTLFYDDFIDFNIIEEALIRRVLDRSLLEYVNHSNTT

SEQ ID NO: 57735 - protein, 429 aa, Homo sapiens
MASNSIFDSFPTYSPTFIRDPSTSRRFTPPSPAFPCGGGGGKMGENSGALSAQAAVGPGGRARPEVRSMVDVLADHAGELVRTDSPNFLCSVLPSHWRCNKTLPVAFKVVALGDVPDGTVVTVMAGNDENYSAELRNASAVMKNQVARFNDLRFVGRSGRGKSFTLTITVFTNPTQVATYHRAIKVTVDGPREPRRHRQKLEDQTKPFPDRFGDLERLRMRVTPSTPSPRGSLSTTSHFSSQPQTPIQGTSELNPFSDPRQFDRSFPTLPTLTESRFPDPRMHYPGAMSAAFPYSATPSGTSISSLSVAGMPATSRFHHTYLPPPYPGAPQNQSGPFQANPSPYHLYYGTSSGSYQFSMVAGSSSGGDRSPTRMLASCTSSAASVAAGNLMNPSLGGQSDGVEADGSHSNSPTALSTPGRMDEAVWRPY

SEQ ID NO: 57736 - protein, 415 aa, Homo sapiens
MRIPVDPSTSRRFTPPSPAFPCGGGGGKMGENSGALSAQAAVGPGGRARPEVRSMVDVLADHAGELVRTDSPNFLCSVLPSHWRCNKTLPVAFKVVALGDVPDGTVVTVMAGNDENYSAELRNASAVMKNQVARFNDLRFVGRSGRGKSFTLTITVFTNPTQVATYHRAIKVTVDGPREPRRHRQKLEDQTKPFPDRFGDLERLRMRVTPSTPSPRGSLSTTSHFSSQPQTPIQGTSELNPFSDPRQFDRSFPTLPTLTESRFPDPRMHYPGAMSAAFPYSATPSGTSISSLSVAGMPATSRFHHTYLPPPYPGAPQNQSGPFQANPSPYHLYYGTSSGSYQFSMVAGSSSGGDRSPTRMLASCTSSAASVAAGNLMNPSLGGQSDGVEADGSHSNSPTALSTPGRMDEAVWRPY

SEQ ID NO: 57737 - protein, 406 aa, Homo sapiens
MSSRVGDLSPQQQEALARFRENLQDLLPILPNADDYFLLRWLRARNFDLQKSEDMLRRHMEFRKQQDLDNIVTWQPPEVIQLYDSGGLCGYDYEGCPVYFNIIGSLDPKGLLLSASKQDMIRKRIKVCELLLHECELQTQKLGRKIEMALMVFDMEGLSLKHLWKPAVEVYQQFFSILEANYPETLKNLIVIRAPKLFPVAFNLVKSFMSEETRRKIVILGDNWKQELTKFISPDQLPVEFGGTMTDPDGNPKCLTKINYGGEVPKSYYLCEQVRLQYEHTRSVGRGSSLQVENEILFPGCVLRWQFASDGGDIGFGVFLKTKMGEQQSAREMTEVLPSQRYNAHMVPEDGSLTCLQAGVYVLRFDNTYSRMHAKKLSYTVEVLLPDKASEETLQSLKAMRPSPTQ

SEQ ID NO: 57738 - protein, 372 aa, Homo sapiens [sequence omitted]

SEQ ID NO: 57739 - protein, 731 aa, Homo sapiens
MKLRSSHNASKTLNANNMETLIECQSEGDIKEHPLLASCESEDSICQLIEVKKRKKVLSWPFLMRRLSPASDFSGALETDLKASLFDQPLSIICGDSDTLPRPIQDILTILCLKGPSTEGIFRRAANEKARKELKEELNSGDAVDLERLPVHLLAVVFKDFLRSIPRKLLSSDLFEEWMGALEMQDEEDRIEALKQVADKLPRPNLLLLKHLVYVLHLISKNSEVNRMDSSNLAICIGPNMLTLENDQSLSFEAQKDLNNKVKTLVEFLIDNCFEIFGENIPVHSSITSDDSLEHTDSSDVSTLQNDSAYDSNDPDVESNSSSGISSPSRQPQVPMATAAGLDSAGPQDAREVSPEPIVSTVARLKSSLAQPDRRYSEPSMPSSQECLESRVTNQTLTKSEGDFPVPRVGSRLESEEAEDPFPEEVFPAVQGKTKRPVDLKIKNLAPGSVLPRALVLKAFSSSSLDASSDSSPVASPSSPKRNFFSRHQSFTTKTEKGKPSREIKKHSMSFTFAPHKKVLTKNLSAGSGKSQDFTRDHVPRGVRKESQLAGRIVQENGCETHNQTARGFCLRPHALSVDDVFQGADWERPGSPPSYEEAMQGPAARLVASESQTVGSMTVGSMRARMLEAHCLLPPLPPAHHVEDSRHRGSKEPLPGHGLSPLPERWKQSRTVHASGDSLGHVSGPGRPELLPLRTVSESVQRNKRDCLVRRCSQPVFEADQFQYAKESYI

SEQ ID NO: 57740 - protein, 553 aa, Homo sapiens
MGALEMQDEEDRIEALKQVADKLPRPNLLLLKHLVYVLHLISKNSEVNRMDSSNLAICIGPNMLTLENDQSLSFEAQKDLNNKVKTLVEFLIDNCFEIFGENIPVHSSITSDDSLEHTDSSDVSTLQNDSAYDSNDPDVESNSSSGISSPSRQPQVPMATAAGLDSAGPQDAREVSPEPIVSTVARLKSSLAQPDRRYSEPSMPSSQECLESRVTNQTLTKSEGDFPVPRVGSRLESEEAEDPFPEEVFPAVQGKTKRPVDLKIKNLAPGSVLPRALVLKAFSSSSLDASSDSSPVASPSSPKRNFFSRHQSFTTKTEKGKPSREIKKHSMSFTFAPHKKVLTKNLSAGSGKSQDFTRDHVPRGVRKESQLAGRIVQENGCETHNQTARGFCLRPHALSVDDVFQGADWERPGSPPSYEEAMQGPAARLVASESQTVGSMTVGSMRARMLEAHCLLPPLPPAHHVEDSRHRGSKEPLPGHGLSPLPERWKQSRTVHASGDSLGHVSGPGRPELLPLRTVSESVQRNKRDCLVRRCSQPVFEADQFQYAKESYI

SEQ ID NO: 57741 - protein, 58 aa, Homo sapiens
MQMFPPSPLFFFLQLLKQSSRRLEHTFVFLRNFSLMLLRYIGKKRRATRFWDPRRGTP

SEQ ID NO: 57742 - protein, 111 aa, Homo sapiens
MKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 57743 - protein, 339 aa, Homo sapiens
MAAACGPGAAGYCLLLGLHLFLLTAGPALGWNDPDRMLLRDVKALTLHYDRYTTSRRLDPIPQLKCVGGTAGCDSYTPKVIQCQNKGWDGYDVQWECKTDLDIAYKFGKTVVSCEGYESSEDQYVLRGSCGLEYNLDYTELGLQKLKESGKQHGFASFSDYYYKWSSADSCNMSGLITIVVLLGIAFVVYKLFLSDGQYSPPPYSEYPPFSHRYQRFTNSAGPPPPGFKSEFTGPQNTGHGATSGFGSAFTGQQGYENSGPGFWTGLGTGGILGYLFGSNRAATPFSDSWYYPSYPPSYPGTWNRAYSPLHGGSGSYSVCSNSDTKTRTASGYGGTRRR

SEQ ID NO: 57744 - protein, 790 aa, Homo sapiens
MAEQVLPQALYLSNMRKAVKIRERTPEDIFKPTNGIIHHFKTMHRYTLEMFRTCQFCPQFREIIHKALIDRNIQATLESQKKLNWCREVRKLVALKTNGDGNCLMHATSQYMWGVQDTDLVLRKALFSTLKETDTRNFKFRWQLESLKSQEFVETGLCYDTRNWNDEWDNLIKMASTDTPMARSGLQYNSLEEIHIFVLCNILRRPIIVISDKMLRSLESGSNFAPLKVGGIYLPLHWPAQECYRYPIVLGYDSHHFVPLVTLKDSGPEIRAVPLVNRDRGRFEDLKVHFLTDPENEMKEKLLKEYLMVIEIPVQGWDHGTTHLINAAKLDEANLPKEINLVDDYFELVQHEYKKWQENSEQGRREGHAQNPMEPSVPQLSLMDVKCETPNCPFFMSVNTQPLCHECSERRQKNQNKLPKLNSKPGPEGLPGMALGASRGEAYEPLAWNPEESTGGPHSAPPTAPSPFLFSETTAMKCRSPGCPFTLNVQHNGFCERCHNARQLHASHAPDHTRHLDPGKCQACLQDVTRTFNGICSTCFKRTTAEASSSLSTSLPPSCHQRSKSDPSRLVRSPSPHSCHRAGNDAPAGCLSQAARTPGDRTGTSKCRKAGCVYFGTPENKGFCTLCFIEYRENKHFAAASGKVSPTASRFQNTIPCLGRECGTLGSTMFEGYCQKCFIEAQNQRFHEAKRTEEQLRSSQRRDVPRTTQSTSRPKCARASCKNILACRSEELCMECQHPNQRMGPGAHRGEPAPEDPPKQRCRAPACDHFGNAKCNGYCNECFQFKQMYG

SEQ ID NO: 57745 - protein, 186 aa, Homo sapiens
MSGISGCPFFLWGLLALLGLALVISLIFNISHYVEKQRQDKMYSYSSDHTRVDEYYIEDTPIYGNLDDMISEPMDENCYEQMKARPEKSVNKMQEATPSAQATNETQMCYASLDHSVKGKRRKPRKQNTHFSDKDGDEQLHAIDASVSKTTLVDSFSPESQAVEENIHDDPIRLFGLIRAKREPIN

SEQ ID NO: 57746 - protein, 494 aa, Homo sapiens
MSTTLLSAFYDVDFLCKTEKSLANLNLNNMLDKKAVGTPVAAAPSSGFAPGFLRRHSASNLHALAHPAPSPGSCSPKFPGAANGSSCGSAAAGGPTSYGTLKEPSGGGGTALLNKENKFRDRSFSENGDRSQHLLHLQQQQKGGGGSQINSTRYKTELCRPFEESGTCKYGEKCQFAHGFHELRSLTRHPKYKTELCRTFHTIGFCPYGPRCHFIHNADERRPAPSGGASGDLRAFGTRDALHLGFPREPRPKLHHSLSFSGFPSGHHQPPGGLESPLLLDSPTSRTPPPPSCSSASSCSSSASSCSSASAASTPSGAPTCCASAAAAAAAALLYGTGGAEDLLAPGAPCAACSSASCANNAFAFGPELSSLITPLAIQTHNFAAVAAAAYYRSQQQQQQQGLAPPAQPPAPPSATLPAGAAAPPSPPFSFQLPRRLSDSPVFDAPPSPPDSLSDRDSYLSGSLSSGSLSGSESPSLDPGRRLPIFSRLSISDD

SEQ ID NO: 57747 - protein, 475 aa, Homo sapiens
MSRRKAGSAPRRVEPAPAANPDDEMEMQDLVIELKPEPDAQPQQAPRLGPFSPKEVSSAGRFGGEPHHSPGPMPAGAALLALGPRNPWTLWTPLTPNYPDRQPWTDKHPDLLTCGRCLQTFPLEAITAFMDHKKLGCQLFRGPSRGQGSEREELKALSCLRCGKQFTVAWKLLRHAQWDHGLSIYQTESEAPEAPLLGLAEVAAAVSAVVGPAAEAKSPRASGSGLTRRSPTCPVCKKTLSSFSNLKVHMRSHTGERPYACDQCPYACAQSSKLNRHKKTHRQVPPQSPLMADTSQEQASAAPPEPAVHAAAPTSTLPCSGGEGAGAAATAGVQEPGAPGSGAQAGPGGDTWGAITTEQRTDPANSQKASPKKMPKSGGKSRGPGGSCEFCGKHFTNSSNLTVHRRSHTGERPYTCEFCNYACAQSSKLNRHRRMHGMTPGSTRFECPHCHVPFGLRATLDKHLRQKHPEAAGEA

SEQ ID NO: 57748 - protein, 561 aa, Homo sapiens
MNSSLTAQRRGSDAELGPWVMAARSKDAAPSQRDGLLPVKVEEDSPGSWEPNYPAASPDPETSRLHFRQLRYQEVAGPEEALSRLRELCRRWLRPELLSKEQILELLVLEQFLTILPEELQAWVREHCPESGEEAVAVVRALQRALDGTSSQGMVTFEDTAVSLTWEEWERLDPARRDFCRESAQKDSGSTVPPSLESRVENKELIPMQQILEEAEPQGQLQEAFQGKRPLFSKCGSTHEDRVEKQSGDPLPLKLENSPEAEGLNSISDVNKNGSIEGEDSKNNELQNSARCSNLVLCQHIPKAERPTDSEEHGNKCKQSFHMVTWHVLKPHKSDSGDSFHHSSLFETQRQLHEERPYKCGNCGKSFKQRSDLFRHQRIHTGEKPYGCQECGKSFSQSAALTKHQRTHTGEKPYTCLKCGERFRQNSHLNRHQSTHSRDKHFKCEECGETCHISNLFRHQRLHKGERPYKCEECEKSFKQRSDLFKHHRIHTGEKPYGCSVCGKRFNQSATLIKHQRIHTGEKPYKCLECGERFRQSTHLIRHQRIHQNKVLSAGRGGSRL

SEQ ID NO: 57749 - protein, 129 aa, Homo sapiens
MREKSFQCNESGKAFNCSSLLKKCQIIHLGEKKYKCDICGKVFNQKRYLAYHHRCHTGEKPYKCNQCGKTFSYKSSLVIHKAIHTGEKPHKCNECGKVFNQKAYLASHHRLHTGEKPYKCEECDKVFSR

SEQ ID NO: 57750 - protein, 572 aa, Homo sapiens
MLENYQNLLALGPPLHKPDVISHLERGEEPWSMQREVPRGPCPEWELKAVPSQQQGICKEEPAQEPIMERPLGGAQAWGRQAGALQRSQAAPGRRTCHGLGRPVEEFPLRCPLFAQQRVPEGGPLLDTRKNVQATEGRTKAPARLCAGENASTPSEPEKFPQVRRQRGAGAGEGEFVCGECGKAFRQSSSLTLHRRWHSREKAYKCDECGKAFTWSTNLLEHRRIHTGEKPFFCGECGKAFSCHSSLNVHQRIHTGERPYKCSACEKAFSCSSLLSMHLRVHTGEKPYRCGECGKAFNQRTHLTRHHRIHTGEKPYQCGSCGKAFTCHSSLTVHEKIHSGDKPFKCSDCEKAFNSRSRLTLHQRTHTGEKPFKCADCGKGFSCHAYLLVHRRIHSGEKPFKCNECGKAFSSHAYLIVHRRIHTGEKPFDCSQCWKAFSCHSSLIMHQRIHTGEKPYKCSECGRAFSQNHCLIKHQKIHSGEKSFKCEKCGEMFNWSSHLTEHQRLHSEGKPLAIQFNKHLLSTYYVPGSLLGAGDAGLRDVDPIDALDVAKLLCVVPPRAGRNFSLGSKPRN

SEQ ID NO: 57751 - protein, 517 aa, Homo sapiens
MVDKTPVMCSHFAQDVWPEHSIKDSFQKVILRTYGKYGHENLQLRKDHKSVDACKVYKGGYNGLNQCLTTTDSKIFQCDKYVKVFHKFPNVNRNKIRHTGKKPFKCKNRGKSFCMLSQLTQHKKIHTREYSYKCEECGKAFNWSSTLTKHKIIHTGEKPYKCEECGKAFNRSSNLTKHKIIHTGEKPYKCEECGKAFNRSSTLTKHKRIHTEEKPYKCEECGKAFNQFSILNKHKRIHMEDKPYKCEECGKAFRVFSILKKHKIIHTGEKPYKCEECGKAFNQFSNLTKHKIIHTGEKPYKCDECGKAFNQSSTLTKHKRIHTGEKPYKCEECGKAFKQSSTLTEHKIIHTGEKPYKCEKCGKAFSWSSAFTKHKRNHMEDKPYKCEECGKAFSVFSTLTKHKIIHTREKPYKCEECGKAFNQSSIFTKHKIIHTEGKSYKCEKCGNAFNQSSNLTARKIIYTGEKPYKYEECDKAFNKFSTLITHQIIYTGEKPCKHECGRAFNKSSNYTKEKLQT

SEQ ID NO: 57752 - protein, 586 aa, Homo sapiens
MGPLTFRDVKIEFSLEEWQCLDTAQRNLYRDVMLENYRNLVFLGIAVSKPDLITWLEQGKEPWNLKRHEMVDKTPVMCSHFAQDVWPEHSIKDSFQKVILRTYGKYGHENLQLRKDHKSVDACKVYKGGYNGLNQCLTTTDSKIFQCDKYVKVFHKFPNVNRNKIRHTGKKPFKCKNRGKSFCMLSQLTQHKKIHTREYSYKCEECGKAFNWSSTLTKHKIIHTGEKPYKCEECGKAFNRSSNLTKHKIIHTGEKPYKCEECGKAFNRSSTLTKHKRIHTEEKPYKCEECGKAFNQFSILNKHKRIHMEDKPYKCEECGKAFRVFSILKKHKIIHTGEKPYKCEECGKAFNQFSNLTKHKIIHTGEKPYKCDECGKAFNQSSTLTKHKRIHTGEKPYKCEECGKAFKQSSTLTEHKIIHTGEKPYKCEKCGKAFSWSSAFTKHKRNHMEDKPYKCEECGKAFSVFSTLTKHKIIHTREKPYKCEECGKAFNQSSIFTKHKIIHTEGKSYKCEKCGNAFNQSSNLTARKIIYTGEKPYKYEECDKAFNKFSTLITHQIIYTGEKPCKHECGRAFNKSSNYTKEKLQT

SEQ ID NO: 57753 - DNA, 20 bp, Homo sapiens
gatcccagtggcatttatca

SEQ ID NO: 57754 - DNA, 20 bp, Homo sapiens
gatccaggccctgcatcggt

SEQ ID NO: 57755 - DNA, 20 bp, Homo sapiens
gatccatccctgacacaggc

SEQ ID NO: 57756 - DNA, 20 bp, Homo sapiens
gatctgtttcagacacacac

SEQ ID NO: 57757 - DNA, 20 bp, Homo sapiens
gatcattaaagaaggttatt

SEQ ID NO: 57758 - DNA, 20 bp, Homo sapiens
gatccagaaaataattcaca

SEQ ID NO: 57759 - DNA, 20 bp, Homo sapiens
gatctttcttgcaacagaaa

SEQ ID NO: 57760 - DNA, 20 bp, Homo sapiens
gatcagttttcaaggcactc

SEQ ID NO: 57761 - DNA, 20 bp, Homo sapiens
gatccccaccccacccatcc

SEQ ID NO: 57762 - DNA, 20 bp, Homo sapiens
gatcggcaaggaggtgtacc

SEQ ID NO: 57763 - DNA, 20 bp, Homo sapiens
gatcttcctatttgagtctc

SEQ ID NO: 57764 - DNA, 20 bp, Homo sapiens
gatcttgcaaatttctattc

SEQ ID NO: 57765 - DNA, 20 bp, Homo sapiens
gatcttgcacagcagctcat

SEQ ID NO: 57766 - DNA, 20 bp, Homo sapiens
gatcatgtttataaaattag

SEQ ID NO: 57767 - DNA, 20 bp, Homo sapiens
gatctatgggaaataactat

SEQ ID NO: 57768 - DNA, 20 bp, Homo sapiens
gatctcacagacgttgggct

SEQ ID NO: 57769 - DNA, 20 bp, Homo sapiens
gatcaccttcccctcgctcc

SEQ ID NO: 57770 - DNA, 20 bp, Homo sapiens
gatcccccggcagtctctca

SEQ ID NO: 57771 - DNA, 20 bp, Homo sapiens
gatcaatcaaacccggcggt

SEQ ID NO: 57772 - DNA, 20 bp, Homo sapiens
gatcaggtggggagtcaggg

SEQ ID NO: 57773 - DNA, 20 bp, Homo sapiens
gatcctgaggcctggtagtg

SEQ ID NO: 57774 - DNA, 20 bp, Homo sapiens
gatcctccagcgttctcacc

SEQ ID NO: 57775 - DNA, 20 bp, Homo sapiens
gatcacagcgaggagaaaac

SEQ ID NO: 57776 - DNA, 20 bp, Homo sapiens
gatcacttgagatcaggagt

SEQ ID NO: 57777 - DNA, 20 bp, Homo sapiens
gatcacctgagatcaggagt

SEQ ID NO: 57778 - DNA, 20 bp, Homo sapiens
gatccacccatcttagcttc

SEQ ID NO: 57779 - DNA, 20 bp, Homo sapiens
gatctcttcaagctcttcaa

SEQ ID NO: 57780 - DNA, 20 bp, Homo sapiens
gatctgacatccccactcac

SEQ ID NO: 57781 - DNA, 20 bp, Homo sapiens
gatcatatttagtcattttg

SEQ ID NO: 57782 - DNA, 20 bp, Homo sapiens
gatcaggctgccgaggacga

SEQ ID NO: 57783 - DNA, 20 bp, Homo sapiens
gatccagctccacacagctc

SEQ ID NO: 57784 - DNA, 20 bp, Homo sapiens
gatcccccgctccctcctcc

SEQ ID NO: 57785 - DNA, 20 bp, Homo sapiens
gatcccaaactctgctacct

SEQ ID NO: 57786 - DNA, 20 bp, Homo sapiens
gatccatgagcaaaaagccg

SEQ ID NO: 57787 - DNA, 20 bp, Homo sapiens
gatccctctggggaggacag

SEQ ID NO: 57788 - DNA, 20 bp, Homo sapiens
gatcttcccccgaccatgct

SEQ ID NO: 57789 - DNA, 20 bp, Homo sapiens
gatcccagagataggggccc

SEQ ID NO: 57790 - DNA, 20 bp, Homo sapiens
gatcagggaggagggggtga

SEQ ID NO: 57791 - DNA, 20 bp, Homo sapiens
gatcatcctcctgttctgcg

SEQ ID NO: 57792 - DNA, 20 bp, Homo sapiens
gatctgtcagggccacttag

SEQ ID NO: 57793 - DNA, 20 bp, Homo sapiens
gatcatgcacccagatagtg

SEQ ID NO: 57794 - DNA, 20 bp, Homo sapiens
gatcttgagcaagttccttc

SEQ ID NO: 57795 - DNA, 20 bp, Homo sapiens
gatcagccgaacagaatgat

SEQ ID NO: 57796 - DNA, 20 bp, Homo sapiens
gatcttgctaggccactgaa

SEQ ID NO: 57797 - DNA, 20 bp, Homo sapiens
gatctgtttgtcaatagcat

SEQ ID NO: 57798 - DNA, 20 bp, Homo sapiens
gatcatttctagctttacgt

SEQ ID NO: 57799 - DNA, 20 bp, Homo sapiens
gatccccagctgtttatgca

SEQ ID NO: 57800 - DNA, 20 bp, Homo sapiens
gatcagtgcctggttccagg

SEQ ID NO: 57801 - DNA, 20 bp, Homo sapiens
gatcttgccctacctgttcc

SEQ ID NO: 57802 - DNA, 20 bp, Homo sapiens
gatctgctgcaaactcttca

SEQ ID NO: 57803 - DNA, 20 bp, Homo sapiens
gatcagggcaaaggcgtttc

SEQ ID NO: 57804 - DNA, 20 bp, Homo sapiens
gatcaacagcaacagcctcg

SEQ ID NO: 57805 - DNA, 20 bp, Homo sapiens
gatcatcgagtttccaccta

SEQ ID NO: 57806 - DNA, 20 bp, Homo sapiens
gatctattatactattttaa

SEQ ID NO: 57807 - DNA, 20 bp, Homo sapiens
gatctatttacagatttgaa

SEQ ID NO: 57808 - DNA, 20 bp, Homo sapiens
gatcttcccttctgattcct

SEQ ID NO: 57809 - DNA, 20 bp, Homo sapiens
gatcgatgctacatattcag

SEQ ID NO: 57810 - DNA, 20 bp, Homo sapiens
gatctagaggtctagctcaa

SEQ ID NO: 57811 - DNA, 20 bp, Homo sapiens
gatctgcctcgcacagaaat

SEQ ID NO: 57812 - DNA, 20 bp, Homo sapiens
gatccagaatccactctcca

SEQ ID NO: 57813 - DNA, 20 bp, Homo sapiens
gatctgctgggcagtttctc

SEQ ID NO: 57814 - DNA, 20 bp, Homo sapiens
gatcaatcctcctccctgcc

SEQ ID NO: 57815 - DNA, 20 bp, Homo sapiens
gatctggtagtctacggtca

SEQ ID NO: 57816 - DNA, 20 bp, Homo sapiens
gatccagacttatggccttc

SEQ ID NO: 57817 - DNA, 20 bp, Homo sapiens
gatcgaaagtgcgaatctga

SEQ ID NO: 57818 - DNA, 20 bp, Homo sapiens
gatccatttattacagtcct

SEQ ID NO: 57819 - DNA, 20 bp, Homo sapiens
gatcaaaagcaaccttgtcc

SEQ ID NO: 57820 - DNA, 20 bp, Homo sapiens
gatcaggagaaactcgggca

SEQ ID NO: 57821 - DNA, 20 bp, Homo sapiens
gatctgtgaagagcacatat

SEQ ID NO: 57822 - DNA, 20 bp, Homo sapiens
gatcagggcattgcctgtga

SEQ ID NO: 57823 - DNA, 20 bp, Homo sapiens
gatccgtgtgtaccatcttt

SEQ ID NO: 57824 - DNA, 20 bp, Homo sapiens
gatcgcagcactcactgacc

SEQ ID NO: 57825 - DNA, 20 bp, Homo sapiens
gatcagatgcatatttatta

SEQ ID NO: 57826 - DNA, 20 bp, Homo sapiens
gatctactgatagacctgca

SEQ ID NO: 57827 - DNA, 20 bp, Homo sapiens
gatcacgagatcaggagttc

SEQ ID NO: 57828 - DNA, 20 bp, Homo sapiens
gatccaaagttgtctcctgc

SEQ ID NO: 57829 - DNA, 20 bp, Homo sapiens
gatcttctagggagacaaca

SEQ ID NO: 57830 - DNA, 20 bp, Homo sapiens
gatcgctcttcctcacacca

SEQ ID NO: 57831 - DNA, 20 bp, Homo sapiens
gatccatctgatttctgtac

SEQ ID NO: 57832 - DNA, 20 bp, Homo sapiens
gatcacgagatcaggagatc

SEQ ID NO: 57833 - DNA, 20 bp, Homo sapiens
gatcaatcacgccaatcata

SEQ ID NO: 57834 - DNA, 20 bp, Homo sapiens
gatcctcctcgcctgccttg

SEQ ID NO: 57835 - DNA, 20 bp, Homo sapiens
gatcaagaaattatctttcc

SEQ ID NO: 57836 - DNA, 20 bp, Homo sapiens
gatccctcgccgcacagggg

SEQ ID NO: 57837 - DNA, 20 bp, Homo sapiens
gatcccttgctcccatccct

SEQ ID NO: 57838 - DNA, 20 bp, Homo sapiens
gatcagtgcagagatatgtc

SEQ ID NO: 57839 - DNA, 20 bp, Homo sapiens
gatccccgggatgcaggccc

SEQ ID NO: 57840 - DNA, 20 bp, Homo sapiens
gatcttgagattcctgaaag

SEQ ID NO: 57841 - DNA, 20 bp, Homo sapiens
gatctgctccgcctttggcc

SEQ ID NO: 57842 - DNA, 20 bp, Homo sapiens
gatcaagaaagaatccctat

SEQ ID NO: 57843 - DNA, 20 bp, Homo sapiens
gatcactcctggcagcaacg

SEQ ID NO: 57844 - DNA, 20 bp, Homo sapiens
gatcaggaatcctcaccaat

SEQ ID NO: 57845 - DNA, 20 bp, Homo sapiens
gatcatcagaagacccccca

SEQ ID NO: 57846 - DNA, 20 bp, Homo sapiens
gatcatggaacatcaaatga

SEQ ID NO: 57847 - DNA, 20 bp, Homo sapiens
gatcttggggaggttctgga

SEQ ID NO: 57848 - DNA, 20 bp, Homo sapiens
gatctttgccttcttccagg

SEQ ID NO: 57849 - DNA, 20 bp, Homo sapiens
gatcagcagcctcttcctcc

SEQ ID NO: 57850 - DNA, 20 bp, Homo sapiens
gatccagaccttcttctcct

SEQ ID NO: 57851 - DNA, 20 bp, Homo sapiens
gatccctggcttcgcagacc

SEQ ID NO: 57852 - DNA, 20 bp, Homo sapiens
gatcaagtttttacagatgt

SEQ ID NO: 57853 - DNA, 20 bp, Homo sapiens
gatccaattccacgtgatgt

SEQ ID NO: 57854 - DNA, 20 bp, Homo sapiens
gatcccaggctctcttgggc

SEQ ID NO: 57855 - DNA, 20 bp, Homo sapiens
gatccctaaactgccttgta

SEQ ID NO: 57856 - DNA, 20 bp, Homo sapiens
gatcctcccctagagcctcc

SEQ ID NO: 57857 - DNA, 20 bp, Homo sapiens
gatcacgatgttctcatcct

SEQ ID NO: 57858 - DNA, 20 bp, Homo sapiens
gatcactgagctgaaactaa

SEQ ID NO: 57859 - DNA, 20 bp, Homo sapiens
gatcagctaccccagctcgg

SEQ ID NO: 57860 - DNA, 20 bp, Homo sapiens
gatcatccggacaaaagtac

SEQ ID NO: 57861 - DNA, 20 bp, Homo sapiens
gatcgttctcctgacacgta

SEQ ID NO: 57862 - DNA, 20 bp, Homo sapiens
gatctcccaagcttttgtca

SEQ ID NO: 57863 - DNA, 20 bp, Homo sapiens
gatcttgcactcattgatgg

SEQ ID NO: 57864 - DNA, 20 bp, Homo sapiens
gatcctccacctacttgcct

SEQ ID NO: 57865 - DNA, 20 bp, Homo sapiens
gatccagccaaatcttgcga

SEQ ID NO: 57866 - DNA, 20 bp, Homo sapiens
gatcctggccgtctcatccc

SEQ ID NO: 57867 - DNA, 20 bp, Homo sapiens
gatcaccagaaggactgcct

SEQ ID NO: 57868 - DNA, 20 bp, Homo sapiens
gatcctattccattccctcc

SEQ ID NO: 57869 - DNA, 20 bp, Homo sapiens
gatcatgaactgtagccatc

SEQ ID NO: 57870 - DNA, 20 bp, Homo sapiens
gatcctgatgtctgcctgaa

SEQ ID NO: 57871 - DNA, 20 bp, Homo sapiens
gatcaactccctggtgatgt

SEQ ID NO: 57872 - DNA, 20 bp, Homo sapiens
gatccacactgctcctggca

SEQ ID NO: 57873 - DNA, 20 bp, Homo sapiens
gatctggtaggttgcagcag

SEQ ID NO: 57874 - DNA, 20 bp, Homo sapiens
gatcttgccgctgtactgcg

SEQ ID NO: 57875 - DNA, 20 bp, Homo sapiens
gatcaagaacttggccccgg

SEQ ID NO: 57876 - DNA, 20 bp, Homo sapiens
gatccgtgcgccaaccctac

SEQ ID NO: 57877 - DNA, 20 bp, Homo sapiens
gatcattatttccattctta

SEQ ID NO: 57878 - DNA, 20 bp, Homo sapiens
gatcctcatggcagcgaggc

SEQ ID NO: 57879 - DNA, 20 bp, Homo sapiens
gatcatttgttgatgggatg

SEQ ID NO: 57880 - DNA, 20 bp, Homo sapiens
gatcaactccacgcgctaca

SEQ ID NO: 57881 - DNA, 20 bp, Homo sapiens
gatctgttgacctgcggccg

SEQ ID NO: 57882 - DNA, 20 bp, Homo sapiens
gatcatttgagatcaggagt

SEQ ID NO: 57883 - DNA, 20 bp, Homo sapiens
gatccccttgccttggcctc

SEQ ID NO: 57884 - DNA, 20 bp, Homo sapiens
gatcacctggctggagcaag

SEQ ID NO: 57885 - DNA, 20 bp, Homo sapiens
gatcccctaggaaagaggag

SEQ ID NO: 57886 - DNA, 1959 bp, Homo sapiens
atcacttggctcttctctgatatgaactgggcagcatctaaatgtatctttcttgattttgttgtctctttgcatagagcatatcttgtgaaaacagaaatatccatgtaatggttttttcttgtagtgaccgctcgaaattgcttgagcaacatagagataatgggcaggggtccctgtgtgaagcacctagaggctggaaagctgatggcaaagctggaggggtgaggcagggagaggataaacacagtggaaatgcaggaggaaagctgtgctctgtggtggcctaattacaaggacctgccctacagccagaatcagccagcaaatgcttttgtaaaggaactaaaagaaagggaaaagaggaagtaaacaaaaggtcccttttcagagagggaaccagtgggagacttaagagcaaggaacaacccatttcgtcgttatggtaagtggagattattccttgggcctgaatgacttgaatgtttccccgcctgagctaacagtccatgtgggtgattcagctctgatgggatgtgttttccagagcacagaagacaaatgtatattcaagatagactggactctgtcaccaggagagcacgccaaggacgaatatgtgctatactattactccaatctcagtgtgcctattgggcgcttccagaaccgcgtacacttgatgggggacaacttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgtgttttccagagcacagaagtgaaacacgtgaccaaggtagaatggatattttcaggacggcgcgcaaaggaggagattgtatttcgttactaccacaaactcaggatgtctgcggagtactcccagagctggggccacttccagaatcgtgtgaacctggtgggggacattttccgcaatgacggttccatcatgcttcaaggagtgagggagtcagatggaggaaactacacctgcagtatccacctagggaacctggtgttcaagaaaaccattgtgctgcatgtcagcccggaagagcctcgaacactggtgaccccggcagccctgaggcctctggtcttgggtggtaatcagttggtgatcattgtgggaattgtctgtgccacaatcctgctgctccctgttctgatattgatcgtgaagaagacctgtggaaataagagttcagtgaattctacagtcttggtgaagaacacgaagaagactaatccagagataaaagaaaaaccctgccattttgaaagatgtgaaggggagaaacacatttactccccaataattgtacgggaggtgatcgaggaagaagaaccaagtgaaaaatcagaggccacctacatgaccatgcacccagtttggccttctctgaggtcagatcggaacaactcacttgaaaaaaagtcaggtgggggaatgccaaaaacacagcaagccttttgagaagaatggagagtcccttcatctcagcagcggtggagactctctcctgtgtgtgtcctgggccactctaccagtgatttcagactcccgctctcccagctgtcctcctgtctcattgtttggtcaatacactgaagatggagaatttggagcctggcagagagactggacagctctggaggaacaggcctgctgaggggaggggagcatggacttggcctctggagtgggacactggccctgggaaccaggctgagctgagtggcctcaaaccccccgttggatcagaccctcctgtgggcagggttcttagtggatgagttactgggaagaatcagagataaaaaccaacccaaatcatt

SEQ ID NO: 57887 - DNA, 1349 bp, Homo sapiens
gatcttaacaccacgccttgagcaagtcgcaagagcgggaggacacagaccaggaaccgagaagggacaagcacatggaagccagcccagcatccgggcccagacacttgatggatccacacatattcacttccaactttaacaatggcattggaaggcataagacctacctgtgctacgaagtggagcgcctggacaatggcacctcggtcaagatggaccagcacaggggctttctacacaaccaggctaagaatcttctctgtggcttttacggccgccatgcggagctgcgcttcttggacctggttccttctttgcagttggacccggcccagatctacagggtcacttggttcatctcctggagcccctgcttctcctggggctgtgccggggaagtgcgtgcgttccttcaggagaacacacacgtgagactgcgcatcttcgctgcccgcatctatgattacgaccccctatataaggaggcgctgcaaatgctgcgggatgctggggcccaagtctccatcatgacctacgatgaatttaagcactgctgggacacctttgtggaccaccagggatgtcccttccagccctgggatggactagatgagcacagccaagccctgagtgggaggctgcgggccattctccagaatcagggaaactgaaggatgggcctcagtctctaaggaaggcagagacctgggttgagcagcagaataaaagatcttcttccaagaaatgcaaacagaccgttcaccaccatctccagctgctcacagacgccagcaaagcagtatgctcccgatcaagtagatttttaaaaaatcagagtgggccgggcgcggtggctcacgcctgtaatcccagcactttggaggccaaggcgggtggatcacgaggtcaggagatcgagaccatcctggctaacacggtgaaaccctgtctctactaaaaatacaaaaaattagccaggcgtggtggcgggcgcctgtagtcccagctactctggaggctgaggcaggagagtagcgtgaacccgggaggcagagcttgcggtgagccgagattgcgctactgcactccagcctgggcgacagtaccagactccatctcaaaaaaaaaaaaaaccagactgaattaattttaactgaaaatttctcttatgttccaagtacacaatagtaagattatgctcaatattctcagaataattttcaatgtattaatgaaatgaaatgataatttggcttcatatctagactaacacaaaattaagaatcttccataattgcttttgctcagtaactgtgtcatgaattgcaagagtttccacaaacact

SEQ ID NO: 57888 - DNA, 1536 bp, Homo sapiens
acagagcttcaaaaaaagagcgggacagggacaagcgtatctaagaggctgaacatgaatccacagatcagaaatccgatggagcggatgtatcgagacacattctacgacaactttgaaaacgaacccatcctctatggtcggagctacacttggctgtgctatgaagtgaaaataaagaggggccgctcaaatctcctttgggacacaggggtctttcgaggccaggtgtatttcaagcctcagtaccacgcagaaatgtgcttcctctcttggttctgtggcaaccagctgcctgcttacaagtgtttccagatcacctggtttgtatcctggaccccctgcccggactgtgtggcgaagctggccgaattcctgtctgagcaccccaatgtcaccctgaccatctctgccgcccgcctctactactactgggaaagagattaccgaagggcgctctgcaggctgagtcaggcaggagcccgcgtgacgatcatggactatgaagaatttgcatactgctgggaaaactttgtgtacaatgaaggtcagcaattcatgccttggtacaaattcgatgaaaattatgcattcctgcaccgcacgctaaaggagattctcagatacctgatggatccagacacattcactttcaactttaataatgaccctttggtccttcgacggcgccagacctacttgtgctatgaggtggagcgcctggacaatggcacctgggtcctgatggaccagcacatgggctttctatgcaacgaggctaagaatcttctctgtggcttttacggccgccatgcggagctgcgcttcttggacctggttccttctttgcagttggacccggcccagatctacagggtcacttggttcatctcctggagcccctgcttctcctggggctgtgccggggaagtgcgtgcgttccttcaggagaacacacacgtgagactgcgcatcttcgctgcccgcatctatgattacgaccccctatataaggaggcgctgcaaatgctgcgggatgctggggcccaagtctccatcatgacctacgatgagtttgagtactgctgggacacctttgtgtaccgccagggatgtcccttccagccctgggatggactagaggagcacagccaagccctgagtgggaggctgcgggccattctccagaatcagggaaactgaaggatgggcctcagtctctaaggaaggcagagacctgggttgagcagcagaataaaagatcttcttccaagaaatgcaaacagaccgttcaccaccatctccagctgctcacagacaccagcaaagcaatgtgctcctgatcaagtagattttttaaaaatcagagtcaattaattttaattgaaaatttctcttatgttccaagtgtacaagagtaagattatgctcaatattcccagaatagttttcaatgtattaatgaagtgattaattggctccatatttagactaataaaacattaagaatcttccataattgtttccacaaacact

SEQ ID NO: 57889 - DNA, 2212 bp, Homo sapiens
tcctgctgggtgccgaggtagccaggtcaggggtcaagagtggaacaccctcactggcccgggccggcgcgggagggctgtgtgatggcctcggagcgcccggagccggaggtggaagaagctgggcaggtgttcctgttaatgaaaaaggattatcgaatctcccgaaatgttcgcctggcttggttcctcagtcatctgcaccaaactgtgcaggccacaccccaggagatgctgcttcagtctgaacaggaattggaagtcctcagtgtcctgccccctgggtggcagccagatgaaccagtggtcccaaggccattcctcctggtaccttccacccgggtcaccttcctggcttggcagtatcggtttgtcattgagttggaccttagcccatctactggcattgtggatgattccacaggggagatcttgtttgatgaagttttccatgccctgtcccgctgcttaggcgggctgcttcggcccttccgagtgcctggatcttgcatcgacttccagcctgagatctatgtaactatccaggcctactcctccatcattggactgcagtcccaccagatgatatgatcttttatttggaaaaacctaatggctccaccaaaaaactattagaactgataaacaaattcagtaaagttgcaagatacaaaatcaacatacagaaaatcagtagcatttctgtatgtcagcagcagacaatgtgaagaagaaatcaagaaagtaatcccatttacgatagtttaaaataaaatacctaggaattaaccaaagaagtgaaagatctctacaatgaaaactataaaacatcgatgagagaaattgaagtggactccaaaaattggaatgatattccatgttcatggattggaagaatcagtattgttaaaatgcccacactgcctaaagcagtctacagattcagtacaattcctatcaaaataccaatgacattcttcatagaaatagagaaaacaatcctaaaatttatatggaaccacaaaagacccagaatagccaaagctattctgagcaaaacaaacaaaactggaggaatcacattacctgacttcagattatactacaaagctatagtaaccaaaaacagcatggtactggcataaaaacagacacatagaccaatggaacagaatagagaacccagaagccatatatctacaatgaactcatttttgacagatgccaagaacatacattggggaaagaacagtctcttcaataaatggttctgggaagactggatattcatatgcagaagaatgaaactagactcctatctcacaaaaatcaaatcaaaatggattaaagacttaaatctggccaggcgcagtggctcacacctgtaatcccaacactttgggaggccaaggctggtcttgaactcttgacatcatgatttgcccgcctcagcctcccaaagtgctgggattacaggcgtgagccaccacacccggcgacttcatccactgtctgtccgcttcctgtgtaaggccgaccacccagcccccaaacaacccttaaaatgagacccaaaccaaagacctaacatataagcctcaaatcagtaaacctctcctgaaacaggcagaggaactgcctgcccagaaatactcacaataggctgtgcagattgtaaagagatcaacagcttcacccacgctctgcataaactctggtactggctgtgttctccatagaaggtctcgctgtgttgcctgggctggagtgcagtggtgtgaacacagctcactgcagccttgatctcttgggcttaagtgattctcctgcctcagactcctgagtagctgagaccacaggtgcatttcaccactcagctaatttttagtttttttgtagagatgaggtctctaccaagctggtctctaactcctgggctcaagcgatcttcccatcttggcctcccaaagtgctgggattacacatgtgaaccactatgcttggctcaaagatttattgataataccctgcaagcacaagcgtgcaaagcaaaaatggacaaataggatcacatcaagttaaaaagctgcacagcaaaggaaacaataaacaaagtgaggaaacaaccacagaatgggagaaaatatttgcaaaccacccatctgacaagggattaattaccagaatatataaggagctcaaacaactctat

SEQ ID NO: 57890 - DNA, 1985 bp, Homo sapiens
actgtggctaagtgtggggaccagacaggactcgtggagacatccaggtgctgaagccttcagctactgtctcagttttttgaagtttagcaatggcgtctttctctgctgagaccaattcaactgacctactctcacagccatggaatgagcccccagtaattctctccatggtcattctcagccttacttttttactgggattgccaggcaatgggctggtgctgtgggtggctggcctgaagatgcagcggacagtgaacacaatttggttcctccacctcaccttggcggacctcctctgctgcctctccttgcccttctcgctggctcacttggctctccagggacagtggccctacggcaggttcctatgcaagctcatcccctccatcattgtcctcaacatgtttgccagtgtcttcctgcttactgccattagcctggatcgctgtcttgtggtattcaagccaatctggtgtcagaatcatcgcaatgtagggatggcctgctctatctgtggatgtatctgggtggtggcttttgtgatgtgcattcctgtgttcgtgtaccgggaaatcttcactacagacaaccataatagatgtggctacaaatttggtctctccagctcattagattatccagacttttatggagatccactagaaaacaggtctcttgaaaacattgttcagccgcctggagaaatgaatgataggttagatccttcctctttccaaacaaatgatcatccttggacagtccccactgtcttccaacctcaaacatttcaaagaccttctgcagattcactccctaggggttctgctaggttaacaagtcaaaatctgtattctaatgtatttaaacctgctgatgtggtctcacctaaaatccccagtgggtttcctattgaagatcacgaaaccagcccactggataactctgatgcttttctctctactcatttaaagctgttccctagcgcttctagcaattccttctacgagtctgagctaccacaaggtttccaggattattacaatttaggccaattcacagatgacgatcaagtgccaacacccctcgtggcaataacgatcactaggctagtggtgggtttcctgctgccctctgttatcatgatagcctgttacagcttcattgtcttccgaatgcaaaggggccgcttcgccaagtctcagagcaaaacctttcgagtggccgtggtggtggtggctgtctttcttgtctgctggactccataccacatttttggagtcctgtcattgcttactgacccagaaactcccttggggaaaactctgatgtcctgggatcatgtatgcattgctctagcatctgccaatagttgctttaatcccttcctttatgccctcttggggaaagattttaggaagaaagcaaggcagtccattcagggaattctggaggcagccttcagtgaggagctcacacgttccacccactgtccctcaaacaatgtcatttcagaaagaaatagtacaactgtgtgaaaatgtggagcagccaacaagcaggggctcttaggcaatcacatagtgaaagtttataagaggatgaagtgatatggtgagcagcggacttcaaaaactgtcaaagaatcaatccagcggttctcaaacggtacacagactattgacatcagcatcacctagaaacttgttagaaatgcaaattctcaagccgcatcccagacttgctgaatcggaatctctgggggttgggacccagcaagggcacttaacaaaccctcgtttctgattaatgctaaatgtaagaatcattgtaaacattagttctatttctatcccaaactaagctatgtgaaataagagaagctactttgtttttaaatgatgttgaatatttgtcgatatttccatcattaaatttttccttagcattgtaaaaaaaaaaaaaaaaaaaaaaaaaaaaaa

SEQ ID NO: 57891 - DNA, 804 bp, Homo sapiens
gaaggacgcaggcagcaaagagtagtcagtcccttcttggctctgctgacactcgagcccacattccatcacctgctcccaatcatgcaggtctccactgctgcccttgccgtcctcctctgcaccatggctctctgcaaccaggtcctctctgcaccacttgctgctgacacgccgaccgcctgctgcttcagctacacctcccgacagattccacagaatttcatagctgactactttgagacgagcagccagtgctccaagcccagtgtcatcttcctaaccaagagaggccggcaggtctgtgctgaccccagtgaggagtgggtccagaaatacgtcagtgacctggagctgagtgcctgaggggtccagaagcttcgaggcccagcgacctcagtgggcccagtggggaggagcaggagcctgagccttgggaacatgcgtgtgacctctacagctacctcttctatggactggttattgccaaacagccacactgtgggactcttcttaacttaaattttaatttatttatactatttagtttttataatttatttttgatttcacagtgtgtttgtgattgtttgctctgagagttccccctgtcccctccaccttccctcacagtgtgtctggtgacaaccgagtggctgtcatcggcctgtgtaggcagtcatggcaccaaagccaccagactgacaaatgtgtatcagatgcttttgttcagggctgtgatcggcctggggaaataataaagatgttcttttaaacggtaaaaaaaaaaaaaaaaaaaaaaaa

SEQ ID NO: 57892 - DNA, 775 bp, Homo sapiens
gcaaagagtagtcagtcccttcttggctctgctgacactcgagcccacattccatcacctgctcccaatcatgcaggtctccactgctgcccttgccgtcctcctctgcaccatggctctctgcaaccaggtcctctctgcaccacttgctgctgacacgccgaccgcctgctgcttcagctacacctcccgacagattccacagaatttcatagctgactactttgagacgagcagccagtgctccaagcccagtgtcatcttcctaaccaagagaggccggcaggtctgtgctgaccccagtgaggagtgggtccagaaatacgtcagtgacctggagccgagtgcctgaggggtccagaagcttcgaggcccagcgacctcagtgggcccagtggggaggagcaggagcctgagccttgggaacatgcgtgtgacctccacagctacctcttctatggactggttattgccaaacagccacactgtgggactcttcttaacttaaattttaatttatttatactatttagtttttataatttatttttgatttcacagtgtgtttgtgattgtttgctctgagagttccccctgtcccctccaccttccctcacagtgtgtctggtgacaaccgagtggctgtcatcggcctgtgtaggcagtcatggcaccaaagccaccagactgacaaatgtgtatcagatgcttttgttcagggctgtgatcggcctggggaaataataaagatgttcttttaaacggtaaaaaaaaa

SEQ ID NO: 57893 - DNA, 1745 bp, Homo sapiens
gaggaggaaacaacttcccggttgctttcagacgcttcagagatcctctggaggcctgggggagcttttgagtactttatttcagttggtccctgagctcggtgagtggggcgggtagagccaccaggggaatcaacagtggtttctcgtgcccctcagggtcaggagcagtctgatcaaaaggagggcatccactgtccggggccattcccacagctcccggatgctgggtctggaggctgcgcccttcccctgcaggagctcagcccagtgggcagtctgaagatggccaattacacgctggcaccagaggatgaatatgatgtcctcatagaaggtgaactggagagcgatgaggcagagcaatgtgacaagtatgacgcccaggcactctcagcccagctggtgccatcactctgctctgctgtgtttgtgatcggtgtcctggacaatctcctggttgtgcttatcctggtaaaatataaaggactcaaacgcgtggaaaatatctatcttctaaacttggcagtttctaacttgtgtttcttgcttaccctgcccttctgggctcatgctgggggcgatcccatgtgtaaaattctcattggactgtacttcgtgggcctgtacagtgagacatttttcaattgccttctgactgtgcaaaggtacctagtgtttttgcacaagggaaactttttctcagccaggaggagggtgccctgtggcatcattacaagtgtcctggcatgggtaacagccattctggccactttgcctgaattcgtggtttataaacctcagatggaagaccagaaatacaagtgtgcatttagcagaactcccttcctgccagctgatgagacattctggaagcattttctgactttaaaaatgaacatttcggttcttgtcctccccctatttatttttacatttctctatgtgcaaatgagaaaaacactaaggttcagggagcagaggtatagccttttcaagcttgtttttgccataatggtagtcttccttctgatgtgggcgccctacaatattgcatttttcctgtccactttcaaagaacacttctccctgagtgactgcaagagcagctacaatctggacaaaagtgttcacatcactaaactcatcgccaccacccactgctgcatcaaccctctcctgtatgcgtttcttgatgggacatttagcaaatacctctgccgctgtttccatctgcgtagtaacaccccacttcaacccagggggcagtctgcacaaggcacatcgagggaagaacctgaccattccaccgaagtgtaaactagcatccaccaaatgcaagaagaataaacatggattttcatctttctgcattatttcatgtaaattttctacacatttgtatacaaaatcggatacaggaagaaaagggagaggtgagctaacatttgctaagcactgaatttgtctcaggcaccgtgcaaggctctttacaaacgtgagctccttcgcctcctaccacttgtccatagtgtggataggactagtctcatttctctgagaagaaaactaaggcgcggaaatttgtctaagatcacataactaggaagtggcagaactgattctccagccctggtagcatttgctcagagcctacgcttggtccagaacatcaaactccaaaccctggggacaaacgacatgaaataaatgtattttaaaacatctaaaaaaaaaaaaaaaaa

SEQ ID NO: 57894 - DNA, 2318 bp, Homo sapiens
tctagatgtgcagaaggtgcaagccagagctcgggcagaacttccagagtgcatctgggatctgcatttgccactggttgcagatcaggcggacgaggagccgggaaggcagagccatgtggctgccccctgctctgctccttctcagcctctcaggctgtttctccatccaaggcccagagtctgtgagagccccagagcaggggtccctgacggttcaatgccactataagcaaggatgggagacctacattaagtggtggtgccgaggggtgcgctgggatacatgcaagatcctcattgaaaccagagggtcggagcaaggagagaagagtgaccgtgtgtccatcaaggacaatcagaaagaccgcacgttcactgtgaccatggaggggctcaggcgagatgacgcagatgtttactggtgtgggattgaaagaagaggacctgaccttgggactcaagtgaaagtgatcgttgacccagagggagcggcttccacaacagcaagctcacctaccaacagcaatatggcagtgttcatcggctcccacaagaggaaccactacatgctcctggtatttgtgaaggtgcccatcttgctcatcttggtcactgccatcctctggttgaaggggtctcagagggtccctgaggagccaggggaacagcctatctacatgaacttctccgaacctctgactaaagacatggccacttagagagatggatctgcagagccttcctgccctggccacgtttccagaagagactcgggctgtggaaggaacatctacgagtcctcgggatgcagtgactgagataggggccctgggcctccgccctggccttggagctggtgggcacctccctgttctgcacagctcagggacttagccaggtcctctcctgagccaccatcacctcctggggtgccagcacctgttctcttggtcaggagctgtagagatggagctcaagcactggacgactctgtccccactgctggaataactcgggcacagagcatgggaccaaagtacagaaagaggttgggggagacccccccagccctagacttccatcattccggagaccaactcaacaccgtctttgcctgagaacctgatatatccgtgtttttaaatttttttttttctagcaaagttgggttttaatgacttatgttcataggaaacctctctgatcccacacacaaggagggtgattctgggatgagttcctggttctagggcatgaggggctggatggaccctgtccccagggaggacatggctctgagtccacagggctgaggaggcaatgggaacctccctggcccggcccggtgcttgtcctccccctcccacctcttcctcctcctagctccccaagctccctgcctattcccccacctccgaggggctgcagcttgggagcctcctcagcatgacagcttgggtctcctccccaaaagagcctgtcaggcctcaagaaccacctccaggtggggagggcagtaacgaaaaccatcgcaggaaatggcaccctcccttttcggtgatgttgaaatcatgttactaatgaaaactgtcctagggaagtggttctgtctcctcacaggcttcacccacggcgatgaggcccttgaatgtggtcactttgtgctgtatggttgagggaccctcacaccaaagggaccttcccatgtgagatgtgctcccgcccccacctgcccacaagcaaacacaccacacatgttcggcatgttgccctttgaacacccatgaggacgcctccaacctgctcttggttctaatagggagtactgactgtcagcagtggataaaggagaggggaccctctggtccctagcatggcacccagagcctcccctcttcttgtccttcagccaaagagaaactttctctgactttgaactgaatttaggtctctggccaatgatgggcctgaaaattccataatggccagagaggagagttcgagcccggctaagatcccctgagtcattctgtgagggaccaagacccacagtccaccagccccagggccctacctcctggaatgctttcctggatccagcttcccgaagatccgaccagacccagggaggacggcaccgctccgcgggagggaaagccaaagcatggtgcttcaccagctggactcaggggcgaggggacatgggcgcttgtcaacgtgatgtcattcttttcccaccgtttcttcctgttgatattcaatgaatccgtcaatctctctggaaaaaaaaaaaaaaaaaaaaaaaaaaaaaaaaa

SEQ ID NO: 57895 - DNA, 4484 bp, Homo sapiens
gtagatgaggaaactgaagttgaggaatagtgaagagtttgtccaatgtcatagccccgtaatcaacgggacaaaaattttcttgctgatgggtcaagatggcatcgtgaagtggttgttcaccgtaaactgtaatacaatcctgtttatggatttgtttgcatatttttccctccatagggaaacctttcttccatggctcaggacacactcctggatcgagccaacaggagaactttctggtaagcatttggctaacttttttttttttgagatggagtcttgctgtgtcgcctaggctggagtgcagtggcgtgatcttggctcactgcagcctccacttcccgggttcaatcaattctcctacctcaacttcctgagtagctgggattacaggcgcccgccaccacacccggctcatttttgtacttttagtagagacacagttttgccatgttggccaggctggtcttgaattcctcagctcaggtgatctgcctgccttggcctctcaaagtgctgggattacaggcgtgagccactgtgcccggccttggctaacttttcaaaattaaagattttgacttgttacagtcatgtgacatttttttctttctgtttgctgagtttttgataatttatatctctcaaagtggagactttaaaaaagactcatccgtgtgccgtgttcactgcctggtatcttagtgtggaccgaagcctaaggaccctgaaaacagctgcagatgaagatggcaagcacccgctgcaagctggccaggtacctggaggacctggaggatgtggacttgaagaaatttaagatgcacttagaggactatcctccccagaagggctgcatccccctcccgaggggtcagacagagaaggcagaccatgtggatctagccacgctaatgatcgacttcaatggggaggagaaggcgtgggccatggccgtgtggatcttcgctgcgatcaacaggagagacctttatgagaaagcaaaaagagatgagccgaagtggggttcagataatgcacgtgtttcgaatcccactgtgatatgccaggaagacagcattgaagaggagtggatgggtttactggagtacctttcgagaatctctatttgtaaaatgaagaaagattaccgtaagaagtacagaaagtacgtgagaagcagattccagtgcattgaagacaggaatgcccgtctgggtgagagtgtgagcctcaacaaacgctacacacgactgcgtctcatcaaggagcaccggagccagcaggagagggagcaggagcttctggccatcggcaagaccaagacgtgtgagagccccgtgagtcccattaagatggagttgctgtttgaccccgatgatgagcattctgagcctgtgcacaccgtggtgttccagggggcggcagggattgggaaaacaatcctggccaggaagatgatgttggactgggcgtcggggacactctaccaagacaggtttgactatctgttctatatccactgtcgagaggtgagccttgtgacacagaggagcctgggggacctgatcatgagctgctgccccgacccaaacccacccatccacaagatcgtgagaaaaccctccagaatcctcttcctcatggacggcttcgatgagctgcaaggtgcctttgacgagcacataggaccgctctgcactgactggcagaaggccgagcggggagacattctcctgagcagcctcatcagaaagaagctgcttcccgaggcctctctgctcatcaccacgagacctgtggccctggagaaactgcagcacttgctggaccatcctcggcatgtggagatcctgggtttctccgaggccaaaaggaaagagtacttcttcaagtacttctctgatgaggcccaagccagggcagccttcagtctgattcaggagaacgaggtcctcttcaccatgtgcttcatccccctggtctgctggatcgtgtgcactggactgaaacagcagatggagagtggcaagagccttgcccagacatccaagaccaccaccgcggtgtacgtcttcttcctttccagtttgctgcagccccggggagggagccaggagcacggcctctgcgcccacctctgggggctctgctctttggctgcagatggaatctggaaccagaaaatcctgtttgaggagtccgacctcaggaatcatggactgcagaaggcggatgtgtctgctttcctgaggatgaacctgttccaaaaggaagtggactgcgagaagttctacagcttcatccacatgactttccaggagttctttgccgccatgtactacctgctggaagaggaaaaggaaggaaggacgaacgttccagggagtcgtttgaagcttcccagccgagacgtgacagtccttctggaaaactatggcaaattcgaaaaggggtatttgatttttgttgtacgtttcctctttggcctggtaaaccaggagaggacctcctacttggagaagaaattaagttgcaagatctctcagcaaatcaggctggagctgctgaaatggattgaagtgaaagccaaagctaaaaagctgcagatccagcccagccagctggaattgttctactgtttgtacgagatgcaggaggaggacttcgtgcaaagggccatggactatttccccaagattgagatcaatctctccaccagaatggaccacatggtttcttccttttgcattgagaactgtcatcgggtggagtcactgtccctggggtttctccataacatgcccaaggaggaagaggaggaggaaaaggaaggccgacaccttgatatggtgcagtgtgtcctcccaagctcctctcatgctgcctgttctcatggattggtgaacagccacctcacttccagtttttgccggggcctcttttcagttctgagcaccagccagagtctaactgaattggacctcagtgacaattctctgggggacccagggatgagagtgttgtgtgaaacgctccagcatcctggctgtaacattcggagattgtggttggggcgctgtggcctctcgcatgagtgctgcttcgacatctccttggtcctcagcagcaaccagaagctggtggagctggacctgagtgacaacgccctcggtgacttcggaatcagacttctgtgtgtgggactgaagcacctgttgtgcaatctgaagaagctctggttggtcagctgctgcctcacatcagcatgttgtcaggatcttgcatcagtattgagcaccagccattccctgaccagactctatgtgggggagaatgccttgggagactcaggagtcgcaattttatgtgaaaaagccaagaatccacagtgtaacctgcagaaactggggttggtgaattctggccttacgtcagtctgttgttcagctttgtcctcggtactcagcactaatcagaatctcacgcacctttacctgcgaggcaacactctcggagacaaggggatcaaactactctgtgagggactcttgcaccccgactgcaagcttcaggtgttggaattagacaactgcaacctcacgtcacactgctgctgggatctttccacacttctgacctccagccagagcctgcgaaagctgagcctgggcaacaatgacctgggcgacctgggggtcatgatgttctgtgaagtgctgaaacagcagagctgcctcctgcagaacctggggttgtctgaaatgtatttcaattatgagacaaaaagtgcgttagaaacacttcaagaagaaaagcctgagctgaccgtcgtctttgagccttcttggtaggagtggaaacggggctgccagacgccagtgttctccggtccctccagctgggggccctcaggtggagagagctgcgatccatccaggccaagaccacagctctgtgatccttccggtggagtgtcggagaagagagcttgccgacgatgccttcctgtgcagagcttgggcatctcctttacgccagggtgaggaagacaccaggacaatgacagcatcgggtgttgttgtcatcacagcgcctcagttagaggatgttcctcttggtgacctcatgtaattagctcattcaataaagcactttctttatttttctcttctctgtctaactttctttttcctatcttttttcttctttgttctgtttacttttgctcatatcatcattcccgctatctttctattaactgaccataacacagaactagttgactatatattatgttgaaattttatggcagctatttatttatttaaattttttgtaacagttttgttttctaataagaaaaatccatgctttttgtagctggttgaaaattcaggaatatgtaaaactttttggtatttaattaaattgattccttttcttaattttaaaaaaaaaaaaaaaaaaaaaaaaaaaaa

SEQ ID NO: 57896 - DNA, 4142 bp, Homo sapiens
gtagatgaggaaactgaagttgaggaatagtgaagagtttgtccaatgtcatagccccgtaatcaacgggacaaaaattttcttgctgatgggtcaagatggcatcgtgaagtggttgttcaccgtaaactgtaatacaatcctgtttatggatttgtttgcatatttttccctccatagggaaacctttcttccatggctcaggacacactcctggatcgagccaacaggagaactttctggtaagcatttggctaacttttttttttttgagatggagtcttgctgtgtcgcctaggctggagtgcagtggcgtgatcttggctcactgcagcctccacttcccgggttcaatcaattctcctacctcaacttcctgagtagctgggattacaggcgcccgccaccacacccggctcatttttgtacttttagtagagacacagttttgccatgttggccaggctggtcttgaattcctcagctcaggtgatctgcctgccttggcctctcaaagtgctgggattacaggcgtgagccactgtgcccggccttggctaacttttcaaaattaaagattttgacttgttacagtcatgtgacatttttttctttctgtttgctgagtttttgataatttatatctctcaaagtggagactttaaaaaagactcatccgtgtgccgtgttcactgcctggtatcttagtgtggaccgaagcctaaggaccctgaaaacagctgcagatgaagatggcaagcacccgctgcaagctggccaggtacctggaggacctggaggatgtggacttgaagaaatttaagatgcacttagaggactatcctccccagaagggctgcatccccctcccgaggggtcagacagagaaggcagaccatgtggatctagccacgctaatgatcgacttcaatggggaggagaaggcgtgggccatggccgtgtggatcttcgctgcgatcaacaggagagacctttatgagaaagcaaaaagagatgagccgaagtggggttcagataatgcacgtgtttcgaatcccactgtgatatgccaggaagacagcattgaagaggagtggatgggtttactggagtacctttcgagaatctctatttgtaaaatgaagaaagattaccgtaagaagtacagaaagtacgtgagaagcagattccagtgcattgaagacaggaatgcccgtctgggtgagagtgtgagcctcaacaaacgctacacacgactgcgtctcatcaaggagcaccggagccagcaggagagggagcaggagcttctggccatcggcaagaccaagacgtgtgagagccccgtgagtcccattaagatggagttgctgtttgaccccgatgatgagcattctgagcctgtgcacaccgtggtgttccagggggcggcagggattgggaaaacaatcctggccaggaagatgatgttggactgggcgtcggggacactctaccaagacaggtttgactatctgttctatatccactgtcgagaggtgagccttgtgacacagaggagcctgggggacctgatcatgagctgctgccccgacccaaacccacccatccacaagatcgtgagaaaaccctccagaatcctcttcctcatggacggcttcgatgagctgcaaggtgcctttgacgagcacataggaccgctctgcactgactggcagaaggccgagcggggagacattctcctgagcagcctcatcagaaagaagctgcttcccgaggcctctctgctcatcaccacgagacctgtggccctggagaaactgcagcacttgctggaccatcctcggcatgtggagatcctgggtttctccgaggccaaaaggaaagagtacttcttcaagtacttctctgatgaggcccaagccagggcagccttcagtctgattcaggagaacgaggtcctcttcaccatgtgcttcatccccctggtctgctggatcgtgtgcactggactgaaacagcagatggagagtggcaagagccttgcccagacatccaagaccaccaccgcggtgtacgtcttcttcctttccagtttgctgcagccccggggagggagccaggagcacggcctctgcgcccacctctgggggctctgctctttggctgcagatggaatctggaaccagaaaatcctgtttgaggagtccgacctcaggaatcatggactgcagaaggcggatgtgtctgctttcctgaggatgaacctgttccaaaaggaagtggactgcgagaagttctacagcttcatccacatgactttccaggagttctttgccgccatgtactacctgctggaagaggaaaaggaaggaaggacgaacgttccagggagtcgtttgaagcttcccagccgagacgtgacagtccttctggaaaactatggcaaattcgaaaaggggtatttgatttttgttgtacgtttcctctttggcctggtaaaccaggagaggacctcctacttggagaagaaattaagttgcaagatctctcagcaaatcaggctggagctgctgaaatggattgaagtgaaagccaaagctaaaaagctgcagatccagcccagccagctggaattgttctactgtttgtacgagatgcaggaggaggacttcgtgcaaagggccatggactatttccccaagattgagatcaatctctccaccagaatggaccacatggtttcttccttttgcattgagaactgtcatcgggtggagtcactgtccctggggtttctccataacatgcccaaggaggaagaggaggaggaaaaggaaggccgacaccttgatatggtgcagtgtgtcctcccaagctcctctcatgctgcctgttctcatgggttggggcgctgtggcctctcgcatgagtgctgcttcgacatctccttggtcctcagcagcaaccagaagctggtggagctggacctgagtgacaacgccctcggtgacttcggaatcagacttctgtgtgtgggactgaagcacctgttgtgcaatctgaagaagctctggttggtgaattctggccttacgtcagtctgttgttcagctttgtcctcggtactcagcactaatcagaatctcacgcacctttacctgcgaggcaacactctcggagacaaggggatcaaactactctgtgagggactcttgcaccccgactgcaagcttcaggtgttggaattagacaactgcaacctcacgtcacactgctgctgggatctttccacacttctgacctccagccagagcctgcgaaagctgagcctgggcaacaatgacctgggcgacctgggggtcatgatgttctgtgaagtgctgaaacagcagagctgcctcctgcagaacctggggttgtctgaaatgtatttcaattatgagacaaaaagtgcgttagaaacacttcaagaagaaaagcctgagctgaccgtcgtctttgagccttcttggtaggagtggaaacggggctgccagacgccagtgttctccggtccctccagctgggggccctcaggtggagagagctgcgatccatccaggccaagaccacagctctgtgatccttccggtggagtgtcggagaagagagcttgccgacgatgccttcctgtgcagagcttgggcatctcctttacgccagggtgaggaagacaccaggacaatgacagcatcgggtgttgttgtcatcacagcgcctcagttagaggatgttcctcttggtgacctcatgtaattagctcattcaataaagcactttctttatttttctcttctctgtctaactttctttttcctatcttttttcttctttgttctgtttacttttgctcatatcatcattcccgctatctttctattaactgaccataacacagaactagttgactatatattatgttgaaattttatggcagctatttatttatttaaattttttgtaacagttttgttttctaataagaaaaatccatgctttttgtagctggttgaaaattcaggaatatgtaaaactttttggtatttaattaaattgattccttttcttaattttaaaaaaaaaaaaaaaaaaaaaaaaaaaaa

SEQ ID NO: 57897 - DNA, 2143 bp, Homo sapiens
tcggagctgaacttcctaaaagacaaagtgtttatctttcaagattcattctccctgaatcttaccaacaaaacactcctgaggagaaagaaagagagggagggagagaaaaagagagagagagaaacaaaaaaccaaagagagagaaaaaatgaattcatctaaatcatctgaaacacaatgcacagagagaggatgcttctcttcccaaatgttcttatggactgttgctgggatccccatcctatttctcagtgcctgtttcatcaccagatgtgttgtgacatttcgcatctttcaaacctgtgatgagaaaaagtttcagctacctgagaatttcacagagctctcctgctacaattatggatcaggttcagtcaagaattgttgtccattgaactgggaatattttcaatccagctgctacttcttttctactgacaccatttcctgggcgttaagtttaaagaactgctcagccatgggggctcacctggtggttatcaactcacaggaggagcaggaattcctttcctacaagaaacctaaaatgagagagttttttattggactgtcagaccaggttgtcgagggtcagtggcaatgggtggacggcacacctttgacaaagtctctgagcttctgggatgtaggggagcccaacaacatagctaccctggaggactgtgccaccatgagagactcttcaaacccaaggcaaaattggaatgatgtaacctgtttcctcaattattttcggatttgtgaaatggtaggaataaatcctttgaacaaaggaaaatctctttaagaacagaaggcacaactcaaatgtgtaaagaaggaagagcaagaacatggccacacccaccgccccacacgagaaatttgtgcgctgaacttcaaaggacttcataagtatttgttactctgatataaataaaaataagtagttttaaatgttataattcatgttactggctgaagtgcattttctctctacgttagtctcaggtcctcttcccagaatttacaaagcaattcataccttttgctacatttgcctcattttttagtgttcgtatgaaagtacagggacacggagccaagacagagtctagcaaagaaggggattttggaaggtgccttccaaaaatctcctgaatccgggctctgtagcaggtcctcttctttctagcttctgacaagtctgtcttctcttcttggtttcataccgttcttatctcctgcccaagcatatatcgtctctttactcccctgtataatgagtaagaagcttcttcaagtcatgaaacttattcctgctcagaataccggtgtggcctttctggctacaggcctccactgcaccttcttagggaagggcatgccagccatcagctccaaacaggctgtaaccaagtccacccatccctggggcttcctttgctctgccttattttcaattgactgaatggatctcaccagattttgtatctattgctcagctaggacccgagtccaatagtcaatttattctaagcgaacattcatctccacactttcctgtctcaagcccatccattatttcttaacttttattttagctttcgggggtacatgttaaaggctttttatataggtaaactcatgtcgtggaggtttgttgtacagattatttcatcacccaggtattaagcccagtgcctaatattgtttttttcggctcctctccctcctcctaccttccgccctcaagtagactccagtgtctgttattcccttctttgtgtttatgaattctcatcatttagctcccacttataagtgaggacatgcagtatttggttttctgttcccatgtttgctaaggataatggtttccagttctaccgatgttcccacaaaagacataattttcttttttaaggctgcttagtattccatggtatctatgtatcacattttctctatccaatctattgttgactcacatttagattgattccatgtttttgctattgtgaatagtgctgcaatgaacattcgtgtgcatgtgtctttatggtagaaagatttatatttctctgagtatgtatccagtaatagcccattcatttattgcataaaattctaccaatac

SEQ ID NO: 57898 - DNA, 2385 bp, Homo sapiens
agcatagtttcatttcctgctcttgaatatctggttgaactacttaagcttaatttgttaaactccggtaagtacctagcccacatgatttgactcagagattctcttttgtccacagacagtcatctcaggagcagaaagaaaagagctcccaaatgctatatctattcaggggctctcaagaacaatggaatatcatcctgatttagaaaatttggatgaagatggatatactcaattacacttcgactctcaaagcaataccaggatagctgttgtttcagagaaaggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattgggatttatagtaaaacaagtgtcttcccaacctgataattcattttggataggcctttctcggccccagactgaggtaccatggctctgggaggatggatcaacattctcttctaacttatttcagatcagaaccacagctacccaagaaaacccatctccaaattgtgtatggattcacgtgtcagtcatttatgaccaactgtgtagtgtgccctcatatagtatttgtgagaagaagttttcaatgtaagaggaagggtggagaaggagagagaaatatgtgaggtagtaaggaggacagaaaacagaacagaaaagagtaacagctgaggtcaagataaatgcagaaaatgtttagagagcttggccaactgtaatcttaaccaagaaattgaagggagaggctgtgatttctgtatttgtcgacctacaggtaggctagtattatttttctagttagtagatccctagacatggaatcagggcagccaagcttgagtttttattttttatttatttatttttttgagatagggtctcactttgttacccaggctggagtgcagtggcacaatctcgactcactgcagctatctctcgcctcagcccctcaagtagctgggactacaggtgcatgccaccatgccaggctaatttttggtgttttttgtagagactgggttttgccatgttgaccaagctggtctctaactcctgggcttaagtgatctgcccgccttggcctcccaaagtgctgggattacagatgtgagccaccacacctggccccaagcttgaattttcattctgccattgacttggcatttaccttgggtaagccataagcgaatcttaatttctggctctatcagagttgtttcatgctcaacaatgccattgaagtgcacggtgtgttgccacgatttgaccctcaacttctagcagtatatcagttatgaactgagggtgaaatatatttctgaatagctaaatgaagaaatgggaaaaaatcttcaccacagtcagagcaattttattattttcatcagtatgatcataattatgattatcatcttagtaaaaagcaggaactcctactttttctttatcaattaaatagctcagagagtacatctgccatatctctaatagaatctttttttttttttttttttttgagacagagtttcgctcttgttgcccaggctggagtgcaacggcacgatctcggctcaccgcaacctccgccccctgggttcaagcaattctcctgcctcagcctcccaagtagctgggattacagtcaggcaccaccacacccggctaattttgtatttttttagtagagacagggtttctccatgtcggtcagggtagtcccgaactcctgacctcaagtgatctgcctgcctcggcctcccaagtgctgggattacaggcgtgagccactgcacccagcctagaatcttgtataatatgtaattgtagggaaactgctctcataggaaagttttctgctttttaaatacaaaaatacataaaaatacataaaatctgatgatgaatataaaaaagtaaccaacctcattggaacaagtattaacattttggaatatgttttattagttttgtgatgtactgttttacaatttttaccatttttttcagtaattactgtaaaatggtattattggaatgaaactatatttcctcatgtgctgatttgtcttatttttttcatactttcccactggtgctatttttatttccaatggatatttctgtattactagggaggcatttacagtcctctaatgttgattaatatgtgaaaagaaattgtaccaattttactaaattatgcagtttaaaatggatgattttatgttatgtggatttcatttcaataaaaaaaaactcttatcaaaaaaaaaaaaaaaa

SEQ ID NO: 57899 - DNA, 1166 bp, Homo sapiens
gctccgggaatttccctggcccggccgctccgggctttccagtctcaaccatgcataaaaagggttcgccgatcttggggagccacacagcccgggtcgcaggcacctccccgccagctctcccgcttctcgcacagcttcccgacgcgtctgctgagccccatggcccacgccacgctctccgccgcccccagcaatccccggctcctgcgggtggcgctgctgctcctgctcctggtggccgccagccggcgcgcagcaggagcgtccgtggtcactgaactgcgctgccagtgcttgcagacactgcagggaattcacctcaagaacatccaaagtgtgaatgtaaggtcccccggaccccactgcgcccaaaccgaagtcatagccacactcaagaatgggaagaaagcttgtctcaaccccgcatcccccatggttcagaaaatcatcgaaaagatactgaacaaggggagcaccaactgacaggagagaagtaagaagcttatcagcgtatcattgacacttcctgcagggtggtccctgcccttaccagagctgaaaatgaaaaagagaacagcagctttctagggacagctggaaaggacttaatgtgtttgactatttcttacgagggttctacttatttatgtatttatttttgaaagcttgtattttaatattttacatgctgttatttaaagatgtgagtgtgtttcatcaaacatagctcagtcctgattatttaattggaatatgatgggttttaaatgtgtcattaaactaatatttagtgggagaccataatgtgtcagccaccttgataaatgacagggtggggaactggagggtggggggattgaaatgcaagcaattagtggatcactgttagggtaagggaatgtatgtacacatctattttttatactttttttttaaaaaaagaatgtcagttgttatttattcaaattatctcacattatgtgttcaacatttttatgctgaagtttcccttagacattttatgtcttgcttgtagggcataatgccttgtttaatgtccattctgcagcgtttctctttcccttggaaaagagaatttatcattactgttacatttgtacaaatgacatgataataaaagttttatgaaaaaaaaaaaaaaa

SEQ ID NO: 57900 - DNA, 1344 bp, Homo sapiens
tccacccaagagcaacctggaactaagttattcggcaacgaactgttccactttgttgtgaggcaatagatgtggaaattccctgacgaggggctctgtcctcatacttcctgcggagcttattgtcgtaagaatatctgtcatcctgctaatgtgcattgaaaggagagcaacggggctgaggccgtgtcagcacgatggaccccaaacagaccaccctcctgtgtcttggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacggttggtacaacaggagcccctacctgtggtccttccccagtaatgccttggagcttgtggtcacagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggagccaggactgtggagtccgacaaagctacttgaaggacacaagagagaaaagctcactaagaagcttgaatctacttttttttttttttgagacagagtctggctctgtcacccaggctgaagtgcagtggagcaatctcggctcattgaacctcttgggttcaagtgattcttgtgcctcagcctcccaagtagctggaattacaggcacataccactgcacccagctaatttttgtatttttagtagagatggggtttcactgtgttggccaggctggtctcgaactcctgacctcaggtgatccacccaccttggcctcccaaagtgctgagattataggcatgagccaccacgcctggccagatgcatgttcaaaccaatcaaatggtgttttcttatgcaggactgatcgatttgcacccacctttctgcacataagttatggttttccatcttatctgtcttctgattttttatatcctgtttaatttcttccttcattgttcttctctttttttatttattttatttatttttatttttatttttatttgagacagagtctcactctgttgcccagg

SEQ ID NO: 57901 - DNA, 1334 bp, Homo sapiens
aatcattagagcctgagtcactctccccaggagacccagacctagaactacccagagcaagaccacagctggtgaacagtccaggagcagacaagatggagacaaattcctctctccccacgaacatctctggagggacacctgctgtatctgctggctatctcttcctggatatcatcacttatctggtatttgcagtcacctttgtcctcggggtcctgggcaacgggcttgtgatctgggtggctggattccggatgacacacacagtcaccaccatcagttacctgaacctggccgtggctgacttctgtttcacctccactttgccattcttcatggtcaggaaggccatgggaggacattggcctttcggctggttcctgtgcaaattcgtctttaccatagtggacatcaacttgttcggaagtgtcttcctgatcgccctcattgctctggaccgctgtgtttgcgtcctgcatccagtctggacccagaaccaccgcaccgtgagcctggccaagaaggtgatcattgggccctgggtgatggctctgctcctcacattgccagttatcattcgtgtgactacagtacctggtaaaacggggacagtagcctgcacttttaacttttcgccctggaccaacgaccctaaagagaggataaatgtggccgttgccatgttgacggtgagaggcatcatccggttcatcattggcttcagcgcacccatgtccatcgttgctgtcagttatgggcttattgccaccaagatccacaagcaaggcttgattaagtccagtcgtcccttacgggtcctctcctttgtcgcagcagccttttttctctgctggtccccatatcaggtggtggcccttatagccacagtcagaatccgtgagttattgcaaggcatgtacaaagaaattggtattgcagtggatgtgacaagtgccctggccttcttcaacagctgcctcaaccccatgctctatgtcttcatgggccaggacttccgggagaggctgatccacgcccttcccgccagtctggagagggccctgaccgaggactcaacccaaaccagtgacacagctaccaattctactttaccttctgcagaggtggagttacaggcaaagtgaggagggagctgggggacactttcgagctcccagctccagcttcgtctcaccttgagttaggctgagccacaggcatttcctgcttattttaggattacccactcatcagaaaaaaaaaaaaaagcctttgtgtcccctgatttggggagaataaacagatatgagtttaaaaaaaaaaaaaaaaaa

SEQ ID NO: 57902 - DNA, 1624 bp, Homo sapiens
gtcctctgtcctgccagcaccgagggctcatccatccacagagcagtgcagtgggaggagacgccatgacctccatcctcacggtcctgatctgtctcgggctgagcctggaccccaggacccacgtgcaggcagggcccctccccaagcccaccctctgggctgagccaggctctgtgatcacccaagggagtcctgtgaccctcaggtgtcaggggagcctggagacgcaggagtaccatctatatagagaaaagaaaacagcactctggattacacggatcccacaggagcttgtgaagaagggccagttccccatcctatccatcacctgggaacatgcagggcggtattgctgtatctatggcagccacactgtaggcctctcagagagcagtgaccccctggagctggtggtgacaggagcctacagcaaacccaccctctcagctctgcccagccctgtggtgacctcaggagggaatgtgaccatccagtgtgactcacaggtggcatttgatggcttcattctgtgtaaggaaggagaagatgaacacccacaatgcctgaactcccattcccatgcccgtgggtcatcccgggccatcttctccgtgggccccgtgagcccaagtcgcaggtggtcgtacaggtgctatggttatgactcgcgcgctccctatgtgtggtctctacccagtgatctcctggggctcctggtcccaggtgtttctaagaagccatcactctcagtgcagccgggtcctgtcgtggcccctggggagaagctgaccttccagtgtggctctgatgccggctacgacagatttgttctgtacaaggagtggggacgtgacttcctccagcgccctggccggcagccccaggctgggctctcccaggccaacttcaccctgggccctgtgagccgctcctacgggggccagtacacatgctccggtgcatacaacctctcctccgagtggtcggcccccagcgaccccctggacatcctgatcacaggacagatccgtgccagacccttcctctccgtgcggccgggccccacagtggcctcaggagagaacgtgaccctgctgtgtcagtcacagggagggatgcacactttccttttgaccaaggagggggcagctgattccccgctgcgtctaaaatcaaagcgccaatctcataagtaccaggctgaattccccatgagtcctgtgacctcggcccacgcggggacctacaggtgctacggctcactcagctccaacccctacctgctgactcaccccagtgaccccctggagctcgtggtctcaggagcagctgagaccctcagcccaccacaaaacaagtccgactccaaggctggtgagtgaggagatgcttgccgtgatgacgctgggcacagagggtcaggtcctgtcaagaggagctgggtgtcctgggtggacatttgaagaattatattcattccaacttgaagaattattcaacacctttaacaatgtatatgtgaagtactttattctttcatattttaaaaataaaagataattatccatgagaaaaaaaaaaaaaaaaaaaaaaaaaaaaaaaaaaaaaaaaaaaaaaaaaa

SEQ ID NO: 57903 - DNA, 2221 bp, Homo sapiens
gctcactgccacacgcagctcagcctgggcggcacagccagatgcgagatgcgtctctgctgatctgagtctgcctgcagcatggacctgggtcttccctgaagcatctccagggctggagggacgactgccatgcaccgagggctcatccatccgcagagcagggcagtgggaggagacgccatgacccccatcgtcacagtcctgatctgtctcgggctgagtctgggccccaggacccacgtgcagacagggaccatccccaagcccaccctgtgggctgagccagactctgtgatcacccaggggagtcccgtcaccctcagttgtcaggggagccttgaagcccaggagtaccgtctatatagggagaaaaaatcagcatcttggattacacggatacgaccagagcttgtgaagaacggccagttccacatcccatccatcacctgggaacacacagggcgatatggctgtcagtattacagccgcgctcggtggtctgagctcagtgaccccctggtgctggtgatgacaggagcctacccaaaacccaccctctcagcccagcccagccctgtggtgacctcaggaggaagggtgaccctccagtgtgagtcacaggtggcatttggcggcttcattctgtgtaaggaaggagaagatgaacacccacaatgcctgaactcccagccccatgcccgtgggtcgtcccgcgccatcttctccgtgggccccgtgagcccgaatcgcaggtggtcgcacaggtgctatggttatgacttgaactctccctatgtgtggtcttcacccagtgatctcctggagctcctggtcccaggtgtttctaagaagccatcactctcagtgcagccgggtcctgtcgtggcccctggggaaagcctgaccctccagtgtgtctctgatgtcggctatgacagatttgttctgtacaaggagggggaacgtgaccttcgccagctccctggccggcagccccaggctgggctctcccaggccaacttcaccctgggccctgtgagccgctcctacgggggccagtacagatgctacggtgcatacaacctctcctccgagtggtcggcccccagcgaccccctggacatcctgatcacaggacagatccatggcacacccttcatctcagtgcagccaggccccacagtggcctcaggagagaacgtgaccctgctgtgtcagtcatggcggcagttccacactttccttctgaccaaggcgggagcagctgatgccccactccgtctaagatcaatacacgaatatcctaagtaccaggctgaattccccatgagtcctgtgacctcagcccacgcggggacctacaggtgctacggctcactcaactccgacccctacctgctgtctcaccccagtgagcccctggagctcgtggtctcaggaccctccatgggttccagccccccacccaccggtcccatctccacacctgcaggccctgaggaccagcccctcacccccactgggtcggatccccaaagtggtctgggaaggcacctgggggttgtgatcggcatcttggtggccgtcgtcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgacgcccaggaagaaaacctctatgctgccgtgaaggacacacagcctgaagatggggtggagatggacactcgggctgctgcatctgaagccccccaggatgtgacctacgcccagctgcacagcttgaccctcagacggaaggcaactgagcctcctccatcccaggaaagggaacctccagctgagcccagcatctacgccaccctggccatccactagcccggagggtacgcagactccacactcagtagaaggagactcaggactgctgaaggcacgggagctgcccccagtggacaccaatgaaccccagtcagcctggacccctaacaaagaccatgaggagatgctgggaactttgggactcacttgattctgcagtcgaaataactaatatccctacattttttaattaaagcaacagacttctcaataaaagcaggtcgtctcgttccaatct

SEQ ID NO: 57904 - DNA, 3404 bp, Homo sapiens
aaatcatgataaaacattgcaggagctgacagacaaaatagcccatatagagaagaatgtaaccaacctgacggaactgaaaaaacacactacaagaatttcataatgcaatcacaagtactaatagcagaatagacaaagcggaggaaagaatttcagagcttgaagactggctttctgaaataagactggcagacaagaatagagaaaaaagaatgaaaagcaatgaacaaaacctccgagaaatatgggatcatgtaaagagagcgaatctaagactgattggtgtccctgaaagagatggggaaaacggaaccaatttggaaaacgcatttcaggatatcatctatgagaaattccctaacctagctagagaggccaacattcaaattcaggaaatccagagaactccaggaagatactccacgaaaggaacatccccaacacacataatcatcagattctccaaggttgaaacgaaagaaaaaatgttaaaggcagctagagagaaaggccaggtcacctacaaagggaagcccttcagactaacagtggatgtctcagtggaaaacctacaagccagaagagattgggggtcaatactcaacattcttaaagaaactccaacccagaatttcatatctggccaaagtaagcttcacaagcgaagaagaaataagattattttcagacaagcaaatgttaagggaatttgttaccaccagacctgccctacaagagctcctgaaggaagcactaaatgtagaaaggaaagatggttaccagccactccaaaaacacactgaagtactcagaccagtgacactacagagcaaacatgtaagcaagtctgcaaaataaccagctagcatcatgatgaaaggatcaaatccaaacataccaatactaaccttaaattgtaaatgggctaaatgccccaattaaaagacacagagtagcaagctggataaggaactaagatccaatggtatgctgtcttcaagagaaccatctcacatgcaatgacacacataggctcaaaataaaaagatggatgaaaatctaccaagcaaacggaaaacataaaaaagtagcagttgcaatcctagtttctgacaaaacagactttaaatcaacaaagatcaaaaaacacaaagaagggcattacataatggtaaatggttcaattcaacaagaaaatctaactatcctaaatacatatggacccaacacaggagcacccagatttataaagcaagttcttagaggccttcacagagacttagactgccaggcaatgatagtgggagactttttaacaccccactgacaatattagacagatcattgagacagacagttaacaaagatattcaggacctgaactcagcactggatcaaatggacctggtggatatctacagaactctccaccccaaaacaacagaatatacattcttctgatcaccgcaaggcacttactctaaaatcgaccacataatcagaagtaaaacactcctcgacaaatgcaaaagaactgaaatcatgacaaacagtctcttgggccacagaagaatcaaatttgaaatcaagattaagaaattcactcaaaaccatgcaattacatggaaattgaataacctgctcctgaatgacttttgggtaaacaatgaaatttaggcagaaatcaagaagttctatgaaactaatgagaacaaagatacaaagtaccagaatctctgggatacagcaaaggcagtgttaagaaggaaatttatagcactaaatgcccacatcaaaaagttagaaagatctcaagttaataacctaacatcactactaaaagaactagagaagcgagagcaaacaaatcccaaaactagcagaagacaagaaataacaaaaatcagagctgaactgaaggagacagagacatgaaaaacccttcaaaaaatgaaagaatccagaagctgttttttttttctttgaaaaaaagtaataaaatagaccgctagctagacgaataaagaaggaaagagagaagatttgaataaacacaatcagaaatgataaggggaatatttatcactgaccccacagaaatacaaacaaccaccagagaatattgtgaacacctctgggcacataaaccaggaagtctagaagaaatggacaaattcctggacacacacacctccccaaggctgaaccaggaagaaactgaatccctgaacagaccagtaatgagtttggaaattgaggcagtaataaatagcctaccaaccaaaaaaatcccaggaccagatggattcacagctgaattctaccagatgtacaaagaggaactggtagcattcctactgaaactatttcaaaaaattgagaaggagggactcctccctaactcattctatgaggccagcatcatcctgaaaccaaaacctggcagagatacaacaacaaaagaaaacttcaggccagtatccttcatgaacatcaatgcaaaaatcctcaacaaaatgctggcaaactgaatccagcagcacatcaaaaagcttatccaccacgatcaagttggcttcctccctgggatgcaaggttggttcaacatatgcagatcaataaatgtgactcatcacataaacagaactaaagacaaaaaccacatgattatctcaatagatgcagaaaaggcttttaataaaattcaacatcgcttcatgttaaaaactctcaataaactaggtattgaaggaccatgcctcaaaataataagagccatctgtgacaaacgcacagccaacatcatactgaatggacaacagctggaagcattccccttgaaaaccggcacaagacaaggatgccctctctcaccactcctattcaacatagtattggaagttctggccagggcaatcaggcaagtgaaagaaataaagggcatccaaattggaagggaggaagtcaacctatccctgcttgcagatgacatgatcctatatctagaaaaccccgttgtctcagcccaaaggcctcttaagctgataaacaacttcagcaaagtctcagggtacagaatcaatgtgcaaaaatcactagcattcctatacaccagcaacagtaaagccgacagccaaatcagcaatgaactcccattcacaattgctacaaaaagaataaaatacctaggaatacagctaactagggaggtgaaagatctctacaaggagaactacaaaccaccgctcaaagaaatcggagatgacacacaaaaaaatggaaaaacattccaagctcatggataggaagaatcagtattaaaatgggcatactgcccaaagcaatttatagattcaatgctattcccattaaactaccattgacagtcttcacagaacgag

SEQ ID NO: 57905 - DNA, 3404 bp, Homo sapiens
aaatcatgataaaacattgcaggagctgacagacaaaatagcccatgtagagaagaatgtaaccaacctgacggaactgaaaaaacacactacaagaatttcataatgcaatcacaagtactaatagcagaatagacaaagcggaggaaagaatttcagagcttgaagactggctttctgaaataagactggcagacaagaatagagaaaaaagaatgaaaagcaatgaacaaaacctccgagaaatatgggatcacgtaaagagagcgaatctaagactgattggtgtccctgaaagagatggggaaaacggaaccaatttggaaaacgcatttcaggatatcatctatgagaaattccctaacctagctagagaggccaacattcaaattcaggaaatccagagaactccaggaagatactccacgaaaggaacatccccaacacacataatcatcagattctccaaggttgaaacgaaagaaaaaatgttaaaggcggctagagagaaaggccaggtcacctacaaagggaagcccttcagactaacagtggatgtctcagtggaaaacctacaagccagaagagattgggggtcaatactcaacattcttaaagaaactccaacccagaatttcatatctggccaaagtaagcttcataagcgaagaagaaataagattattttcagacaagcaaatgttaagggaatttgttaccaccagacctgccctacaagagctcctgaaggaagcactaaatgtagaaaggaaagatggttaccagccactccaaaaacacactgaagtactcagaccagtgacactacagagcaaacatgtaagcaagtctgcaaaataaccagctagcatcatgatgaaaggatcaaatccaaacataccaatactaaccttaaattgtaaatgggctaaatgccccagttaaaagacacagagtagcaagctggataaggaactaagatccaatggtatgctgtcttcaagagaaccatctcacatgcaatgacacacataggctcaaaataaaaagatggatgaaaatctaccaagcaaacggaaaacataaaaaagcagcagttgcaatcctagtttctgacaaaacagactttaaatcaacaaagatcaaaaaacacaaagaagggcattacataatggtaaatggttcaattcaacaagaaaatctaactatcctaaatacatatggacccaacacaggagcacccagatttataaagcaagttcttagaggccttcacagagacttagactgccaggcaatgatagtgggagactttttaacaccccactgacaatattagacagatcattgagacagacagttaacaaagatattcaggacctgaactcagcactggatcaaatggacctggtggatatctacagaactctccaccccaaaacaacagaatatacattcttctgatcaccgcaaggcacttactctaaaatcgaccacataatcagaagtaaaacactcctcgacaaatgcaaaagaactgaaatcatgacaaacagtctcttgggccacagaagaatcaaatttgaaatcaagattaagaaattcactcaaaaccatgcaattacatggaaattgaataacctgctcctgaatgacttttgggtaaacaatgaaatttaggcagaaatcaagaagttctatgaaactaatgagaacaaagatacaaagtaccagaatctctgggatacagcaaaggcagtgttaagaaggaaatttatagcactaaatgcccacatcaaaaagttagaaagatctcaagttaataacctaacatcactactaaaagaactagagaagcgagagcaaacaaatcccaaaactagcagaagacaagaaataacaaaaatcagagctgaactgaaggagacagagacatgaaaaacccttcaaaaaatgaaagaatccagaagctgttttttttttctttgaaaaaaagtaataaaatagaccgctagctagacgaataaagaaggaaagagagaagatttgaataaacacaatcagaaatgataaggggaatatttatcactgaccccacagaaatacaaacaaccaccagagaatattgtgaacacctctgggcacataaactaggaagtctagaagaaatggacaaattcctggacacacacacctccccaaggctgaaccaggaagaaactgaatccctgaacagaccagtaatgagtttggaaattgaggcagtaataaatagcctaccaaccaaaaaaatcccaggaccagatggattcacagctgaattctaccagatgtacaaagaggaactggtagcattcctactgatactatttcaaaaaattgagaaggagggactcctccctaactcattctatgaggccagcatcatcctgaaaccaaaacctggcagagatacaacaacaaaagaaaacttcaggccagtatccttcatgaacatcaatgcaaaaatcctcaacaaaatgctggcaaactgaatccagcagcacatcaaaaagcttatccaccacgatcaagttggcttcctccctgggatgcaaggttggttcaacatatgcagatcaataaatgtgactcatcacataaacagaactaaagacaaaaaccacatgattatctcaatagatgcagaaaaggcttttgataaaattcaacatcgcttcatgttaaaaactctcaataaactaggtattgaaggaccatgcctcaaaataataagagccatctgtgacaaacgcacagccaacatcatactgaatggacaacagctggaagcattccccttgaaaaccggcacaagacaaggatgccctctctcaccactcctattcaacatagtattggaagttctggccagggcaatcaggcaagtgaaagaaataaagggcatccaaattggaagggaggaagtcaacctatccctgcttgcagatgacatgatcctatatctagaaaaccccgttgtctcagcccaaaggcctcttaagctgataaacaacttcagcaaagtctcagggtacagaatcaatgtgcaaaaatcactagcattcctatacaccagcaacagtaaagccgacagccaaatcagcaatgaactcccattcacaattgctacaaaaagaataaaatacctaggaatacagctaactagggaggtgaaagatctctacaaggagaactacaaaccactgctcaaagaaatcggagatgacacacaaaaaaatggaaaaacattccaagctcatggataggaagaatcagtattaaaatgggcatactgcccaaagcaatttatagattcaatgctattcccattaaactaccattgacagtcttcacagaacgag

SEQ ID NO: 57906 - DNA, 1551 bp, Homo sapiens
ctgcttcggggggtgagcaaactttttaaaatgcagaaattatgatctacacccgtttcttaaaaggcagtctgaagatggccaattacacgctggcaccagaggatgaatatgatgtcctcatagaaggtgaactggagagcgatgaggcagagcaatgtgacaagtatgacgcccaggcactctcagcccagctggtgccatcactctgctctgctgtgtttgtgatcggtgtcctggacaatctcctggttgtgcttatcctggtaaaatataaaggactcaaacgcgtggaaaatatctatcttctaaacttggcagtttctaacttgtgtttcttgcttaccctgcccttctgggctcatgctgggggcgatcccatgtgtaaaattctcattggactgtacttcgtgggcctgtacagtgagacatttttcaattgccttctgactgtgcaaaggtacctagtgtttttgcacaagggcaactttttctcagccaggaggagggtgccctgtggcatcattacaagtgtcctggcatgggtaacagccattctggccactttgcctgaatacgtggtttataaacctcagatggaagaccagaaatacaagtgtgcatttagcagaactcccttcctgccagctgatgagacattctggaagcattttctgactttaaaaatgaacatttcggttcttgtcctccccctatttatttttacatttctctatgtgcaaatgagaaaaacactaaggttcagggagcagaggtatagccttttcaagcttgtttttgccataatggtagtcttccttctgatgtgggcgccctacaatattgcatttttcctgtccactttcaaagaacacttctccctgagtgactgcaagagcagctacaatctggacaaaagtgttcacatcactaaactcatcgccaccacccactgctgcatcaaccctctcctgtatgcgtttcttgatgggacatttagcaaatacctctgccgctgtttccatctgcgtagtaacaccccacttcaacccagggggcagtctgcacaaggcacatcgagggaagaacctgaccattccaccgaagtgtaaactagcatccaccaaatgcaagaagaataaacatggattttcatctttctgcattatttcatgtaaattttctacacatttgtatacaaaatcggatacaggaagaaaagggagaggtgagctaacatttgctaagcactgaatttgtctcaggcaccgtgcaaggctctttacaaacgtgagctccttcgcctcctaccacttgtccatagtgtggataggactagtctcatttctctgagaagaaaactaaggcgcggaaatttgtctaagatcacataactaggaagtggcagaactgattctccagccctggtagcatttgctcagagcctacgcttggtccagaacatcaaactccaaaccctggggacaaacgacatgaaataaatgtattttaaaacatctatttaataaaaaacaaagaaaaataaagaaa

SEQ ID NO: 57907 - DNA, 1529 bp, Homo sapiens
ggaagctgcttcggggggcaagtcctgtttctgctaaaagaagggcagtctgaagatggccaattacacgctggcaccagaggatgaatatgatgtcctcatagaaggtgaactggagagcgatgaggcagagcaatgtgacaagtatgacgcccaggcactctcagcccagctggtgccatcactctgctctgctgtgtttgtgatcggtgtcctggacaatctcctggttgtgcttatcctggtaaaatataaaggactcaaacgcgtggaaaatatctatcttctaaacttggcagtttctaacttgtgtttcttgcttaccctgcccttctgggctcatgctgggggcgatcccatgtgtaaaattctcattggactgtacttcgtgggcctgtacagtgagacatttttcaattgccttctgactgtgcaaaggtacctagtgtttttgcacaagggcaactttttctcagccaggaggagggtgccctgtggcatcattacaagtgtcctggcatgggtaacagccattctggccactttgcctgaatacgtggtttataaacctcagatggaagaccagaaatacaagtgtgcatttagcagaactcccttcctgccagctgatgagacattctggaagcattttctgactttaaaaatgaacatttcggttcttgtcctccccctatttatttttacatttctctatgtgcaaatgagaaaaacactaaggttcagggagcagaggtatagccttttcaagcttgtttttgccataatggtagtcttccttctgatgtgggcgccctacaatattgcatttttcctgtccactttcaaagaacacttctccctgagtgactgcaagagcagctacaatctggacaaaagtgttcacatcactaaactcatcgccaccacccactgctgcatcaaccctctcctgtatgcgtttcttgatgggacatttagcaaatacctctgccgctgtttccatctgcgtagtaacaccccacttcaacccagggggcagtctgcacaaggcacatcgagggaagaacctgaccattccaccgaagtgtaaactagcatccaccaaatgcaagaagaataaacatggattttcatctttctgcattatttcatgtaaattttctacacatttgtatacaaaatcggatacaggaagaaaagggagaggtgagctaacatttgctaagcactgaatttgtctcaggcaccgtgcaaggctctttacaaacgtgagctccttcgcctcctaccacttgtccatagtgtggataggactagtctcatttctctgagaagaaaactaaggcgcggaaatttgtctaagatcacataactaggaagtggcagaactgattctccagccctggtagcatttgctcagagcctacgcttggtccagaacatcaaactccaaaccctggggacaaacgacatgaaataaatgtattttaaaacatctatttaataaaaaacaaagaaaaataaagaaa

SEQ ID NO: 57908 - DNA, 1795 bp, Homo sapiens
cacagggaaatcaaaggcggggtacagggccagagggaggaggaaacaacttcccggttgctttcagacgcttcagagatcctctggaggcctgggggagcttttgagtactttatttcagttggtccctgagctcggtgagtggggcgggtagagccaccaggggaatcaacagtggtttctcgtgcccctcagggtcaggagcagtctgatcaaaaggagggcatccactgtccggggccattcccacagctcccggatgctgggtctggaggctgcgcccttcccctgcaggagctcagcccagtgggcagtctgaagatggccaattacacgctggcaccagaggatgaatatgatgtcctcatagaaggtgaactggagagcgatgaggcagagcaatgtgacaagtatgacgcccaggcactctcagcccagctggtgccatcactctgctctgctgtgtttgtgatcggtgtcctggacaatctcctggttgtgcttatcctggtaaaatataaaggactcaaacgcgtggaaaatatctatcttctaaacttggcagtttctaacttgtgtttcttgcttaccctgcccttctgggctcatgctgggggcgatcccatgtgtaaaattctcattggactgtacttcgtgggcctgtacagtgagacatttttcaattgccttctgactgtgcaaaggtacctagtgtttttgcacaagggcaactttttctcagccaggaggagggtgccctgtggcatcattacaagtgtcctggcatgggtaacagccattctggccactttgcctgaatacgtggtttataaacctcagatggaagaccagaaatacaagtgtgcatttagcagaactcccttcctgccagctgatgagacattctggaagcattttctgactttaaaaatgaacatttcggttcttgtcctccccctatttatttttacatttctctatgtgcaaatgagaaaaacactaaggttcagggagcagaggtatagccttttcaagcttgtttttgccataatggtagtcttccttctgatgtgggcgccctacaatattgcatttttcctgtccactttcaaagaacacttctccctgagtgactgcaagagcagctacaatctggacaaaagtgttcacatcactaaactcatcgccaccacccactgctgcatcaaccctctcctgtatgcgtttcttgatgggacatttagcaaatacctctgccgctgtttccatctgcgtagtaacaccccacttcaacccagggggcagtctgcacaaggcacatcgagggaagaacctgaccattccaccgaagtgtaaactagcatccaccaaatgcaagaagaataaacatggattttcatctttctgcattatttcatgtaaattttctacacatttgtatacaaaatcggatacaggaagaaaagggagaggtgagctaacatttgctaagcactgaatttgtctcaggcaccgtgcaaggctctttacaaacgtgagctccttcgcctcctaccacttgtccatagtgtggataggactagtctcatttctctgagaagaaaactaaggcgcggaaatttgtctaagatcacataactaggaagtggcagaactgattctccagccctggtagcatttgctcagagcctacgcttggtccagaacatcaaactccaaaccctggggacaaacgacatgaaataaatgtattttaaaacatctatttaataaaaaacaaagaaaaataaagaaa

SEQ ID NO: 57909 - DNA, 3350 bp, Homo sapiens
agttgccaagatggccgaacaggaacagctccagtctgcagctcccagcatgaccaatgcagaaggtggatgatttctgcatttccaactgaggtacctggttcatctcattcggactggttggacagtgggaacagcccacggagggcgagctgaagcagggcggggcgttgactcacccgggaagcgcaaggtgttgggggatttccctttcctagccaagggaagccgtgacagactacctggaaaagcgggacactccctgcccaaatactatgcttttaccaaggtcttagcaaccggcagacaaggtgattctctcccgtgcctggctcggcagctcccacgcccacggagccttgcttactgctagcacagcagtctgagatgcatctgcgaggcggcagcctggctgggggaggggtatccgccattgctgaggcttgagtaggtaaacaaagcagccaggaagctcgaactgggcggagcccacctcagctcaacaacgcctactgcctctagactccacctctgtgggcagggcacagctgaagaaaaggcagcagacaacttctgcagacttaaacatccctgtctgacagctctgaagagagcagtggttctcccaacacagcgtttgagatctgagaacagacagactgcctcttcaagtgggtccctgacccccgtgtagcctaactgggagacacctcccagtagggtccaacagatacctcatatatgcagctgcccctctgggacgaagcttccagaggaagtatcacgcagcaatatttgctgttctgcaatatttgctgttctgtagcctccgctggtgatacccaggcaaacagggtctggagtggaactccagcaaactccaacagacctgaagctgagggacctgactgttagaaggaaaactaacaaacagaaaggaatagcatcaacatcagcaaaaaggtcatctacaccaaaaccacatctacaggtcaccaacatcaaagaccaaagatagataaaaccacaaagatggggagaaaccagagcagaaaagctgaaaattctaaaaatgagagcacctcttctcctccaaagggtcacagctcctcaccagcaacggaacaaagtgggacggagaatgactttgacgagttgacagaagtaggcttcagaaggtcggtaacaacaaacttctacgagctgaaggaggatgttcaaactcatcgcaaggaagctaaaaaccttgaaaaaagattagacaaatggctaactagaataaacagtgtagagaagaccttaagtgacatgatggagctgaaaaccatggcacgagaacttcgtgacacatgctcaagcttcaagagccgattcaatcaagtggaagaaagggtatcagtgattgaagatcaaattaatgaagtaaagcgagaagacaaggttagagataaaaaagtaagaaacaaacaaagcctccaagaaatatgggactatgtcaaaagaccaaatctacgtgtgattggtgtacctgaaagtgatggggagaatggaaccaagttggaaaatatgcttcaggatattatccaggagaacttccccaacctagcaaggcaggccaacattcaaattcaggaaatacagagaacgccacaaagatactcctcgagaagagcaaccccaagacacataattgtcagattcaccaaggttgaaatgaagcaaaaagtgttaagggcagccagagagaaaggtccagttacccacaaagggaacagcggatctctcagctgaaacgctacaagacagaagagagtgggggccaatattcaacattcttaaagaaaagaattttcaacccagaatttcatatccagccaaactaaacttcataagtgaaggagaaataaaatcctttacagataagcaaatgctgacagattttgtcaccaccaggcctgtcttacaagagctcctgaaggaagcactaaacgtggaaagaaacaactggtaccagccactgcaaaaacatgccaaattgtaaagaccatcgatgctaagaagaaactgcatcaattaacaggcaaaataaccagcaaacatcataatgacagggtcaaattcacacataacaatattaaccttaaatgtaaatgggctaaataccccaattaaaagacacagactggcaagttggataaagagtcaagacccatcagtgtgctgtattcaggagacccatctcatatgcaaagacgcatacaggctcaaaataaagggatggaggaagatctaccaagcaaacagaaagcaaaaaaaagcaggggttgcaatcctagtctctgataaatcagattttaaaccaacaaagatcaaaagagacaaaaaaggccattacataatggtaaagggatcaatgcaacaagaagagctaactatcctaaatatatatgcacccaatacaggagcacccagattcataaatgaagtccttagagacccacagagaaacttagactcccacacaataataatgggagactttaacaccccattgtcaatatttgacagatcaacgagacagaaggttaacaaggatacccaggacctgaatttgactctgcaacaagcagacctaagagacatctacaggactctccaccccaaatcaacagaatatacattcttctcagcactacatcacacttattctaaaactgaccacatacttggaagtaaagcactcctcagcaaatgtaaaagaacagaaatcacaacaaactgtctctcagaccacagtgcaatcaaactagaactcaggattaagaaactcactcaataccacataagtacatggaaactgaacaacttgctcctgaatgactactgggtaaataactaaatgaaggcagaaataaaaatgttctttgaaaccaatgagaacaaagacacaacgtaccggaatctctgggacacatttaaagcagtgtgtagagggaaatttatagcactaaatgcccacaagagaaagcaggaaagatctaaaatcgacaccctaacatcacaattaaaagaactagctgggcaccgtggctcatgcctgtaatcccagcactttgggaggccaaggtgggcagatcacaaggtcaggagatcgagaccatcccggctaacacggtgaaaccccatctctactaaaaatacaaaaaattagccgggcatggtggtgggcgcctgtagtcccagctacttgggaggctgaggcaggagaatggcgtgaacccgggaggcggagcttgcaatgagctgagatcgcgccattgcactccagcctgggtgacagagccagactc

SEQ ID NO: 57910 - DNA, 773 bp, Homo sapiens
cgcaggcagcaaagagtagtcagtcccttcttggctctgctgacactcgagcccacattccatcacctgctcccaatcatgcaggtctccactgctgcccttgccgtcctcctctgcaccatggctctctgcaaccaggtcctctctgcaccacttgctgctgacacgccgaccgcctgctgcttcagctacacctcccgacagattccacagaatttcatagctgactactttgagacgagcagccagtgctccaagcccagtgtcatcttcctaaccaagagaggccggcaggtctgtgctgaccccagtgaggagtgggtccagaaatacgtcagtgacctggagctgagtgcctgaggggtccagaagcttcgaggcccagcgacctcagtgggcccagtggggaggagcaggagcctgagccttgggaacatgcgtgtgacctctacagctacctcttctatggactggttattgccaaacagccacactgtgggactcttcttaacttaaattttaatttatttatactatttagtttttataatttatttttgatttcacagtgtgtttgtgattgtttgctctgagagttccccctgtcccctccaccttccctcacagtgtgtctggtgacaaccgagtggctgtcatcggcctgtgtaggcagtcatggcaccaaagccaccagactgacaaatgtgtatcagatgcttttgttcagggctgtgatcggcctggggaaataataaagatgttcttttaaacgg

SEQ ID NO: 57911 - DNA, 1185 bp, Homo sapiens
caaagagtagtcagtcccttcttggctctgctgacactcgagcccacattccatcacctgctcccaatcatgcaggtctccactgctgcccttgccgtcctcctctgcaccatggctctctgcaaccaggtcctctctgcaccacttgctgctgacacgccgaccgcctgctgcttcagctacacctcccgacagattccacagaatttcatagctgactactttgagacgagcagccagtgctccaagcccagtgtcatgtaagtgccagtcttcctgctcacctctagggaggtagggagtgtcagggtgggggcagaaacaggccagaaggccatcctggaaaggcccagccttcaggagcctatcggggatacaggacgcagggcactgaggtgtgacctgacttggggctggagtgaggtgggtgttacagagtcaggaagggctgccccaggccagaggaaaggaacaggaagaaggaggcagcaggacactctgagggcccccttgcctggagtcactgagagaagctctctagacggagataggcagggggcccctgagagaggagcaggccttgagctgcccaggacagagagcaggatgtcagggccatggtgggcccaggattccccggctggattccccagtgcttaactcttcctcccttctccacagcttcctaaccaagagaggccggcaggtctgtgctgaccccagtgaggagtgggtccagaaatacgtcagtgacctggagctgagtgcctgaggggtccagaagcttcgaggcccagcgacctcagtgggcccagtggggaggagcaggagcctgagccttgggaacatgcgtgtgacctctacagctacctcttctatggactggttattgccaaacagccacactgtgggactcttcttaacttaaattttaatttatttatactatttagtttttataatttatttttgatttcacagtgtgtttgtgattgtttgctctgagagttccccctgtcccctccaccttccctcacagtgtgtctggtgacaaccgagtggctgtcatcggcctgtgtaggcagtcatggcaccaaagccaccagactgacaaatgtgtatcagatgcttttgttcagggctgtgatcggcctggggaaataataaagatgttcttttaaacgg

SEQ ID NO: 57912 - DNA, 1195 bp, Homo sapiens
gtaatttgatcgtctgaagccttcttctctcagctcgtcaaagtcattctccgtccagctttgttccgttgctggtgaggagctgcgtttctttggaggaggagaggcactgcgttcctttggaggaggagagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctgtgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatacaatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttattgatgttgatgttgacgacctgatcacctggctgaaggagtgtttgtcaggtttctgcattgtaaagttactcttctcccccatttcatactgtgctctttggaaggaaatcactatgcacagcccacactaaaggaatggggagttgtagtgtactttcttgggagtggtctacataattaattgaaattcttctgcaagggacaaaaaaa

SEQ ID NO: 57913 - DNA, 1734 bp, Homo sapiens
accctatgaatgtacgcagtgtgggaaagcattatcctctcttacaagttttcaaacacacataagaatgcactctggagaaagaccttatgaatgtaagatatgtgggaaaggcttttgttctgccaattcatttcaaagacatgaaaaaactcacagtggagagaaaccctataaatgcaagcaatgtggtaaagccttcattcattccagttcccttcgttatcatgaaaggattcacactggagagaaaccctatgagtgtaagcaatgtgggaaggccttcagatcttcctcacaccttcaattgcatggtaggactcacactggagagaagccctatgaatgtcaggaatgtgggaaagccttcagatctatgaagaaccttcaaagtcatgaaaggacacaaacacacgtaagaatacactctggagaaagaccttataaatgtaagctatgtgggaaaggcttttattgtcccaaatcattgcaaagacatgaaaaaactcacactggagagaaactctatgaatgcaagcaatgtggtgaagccttcagtagttccagttcctttcgataccatgaaaggactcacactggagagaaaccctataaatgcaagcaatgtgggaaagccttcagagctgcctcagtccttcgaatgcatggtaggactcaccctgaagataaaccctatgagtgtaagcaatgagggaaagccttcagatctgcctcacacctttgaatgcatggtaggacacacaatcaagagaaaccatgaatgtaaagaatgtgggaaacccttcaggtctgcccagaaccttcgaattcagtaaaggacacaagcacacataagaatgcattctggatagctgaacaaaaggcagcagaaacttctgcagacttaaatgtccctgtctgacagctttgaagagagtagcagtcctcccagcatggagtttgagatctaagaatggacagtctgcctcctcaagtgggtccctgatctccaagtagcctaactgggaggcacttcccagtaggggccaactgacacctcatacggccgtgtgcccctctgtgacgaagcttccagaggaaggatcaggcaacaacatttgccgttctgcaatatttgctgttctgcagcccctgctggtgatacccaggcaaacagggtctggagtggacctcaagcaaaatccaacagacctcagctgagggtcctgactgttagaaggaaaactaacaaacagaaaggacaaccacaccaaaacccatctgtacatcaccatcatcaaagaccaaaagtagataaaaccacaaagatggggagaaaccagagcagaaaagctgaaaattctaaacatcagagcgcctcttctcctccaaaggaacgcagctcctcgccagcaatggaacaaagctggactttgactttgacgagctgagagaagaaggcttcagatgatcggtaataacaaacttctccaagctaaaggaggatgttcgaacccatcacaaagaagctaaaaaccttgaaaaaagattagacaaaatggctaactagaataaacagtgtagagaagaccttaaatgacccgatggagctgaaaaccatggcacgagaactatgtgatgcatgcacaagcttcagtagctgattcaatcaagtggaagaaaaggtatcagtaattgaagatcaaatggatgaaatgaagtgagaagagaagt

SEQ ID NO: 57914 - DNA, 1017 bp, Homo sapiens
atggggaaaaaacagaacagaaaaactggaaactctaaaatgcagagcgcctctcctcctccaaaggaacgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaaagttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagggagtgggggccaatattcaacattcttaaagaaaagaattttcaacccagaatttcatatccagccaaactaagcttcataagtgaaggagaaataaaatacttcatagacaagcaaatgctgagagattttgtcaccaccaggcctgccctaaaagagctcctgaaggaagcgctaaacatggaaaggaacaaccggtaccagccgctgcaaaatcatgccaaaatgtaa

SEQ ID NO: 57915 - DNA, 3350 bp, Homo sapiens
agttgccaagatggccgaacaggaacagctccagtctgcagctcccagcatgaccaatgcagaaggtggatgatttctgcatttccaactgaggtacctggttcatctcattcggactggttggacagtgggaacagcccacggagggcgagctgaagcagggcggggcgttgactcacccgggaagcgcaaggtgttgggggatttccctttcctagccaagggaagccgtgacagactacctggaaaagcgggacactccctgcccaaatactatgcttttacgaaggtcttagcaaccggcagacaaggtgattctctcccgtgcctggctcggcagctcccacgcccacggagccttgcttactgctagcacagcagtctgagatgcatctgcgaggcggcagcctggctgggggaggggtatccgccattgctgaggcttgagtaggtaaacaaagcagccaggaagctcgaactgggcggagcccacctcagctcaacaacgcctactgcctctagactccacctctgtgggcagggcacagctgaagaaaaggcagcagacaacttctgcagacttaaacatccctgtctgacagctctgaagagagcagtggttctcccaacacagcgtttgagatctgagaacagacagactgcctcttcaagtgggtccctgacccccgtgtagcctaactgggagacacctcccagtagggtccaacagatacctcatatatgcagctgcccctctgggacgaagcttccagaggaagtatcacgcagcaatatttgctgttctgcaatatttgctgttctgtagcctccgctggtgatacccaggcaaacagggtctggagtggaactccagcaaactccaacagacctgaagctgagggacctgactgttagaaggaaaactaacaaacagaaaggaatagcatcaacatcagcaaaaaggtcatctacaccaaaaccacatctacaggtcaccaacatcaaagaccaaagatagataaaaccacaaagatggggagaaaccagagcagaaaagctgaaaattctaaaaatgagagcacctcttctcctccaaagggtcacagctcctcaccagcaacggaacaaagtgggacggagaatgactttgacgagttgacagaagtaggcttcagaaggtcggtaacaacaaacttctacgagctgaaggaggatgttcaaactcatcgcaaggaagctaaaaaccttgaaaaaagattagacaaatggctaactagaataaacagtgtagagaagaccttaagtgacatgatggagctgaaaaccatggcacgagaacttcgtgacacatgctcaagcttcaagagccgattcaatcaagtggaagaaagggtatcagtgattgaagatcaaattaatgaagtaaagcgagaagacaaggttagagataaaaaagtaagaaacaaacaaagcctccaagaaatatgggactatgtcaaaagaccaaatctacgtgtgattggtgtacctgaaagtgatggggagaatggaaccaagttggaaaatatgcttcaggatattatccaggagaacttccccaacctagcaaggcaggccaacattcaaattcaggaaatacagagaacgccacaaagatactcctcgagaagagcaaccccaagacacataattgtcagattcaccaaggttgaaatgaagcaaaaagtgttaagggcagccagagagaaaggtccagttacccacaaagggaacagcggatctctcagctgaaacgctacaagacagaagagagtgggggccaatattcaacattcttaaagaaaagaattttcaacccagaatttcatatccagccaaactaaacttcataagtgaaggagaaataaaatcctttacagataagcaaatgctgacagattttgtcaccaccaggcctgtcttacaagagctcctgaaggaagcactaaacgtggaaagaaacaactggtaccagccactgcaaaaacatgccaaattgtaaagaccatcgatgctaagaagaaactgcatcaattaacaggcaaaataaccagcaaacatcataatgacagggtcaaattcacacataacaatattaaccttaaatgtaaatgggctaaataccccaattaaaagacacagactggcaagttggataaagagtcaagacccatcagtgtgctgtattcaggagacccatctcatatgcaaagacgcatacaggctcaaaataaagggatggaggaagatctaccaagcaaacagaaagcaaaaaaaagcaggggttgcaatcctagtctctgataaatcagattttaaaccaacaaagatcaaaagagacaaaaaaggccattacataatggtaaagggatcaatgcaacaagaagagctaactatcctaaatatatatgcacccaatacaggagcacccagattcataaatgaagtccttagagacccacagagaaacttagactcccacacaataataatgggagactttaacaccccattgtcaatatttgacagatcaacgagacagaaggttaacaaggatacccaggacctgaatttgactctgcaacaagcagacctaagagacatctacaggactctccaccccaaatcaacagaatatacattcttctcagcactacatcacacttattctaaaactgaccacatacttggaagtaaagcactcctcagcaaatgtaaaagaacagaaatcacaacaaactgtctctcagaccacagtgcaatcaaactagaactcaggattaagaaactcactcaataccacataagtacatggaaactgaacaacttgctcctgaatgactactgggtaaataactaaatgaaggcagaaataaaaatgttctttgaaaccaatgagaacaaagacacaacgtaccggaatctctgggacacatttaaagcagtgtgtagagggaaatttatagcactaaatgcccacaagagaaagcaggaaagatctaaaatcgacaccctaacatcacaattaaaagaactagctgggcaccgtggctcatgcctgtaatcccagcactttgggaggccaaggtgggcagatcacaaggtcaggagatcgagaccatcccggctaacacggtgaaaccccatctctactaaaaatacaaaaaattagccgggcatggtggtgggcgcctgtagtcccagctacttgggaggctgaggcaggagaatggcgtgaacccgggaggcggagcttgcaatgagctgagatcgcgccattgcactccagcctgggtgacagagccagactc

SEQ ID NO: 57916 - DNA, 1734 bp, Homo sapiens
accctatgaatgtacgcagtgtgggaaagcattatcctctcttacaagttttcaaacacacataagaatgcactctggagaaagaccttatgaatgtaagatatgtgggaaaggcttttgttctgccaattcatttcaaagacatgaaaaaactcacagtggagagaaaccctataaatgcaagcaatgtggtaaagccttcattcattccagttcccttcgttatcatgaaaggattcacactggagagaaaccctatgagtgtaagcaatgtgggaaggccttcagatcttcctcacaccttcaattgcatggtaggactcacactggagagaagccctatgaatgtcaggaatgtgggaaagccttcagatctatgaagaaccttcaaagtcatgaaaggacacaaacacacgtaagaatacactctggagaaagaccttataaatgtaagctatgtgggaaaggcttttattgtcccaaatcattgcaaagacatgaaaaaactcacactggagagaaactctatgaatgcaagcaatgtggtgaagccttcagtagttccagttcctttcgataccatgaaaggactcacactggagagaaaccctataaatgcaagcaatgtgggaaagccttcagagctgcctcagtccttcgaatgcatggtaggactcaccctgaagataaaccctatgagtgtaagcaatgagggaaagccttcagatctgcctcacacctttgaatgcatggtaggacacacaatcaagagaaaccatgaatgtaaagaatgtgggaaacccttcaggtctgcccagaaccttcgaattcagtaaaggacacaagcacacataagaatgcattctggatagctgaacaaaaggcagcagaaacttctgcagacttaaatgtccctgtctgacagctttgaagagagtagcagtcctcccagcatggagtttgagatctaagaatggacagtctgcctcctcaagtgggtccctgatctccaagtagcctaactgggaggcacttcccagtaggggccaactgacacctcatacggccgtgtgcccctctgtgacgaagcttccagaggaaggatcaggcaacaacatttgccgttctgcaatatttgctgttctgcagcccctgctggtgatacccaggcaaacagggtctggagtggacctcaagcaaaatccaacagacctcagctgagggtcctgactgttagaaggaaaactaacaaacagaaaggacaaccacaccaaaacccatctgtacatcaccatcatcaaagaccaaaagtagataaaaccacaaagatggggagaaaccagagcagaaaagctgaaaattctaaacatcagagcgcctcttctcctccaaaggaacgcagctcctcgccagcaatggaacaaagctggactttgactttgacgagctgagagaagaaggcttcagatgatcggtaataacaaacttctccaagctaaaggaggatgttcgaacccatcacaaagaagctaaaaaccttgaaaaaagattagacaaaatggctaactagaataaacagtgtagagaagaccttaaatgacccgatggagctgaaaaccatggcacgagaactatgtgatgcatgcacaagcttcagtagctgattcaatcaagtggaagaaagggtatcagtaattgaagatcaaatggatgaaatgaagtgagaagagaagt

SEQ ID NO: 57917 - DNA, 1838 bp, Homo sapiens
aagaaagaagtcaacttttcttcccctacttccctgcatttctcctctgtgctcactgccacacgcagctcaacctggacggcacagccagaggcgagatgcttctctgctgatctgagtctgcctgcagcatggacctgggtcttccctgaagcatctccagggctggagggacgactgccatgcaccgagggctcatccatccgcagagcagggcagtgggaggagacgccatgacccccatcgtcacagtcctgatctgtctcgggctgagtctgggccccaggacccacgtgcagacagggaccatccccaagcccaccctgtgggctgagccagactctgtgatcacccaggggagtcccgtcaccctcagttgtcaggggagccttgaagcccaggagtaccgtctatatagggagaaaaaatcagcatcttggattacacggatacgaccagagcttgtgaagaacggccagttccacatcccatccatcacctgggaacacacagggcgatatggctgtcagtattacagccgcgctcggtggtctgagctcagtgaccccctggtgctggtgatgacaggagcctacccaaaacccaccctctcagcccagcccagccctgtggtgacctcaggaggaagggtgaccctccagtgtgagtcacaggtggcatttggcggcttcattctgtgtaaggaaggagaagatgaacacccacaatgcctgaactcccagccccatgcccgtgggtcgtcccgcgccatcttctccgtgggccccgtgagcccgaatcgcaggtggtcgcacaggtgctatggttatgacttgaactctccctatgtgtggtcttcacccagtgatctcctggagctcctggtcccaggtgtttctaagaagccatcactctcagtgcagccgggtcctgtcgtggcccctggggaaagcctgaccctccagtgtgtctctgatgtcggctatgacagatttgttctgtacaaggagggggaacgtgaccttcgccagctccctggccggcagccccaggctgggctctcccaggccaacttcaccctgggccctgtgagccgctcctacgggggccagtacagatgctacggtgcacacaacctctcctctgagtgctcggcccccagcgaccccctggacatcctgatcacaggacagatccgtggcacacccttcatctcagtgcagccaggccccacagtggcctcaggagagaacgtgaccctgctgtgtcagtcatggcggcagttccacactttccttctgaccaaggcgggagcagctgatgccccactccgtctaagatcaatacacgaatatcctaagtaccaggctgaattccccatgagtcctgtgacctcagcccacgcggggacctacaggtgctacggctcactcaactccgacccctacctgctgtctcaccccagtgagcccctggagctcgtggtctcaggaccctccatgggttccagccccccacccaccggtcccatctccacacctgcaggccctgaggaccagcccctcacccccactgggtcggatccccaaagtggtctgggaaggcacctgggggttgtgatcggcatcttggtggccgtcgtcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgacgcccaggaagaaaacctctgtgagtga

SEQ ID NO: 57918 - DNA, 6245 bp, Homo sapiens
gagaagaagtggcaggtgatgctgaagcgggggagaagcggcagagccggccacacagtgcaggggatggagacaggtgctgggctggtcctcctgcagcatcctcagttgttggagggcagtcatcctcaggccgtacccagccagagaagaaaaagaacagtgtgaagccacgtgtgatagccgtccaacatcggctcttccctccaattacattgtagttgattgtgtctcaaaccatgaattatgtgggacagctggctgggcaggtgattgtcactgtgaaggaactctacaagggcattaaccaggccaccctctctgggtgcattgatgtcatcgtggtacagcagcaggatggcagctatcagtgttcaccttttcacgttcggtttggaaagctgggagtcctgagatccaaagagaaagtgattgatatagaaatcaacggcagtgcagtggatcttcacatgaagttgggtgataacggagaagctttctttgttgaggagactgaagaagaatatgaaaagcttcctgcttaccttgccacctcaccaattcctactgaagatcagttctttaaagatattgacacccctttggtgaaatcgggtggagatgaaacaccatctcagagttcagacatctcacacgtcttggaaacagagacaatttttactccaagttctgtgaaaaagaaaaaacgaaggagaaagaaatacaaacaggacagtaagaaggaagagcaggccgcatctgctgctgcagaagacacatgtgatgtaggcgtgagctccgatgatgacaagggggcccaggcagcacgaggatcttcaaatgcttccttgaaagaagaagaatgtaaagagcctttgctcttccattctggggatcattaccccttatctgatggagattggtcccctttagagaccacctatccccagacagcgtgtcctaagagtgattcagagctggaggtgaaacctgcggagagcctgctcagatcagagtctcacatggagtggacgtggggcggattcccagagtccaccaaggtcagcaaaagagaacgatctgaccatcatcctaggacagctacaattacaccatcagaaaatactcattttcgggtaattcccagtgaggacaacctcatcagtgaagttgagaaggatgcttccatggaagacactgtctgtaccatagtgaagcccaaacccagagccctgggtacacagatgagcgacccaacatctgtggcagagcttctcgaacctcctcttgagagtactcagatttcatctatgttagatgctgaccaccttcccaacgcagccttagcggaggcgccctcagaatccaaaccggcagctaaagtagactcgccgtcaaagaagaaaggtgttcacaaaagaagccaacaccagggacctgatgatatttaccttgatgacttaaagggtctagaacctgaagttgcagctctttatttccctaaaagtgaatcggagcccggttccaggcagtggcccgagtctgacacactctctggctcccagtccccacagtccgtgggaagcgcagctgcagatagcggcaccgagtgcctctcagattctgccatggacttgcctgacgttaccctctccctttgcgggggcctcagtgaaaatggagaaatttcaaaagaaaaattcatggagcatatcattacttatcacgaatttgcagaaaaccctggacttatagacaatcctaaccttgtaataaggatatataatcgttactataactgggctttggcagctcccatgatccttagcttgcaagtattccagaagagcttgcctaaggccacagttgagtcctgggtgaaagacaagatgccaaagaaatctggtcgctggtggttttggcgaaagagagaaagcatgaccaaacagctgccagaatccaaggagggaaaatctgaggcaccgccagccagtgacctgccatccagctccaaggagccggccggtgccaggccggccgagaatgactcctcgagtgacgagggatcacaggagctcgaagaatccatcacagtggaccccatccccacagagcccctgagccacggcagcacaacttcatataagaagtctctccgcctctcctcagaccagatcgcaaaactgaagctccacgatggcccaaatgatgttgtgtttagtattacaacccagtatcaaggcacctgtcgctgtgcagggaccatttacctgtggaactggaatgacaagatcatcatttctgatattgatgggacaataaccaagtcggatgctttgggacagattctcccacagctgggcaaagactggacccaccagggtatagcaaagctctaccattccatcaatgagaatggctacaagtttctgtactgctcggctcgtgccatcggcatggccgacatgacccgtggctacctgcactgggtcaatgacaagggcacaatcttgccccggggccccctgatgctgtcccccagcagcttgttctccgccttccacagagaagtgatagaaaagaaaccagagaagttcaaaattgagtgtctaaatgatatcaagaatctgtttgccccgtctaagcagcccttctatgctgcctttggaaaccgtccaaatgatgtctatgcctacacacaagttggagttccagactgtagaatattcaccgtgaaccccaagggtgaattaatacaagaaagaaccaaaggaaacaagtcatcgtatcacaggctgagtgagctcgtggagcatgtgttcccccttctcagtaaggagcagaattccgcttttccctgcccggagttcagctccttctgctactggcgagacccgatccctgaagtggacctggatgacctgtcttgaggcggcacctcagtgggtgggcagggcttggtccccctccccacagcaagggaaggcagctggctcttctgctgacctcagataccagccttccccagcggggacgggtgcttctggagctggtcccgccatcctcctttgccttcccaggccagctgctcaggctcggcaggtctgcagctcagctcctggaaggagaagggaggaactgggcctggggctggaggcctgggatccctcctttgtgggtcgcacacatgtttcctgctgtgagctggggcctccttccattgcatcattttaaaggaagaaaaaagcagctaaaaaagagtggaccaaaacactgcacacagtgaagtgttccagtttccactgggcagttgaggtggcttctgtaaccagggctgtcttcagatgtcagggtccctgaactgctgcgggcccagtcagtgatgctggctgaagctgcctgtgcacgtttcttctctggtcgcctcatttcctgctacactgaaggggtcagctgctccagtgggccaagttgggcaggacccccgcccctgcagggcccatgcaccagagccactgagcccagtcccataaacctggccctctttggggaaagatccccacagagcatcctcctctcatctgtgacaactccacgagcccttaatttcttagtcctcaccagaagaacaggtctcacaagtatatatttgatgtctgtaataaaagtgggaaggtgggtcttaaaacagaccaaaccccgccccgcccccaacaactctgcttttagggaggcctccgaaatgcagataggcggttgagtggggtcctgggaagagcgctgaatccctctgcttgctgcctggtgtgggcctttggaaagcatcttgccttgggacaggatttctaaaattctgtgattcagatttgtcagggaagcacagtgaagcttgcttaaaggcactggccagcagtgtgtgactttggcttttgggatcacaccctgtaatcgggcccgtggaagcagcgtcaaagaggggtcttggagctcctatggagcagactgccccccgagcagtgtccccagcctagccctgtgagaccccatggggacacgggtgcctatgtattttcactaaaatatacatggtagctccatttactgatgcggttgtaatgagctcacatcgtgtctgaagagatggcaccagggaaaggtgtgccataagctgctccagagcttttggtatgctgagtgttgacagagctgcactcttaacatcaagagaactgtcaggagcccagaaccaaccccaggtcttggtctccattggcgagaacacaggacgtggtggttcctgagcagagagggatctgcagatacaggcttggcgctcggggtggtctcgtggccaactcttcatgcccctgccgttgtagtggaacctctacatgttttagtttgcttcacctaaaataatgctgatctagagatagagaaataggggtggttatttttccagattggagagttgaaagtccctgactgatttcagccattttcctagtgcttgtcggatgcagagacaatgttgaaatcccctaaacacagttctcagtggcaaaacctaggaaggctcatgttcccagagaagggaccacatgagccttctcccatgcaaagcttcccccagcttaaatagttgataaggactaattgtttaatgagtttatttatctacagtaggttagggatcctgggttctgtttatatgaagttcttcccagtttgtgaattctagtacagcagccatgcagccaccttatttcatagatgccatctgtgtgtcctcttgactaccttctatttagaggaagaatgagagctttgtgtgtttaactgagcttatagtaggacttctttgcatatgtatggtactgaaaaatcttaatatacatctttaatcctttttaggttgtcctttaaagagtttttgactagtttctttttcttgacagctcttctctttggacacatgggccttcttagagggttcagtctaggacccggctctcctggccctgtgttgagggtagctggtccctctgtccctgtgtctgctagcactagactttgttgctgcagattgatccagtgggtacataggctaattaatgtgagtctttttccttgtttaaaggagtccctcttgctgaaagtagatgattactattgctgtagtgttaggaaagtattaagtttgtgctgaaaatccattgccatttggtacaaatgacatttgttctttctgtgaaagagatgccctcgagtgtgtttgtacacaaacccttaggatggtgagttgaagcatcaccctcgcgctatcttcagtgacgggtgacggctcagggagatggcaggcagattgggctctaagtcattattctctcagttactccattggtgaaatggccctttccctctttgcagttcagtctaagtctcgtatttgctttgctgtctgtgtgctgaagctcgtcccgtgtgagttgctgtctgccccttgtcaggctgtgaggtgctcgtgtagacctggagcatgcaggctgcctccgtttttgggtactgtgttgtgttttgctctgtctaaaaacatctgcatagttttcaactggaaaaagaaaaaacttaaaaatgggatgtcctaaaatgaaagctgctcaaagtcacagaacaaccgagggacaaaggagattggatgactgggaagcgctggcccggaacagcccctgcaactgtggggcctgcacacagcccttccacagttggcactgcaggtgcaggccaaccctttaaagaataaacaaggaagtcagctctttcactttttacaagttggcaaaaacagacttccggggaatttcgatgttttcccgtgttgtagagcttccagggtttaataaaactggttaaaaattgagtctttccctgaagtaagtgctctttccagatgaaaactactcttttggttttgtttgaaagtaagaaagggaggggaaactttgctcttttaataattatgttcagcctatgatgaagtatttgattattagacagcaatgtcactaataagttttaagttgtccaaagttaattgtaaacatcatcagtacagtactcttagttacagtaaagcaattgttgcaagatgaatggctaatattttggtgcagtgtttgatgttcaaaacaaaatgttacaacaataaacgaacataacataaactgaaaaaaaaaaaaaaaaaa

SEQ ID NO: 57919 - DNA, 765 bp, Homo sapiens
aggctgggggagaagttaaagccagaggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagtaaagaggctggagaggagctggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccacccaaaaaaaaaaaaaaaaaa

SEQ ID NO: 57920 - DNA, 619 bp, Homo sapiens
cacccacccaggcccaggctccttcccctccatcatccccttaccagcacctagaaccatccagggctgaaaagtcccctccaaaccacgtgatgaggaacttgaggcaagtcaccagcccctgatcatttcgcctaaaagagcaaggactagagttcctgacctccaggccagtccctgatccctgacctaatgttatcgcggaatgatgcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccacccaaaaaaaaaaaaaaaaaa

SEQ ID NO: 57921 - DNA, 628 bp, Homo sapiens
aggctgggggagaagttaaagccagaggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatgtaaagaggctggagaggagctggaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccacccaaaaaaaaaaaaaaaaaa

SEQ ID NO: 57922 - DNA, 650 bp, Homo sapiens
aggctgggggagaagttaaagccagaggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccacccaaaaaaaaaaaaaaaaaa

SEQ ID NO: 57923 - DNA, 605 bp, Homo sapiens
aggctgggggagaagttaaagccagaggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatgaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccacccaaaaaaaaaaaaaaaaaa

SEQ ID NO: 57924 - DNA, 2406 bp, Homo sapiens
tctctctctgcttctttccttttctctctcatggtagggttatgagtcagttgccaaaaggtggggacatttcctgatgcatttgcaacactgagaagttatcttaagggaggctgggccccattctactcatctggcccagaaagtgaacaccttgggggccactaaggcagccctgctaggggagacgctccaacctgtcttctctctgtctcctggcagctctcttggcctcctagtttctacctaatcatgtccctggtggaggccatcagcctctggaatgaaggggtgctggcagcggacaagaaggactggaagggagccctggatgccttcagtgccgtccaggacccccactcccggatttgcttcaacattggctgcatgtacactatcctgaagaacatgactgaagcagagaaggcctttaccagaagcattaaccgagacaagcacttggcagtggcttacttccaacgagggatgctctactaccagacagagaaatatgatttggctatcaaagaccttaaagaagccttgattcagcttcgagggaaccagctgatagactataagatcctggggctccagttcaagctgtttgcctgtgaggtgttatataacattgctttcatgtatgccaagaaggaggaatggaaaaaagctgaagaacagttagcattggccacgagcatgaagtctgagcccagacattccaaaatcgacaaggcgatggagtgtgtctggaagcagaagctatatgagccagtggtgatccctgtgggcaagctgtttcgaccaaatgagagacaagtggctcagctggccaagaaggattacctaggcaaggcgacggtcgtggcatctgtggtggatcaagacagtttctctgggtttgcccctctgcaaccacaggcagctgagcctccacccagaccgaaaaccccagagatcttcagggctctggaaggggaggctcaccgtgtgctatttgggtttgtgcctgagacaaaagaagagctccaggtcatgccagggaacattgtctttgtcttgaagaagggcaatgataactgggccacggtcatgttcaacgggcagaaggggcttgttccctgcaactaccttgaaccagttgagctgcggatccaccctcagcagcagccccaggaggaaagctctccgcagtccgacatcccagctcctcctagttccaaagcccctggaagaccccagctgtcaccaggccagaaacaaaaagaagagcctaaggaagtgaagctcagtgttcccatgccctacacactcaaggtgcactacaagtacacggtagtcatgaagactcagcccgggctcccctacagccaggtccgggacatggtgtctaagaaactggagctccggctggaacacactaagctgagctatcggcctcgggacagcaatgagctggtgcccctttcagaagacagcatgaaggatgcctggggccaggtgaaaaactactgcctgactctgtggtgtgagaacacagtgggtgaccaaggctttccagatgaacccaaggaaagtgaaaaagctgatgctaataaccagacaacagaacctcagcttaagaaaggcagccaagtggaggcactcttcagttatgaggctacccaaccagaggacctggagtttcaggaaggggatataatcctggtgttatcaaaggtgaatgaagaatggctggaaggggagtgcaaagggaaggtgggcattttccccaaagtttttgttgaagactgcgcaactacagatttggaaagcactcggagagaagtctaggatgtttcacaaactacaaagctgaagaaaatgaagccctattacttgtttgtaagatttagcacccttctgctgtatactgtactgagacattacagtttggaagtgttaactatttattccctgttaaaatttaacctactagacaatgatgtgagtacccaggatgatttcctggggcacagtgggtgaggagatggggacaggtgaatggaggagttaggggagaggaaaagtggatggaagtgtctggaaagggcacgagagagtcttccaggtactgatcctgtttcttgctctgagtgctagctagccagctgtgttcacactgtaaacattcatcaagctgtacatttggtgcacttttctgtgtcataccacaataaaaaaaaacctagcatcttacaaaaacaagacacccaagtccaggcccaaggagtaagtacaaatattcctgtttctgaaccattactgtaattggctcttaaggcttgaagtaaccttataggttactcataaggcatatacaaataaacttgtttgttttcttttttcaaaaaaaaaaaaaaaaaa

SEQ ID NO: 57925 - DNA, 6609 bp, Homo sapiens
gaattcggcacgagggagccccagaacaggggtccggcggtgcccccagcgtggcccaagatggtgacggagtcgtgctacttccctgcgcagaggggatcggcctgccgcttgccagccgccccaaggctgacagagaggccctcgggagtccgcatctcagcccccaggaagaggaagacgatcgcccactcttccagcccttgcttggtcacaggttacacagatgccaagagaacccgggtggccagcagcagccaacgctcccgtggctccaaggtcggcagacagccagggaagacgcgcaacaggtcagggatggcatgcaagaccaccgccaccaccagctctaagcgaatcgtccgtcgtccatccttaccgagtttgagtttgaagaaacccattatcctccgaagctctgggtgccaagtccccaccgtcctccgccgaggctatctccaactgttcaccgaagagtgtctcaagttctgcgcctccaagcaggaggccgaggagaaggcgctgaacgaggagaaggtggcctacgactgcagccccaacaagaacaggtacctgaacgtggtcctgaacaccctcaagagactgaagggcctgacccccagctccatgcccggcctcagcagggccgccctgtacagccgcctccaggagttcctgctcacccaggaccagctcaaggagaacggctaccccttcccgcaccccgagcggcccggaggcgccgtcctcttcactggccaggggaaggggcccggcgactcctcctgcagggtctgctgccgttgtggcaccgagtacctggtgtcctcctcgggccgctgtgtacgcgaccagttgtgttattatcactgggggcgggtccgctcgagccaggtggctggaggccgggttagccagtacacctgctgtgcagctgctcctggctctgtgggctgccaggtggcaaagcagcacgtgcgggacggccgcaaggagagcctcgatggcttcgtggagaccttcaagaaagagttgtccagagacgcttatccaggaatctacgccttggactgtgagatgtgctacaccacgcatggcctagagctgacccgcgtcaccgtggtggacgccgacatgcgagtggtgtacgacaccttcgtcaagcccgacaacgagatcgtggactacaacaccaggttttccggagtcaccgaggccgacgtcgccaagacgagcatcacgttgccccaagtccaagccatcctgctgagctttttcagcgcccaaaccatcctcatcgggcacagcctggagagcgacctgctggccctgaagctcatccacagcaccgtggtggacacggccgtgctcttcccgcactacctgggtttcccctacaagcgctccctcaggaatctcgcggccgactacctggcacagatcatccaggacagccagaacggccacaactccagcgaggacgcaaacgcctgcctgcagctggtgatgtggaaggtccgacagcgcgcccagatccagccacgccaccggtccgtctctcccgccgccctggcctgtccttagccccaggcctcttccaaaaccgccatcagtcccgagagctcaccctgcccacctcgccgcaaagcgaaagaaactggagcagccggcggcaggagagggcaaaaagccaagagtaaccccaaccccccactcccggtcccccggaatccctgccgcggcccctcgggcctgtccacatccctctgcccctcccagacctctgtccttccaccaatcgcctcccgcagccccgagccgccactcccagtcccccgagtccctgccgcgcgccctcgcgcctgttcacatccctctgcccatccgagacctctgtccttacaccactagccaccccacgtgggacttccatggcttctgagtacaaggccagccccccggcccaccagctttcggaatgcctgcttacctctttttctgtagaggcaccacagggaggtgggtgaagcacttcggctctggagttacagatctgggttcaaggccaaattccaccacttactaggtttgtaatattggacagataacgtctttgcgcttctaccttttggtctttaaagtgtgatcaaaagagacttagactcccacataataataataataataatggcaaacttaacaccccactgtcaacattagacacaccaacgagacagaaagttaaaaaaggatatccgggaattgaactcagctctgcaccaagcggacctaggagacatgtacagaacgctccaccccaaatcaacagaatatacattcttctcagcaccacatcacacttatttccacattgaccacatagttggaagtaaagcactcctcagtaaaagtaaaataacagaaattattacaaacggtctctcagaccacattgcaatcaaactagacctcaggattgagaaactcactcaaaaccgctcaactgcatggaaaccggacaagctgctcctgaatgagtactgggtacataacgaaatgaaggcagaaataaagatattctctgaaagcaatgagaacaaagacacaacataccagaatctctgggacacatttaaagcagtgtgtagagggaaatttatagcactaaatgcccacaagggaaagcaggaaagatcaaaaatgcataccctaacatcaccattaaaagaatgagagaagcaagggcaaacacattcaaaagctagcagaaggcaagaaataactaagatctgagcaggactgaaggagatagagacacaaaaaacgtgggatggttttttagtatgtggaaaaattctttgatggtttttccttgaaaaagtgaaacctaaatccactccgtttggatgtgggacgatttgcggttgttgcttcctaaacataaactacgtttaggctgatatttcagacaatgaaacctttgagtgcccgtagcgggaagatctcggttgctgagtgcagggaaggaggatgtaattccatcatatactctctctgtgcctaccgcatttggaaccatgcgagtgatacctacttataaaataaaataaaccaagcaaaagtacgaacttagcaacactatattgagttaatagaatggtatcttgtatttcttctgtccaggtatacttataaatacctgcagggatttcaccacctcagggtggagagactgaatgcttgtgagggaattaggatggtggaatattggtgttaccagggaactgggcgggatgtttgaaaatactatgtttactcgttcttgggttccaataaaggagaaacagggcacaggagtcggaaggactagtggcaatagtgatgaaaggacctccttatcatgctggcaatgttaattacccaggtgtaggaagccatacactgaggcggaagatcgcaagtcagagtggccggcaggcacaacctcctggcacaccagaggcaggtcttcaatacccactggtttccccaacaggctgcgtaagggaccctgagccacagtgagttggtcaaatgctcctgacagtgtggagaaaccaacaggcaaaacgtgggtgcaaaagtgatgagaccccacactttacactcgtggtgacaatgaagctattaagtaacagcttctcaacctatgctgtttcctgttggatgcacataatccatttgcactgcagacaattttaggatgtggtttacagtaaggtggatggtaccttatggcaaaaatctctcagaaatttatgtgtggttttaaagtcattccagtcctagcacgttgtgcttttcagagacgccatagctgtttttccctttgtaatatcaaagcagtaatatcttctctggaggcctgttgggtgaatttaatggaatcaagttaagtaggtgccagaaccattgctgttttccctccatagccctgccacccactgtaaaaaggttgatgagattacttaatgatttccaattaagttgtatttccaaatatcatgatttccattttaatgtagttggtatggagctctgtgagtgtgtgcttcttttattatggatcacgttcagcttctttttatttgcctcctagtcataatagtaaaactctactcctctactccgaggagtccctaccacccatctcatcactttccagcccagcactcttcatgctcattcatttaaagcattcaacattgtgtaaatgaatcttggaaggcaaaagctactgaatttagcgaatttgtggaggcattgccacaaatcagccaggtgaagtttcacacaatcgaagactgcacaactcctagaaggcagcactatgctgcaaacccagacggccactcttctcacccctcgtccgtttgctgttctggataatgaggttcaaaagtcacctaggcaactgccaaaatagctgaaatggagaaagggcttcaggctggtgactagcagaggtccacctgacccccgtaagctgctgaacaagtagggctgccagaaatgtcccactagggaatttggtagagacgaagacatgctcaccggacaagggttcctcccaggatacgcccgagcggaagaagcgggctctgagccacgccctttcaccctcctctaccccgccctgggctggtgaaggtgcgcgccaggatgtggactactgagccctgaagaaataagtccttccactttgaccccatggaggattgcctgtgaggaacttaaacgagtctaccagtgtctagacacgggggcaggtctgtccggcacagcagctccctcaaggaggagaagagtgaggagaaaggaaactcaagtctcaccattctgtcctgggagagaagaggaggatctcatctctcatctgtccaaacaaggcaaggagactttctctcatctttccaagcaaggcaaggagactttttatcattaggaaacaaaaagaatttagaaggaatgaaagcagcccgtaaggtgaattcctaaggactgcccattgaaactgacaaaattgcccttgtttgatgagaggaatgagcagagcattgatgtggtgaacaaggatctagtgagactttcccagcatgtttctaccaaagctttatctaagcttctcagaacactctcctaataagcagatgtttggcctttcagaaagtcaacaagcaaaatgccttgagtgtcccaaaacactgatgccatgatgtgggctcctgactggcctccttttcctttgactggaccgctgccacctcttggtagccatcgctttcatgatgctttgccttggagatcatattggtgaagccatgttccaactgccgcttacaatttgtcagagggatgcgtcaggatcgtgatccctcctgtttaaaatttccactgatagctctcgtcgtaactgcagctgatctgggcacagtggttttcacagccactgcaggattcatcttccacatcttctcacctcttcttgaaacaagctatacattcgtaaagagttcatttctttggggtagtgtccttacaagcttttcttaaaacgtcaatgatttcttcaatcttccacccaagcttcaccataaatttgatgtttcctcttgctgcaattttcgtggaattcatgttgctctgacgggagtccttttcagtggatgtctaaaccttcttagtgcctcaaactagatctagttcagaaaggttatcagaagttagacaagtttattttagtgcaaaccagtggaaatccatgcatagtttcttcaccatgtgcattttctatgaacctttggaagaccacctgtgttgaacattgcccaagtcctgggagagaagtgggtgcggtccgcttcctgtcctcaatttgcccgcagcggcgagtgcacagagcagggaaaggcagccccagaggatcccgccctccagcatgcagcagactgctggcccagtcctggctccaaggggtgctgtgtgggcccaagcaagttgaccaacctccctgaaccttaatttaatcctaggtagcccaattccagtagccattataggactgccctgcagggacagttacttaactcaggaaaagcaacctagctccaagtttagcaaccgggagttccagttgattccattagcgcaccccctgaggcattcccaagctggagtctggtggaagatgaggctcagtgtgattggactgaagcaccaacctatcaaggagaagtcccacccagtctgccctgtgcctatataaaggcgacaagtggcggccgcagcactcattgaagccgccagttgggagaggagcagagccaggccggtgctcccgaaggcagcaagatgttgcgagccacagctccctgctggttcccccctggatacccagaagctaagaaggtggccgaggaggcggccctggaggcaagccgccatttgggaggggagcagagccaggccggtgctcccgaaggcagcaagatgttgcgagccacagctccctgctggttccgccctggatacccagaagctaagaaggtggccgaggaggcggccctcgag

SEQ ID NO: 57926 - DNA, 6774 bp, Homo sapiens
atgttgcgagccacagctccctgctggttcccacctggatacccagaagctaagaaggtggccgaggaggcggccctcgaggctccagaattcccactgccctctcatcagcctgcccagagcttcgggctctgggtgccccagatgcacaagcaggcctcagcatttgtggacatccaggcggagccccagaacaggggtccggcggtgcccccagcgtggcccaagatggtgacggagtcgtgctacttccctgcgcagaggggatcggcctgccgcttgccagccgccccaaggctgacagagaggccctcgggagtccgcatctcagcccccaggaagaggaagacgatcgcccactcttccagcccttgcttggtcacaggttacacagatgccaagagaacccgggtggccagcagcagccaacgctcccgtggctccaaggtcggcagacagccagggaagacgcgcaacaggtcagggatggcatgcaagaccaccgccaccaccagctctaagcgaatcgtccgtcgtgcatccttaccgagtttgagtttgaagaaacccattatcctccgaagctctgggtgccaagtccccaccgtcctccgccgaggctatctccaactgttcaccgaagagtgtctcaagttctgcgcctccaagcaggaggccgaggagaaggcgctgaacgaggagaaggtggcctacgactgcagccccaacaagaacaggtacctgaacgtggtcctgaacaccctcaagagactgaagggcctgacccccagctccatgcccggcctcagcagggccgccctgtacagccgcctccaggagttcctgctcacccaggaccagctcaaggagaacggctaccccttcccgcaccccgagcggcccggaggcgccgtcctcttcactggccaggggaaggggcccggcgactcctcctgcagggtctgctgccgttgtggcaccgagtacctggtgtcctcctcgggccgctgtgtacgcgaccagttgtgttattatcactgggggcgggtccgctcgagccaggtggctggaggccgggttagccagtacacctgctgtgcagctgctcctggctctgtgggctgccaggtggcaaagcagcacgtgcgggacggccgcaaggagagcctcgatggcttcgtggagaccttcaagaaagagttgtccagagacgcttatccaggaatctacgccttggactgtgagatgtgctacaccacgcatggcctagagctgacccgcgtcaccgtggtggacgccgacatgcgagtggtgtacgacaccttcgtcaagcccgacaacgagatcgtggactacaacaccaggttttccggagtcaccgaggccgacgtcgccaagacgagcatcacgttgccccaagtccaagccatcctgctgagctttttcagcgcccaaaccatcctcatcgggcacagcctggagagcgacctgctggccctgaagctcatccacagcaccgtggtggacacggccgtgctcttcccgcactacctgggtttcccctacaagcgctccctcaggaatctcgcggccgactacctggcacagatcatccaggacagccaggacggccacaactccagcgaggacgcaaacgcctgcctgcagctggtgatgtggaaggtccgacagcgcgcccagatccagccacgccaccggtccgcctctcccgccgccctggcctgtccttagccccaggcctcttccaaaaccgccatcagtcccgagagctcaccctgcccacctcgccgcaaagcgaaagaaactggagcagccggcggcaggagagggcaaaaagccaagagtaaccccaacccccgactcccggtaccccggaatccctgccgcggcccctcgggcctgtccacatccctctgcccctcccagacctctgtccttccaccaatcgcctcccgcagccccgagccgccactcccagtcccccgagtccctgccgcgcgccctcgcgcctgtccacatccctctgcccatccgagacctctgtccttacaccactagccaccccacgtgggacttccatggcttctgagtacaaggccagccccccggcccaccagctttcggaatgcctgcttacctctttttctgtagaggcaccacagggaggtgggtgaagcacttcggctctggagttacagatctgggttcaaggccaaattccaccacttactaggtttgtaatattggacagataacgtctttgcgcttctaccttttggtctttaaagtgtgatcaaaagagacttagactcccacatagtaataataataataatggcaaacttaacaccccactgtcaacattagacacaccaacgagacagaaagttaaaaaaggatatccgggaattgagctcagctctgcaccaagcggacctaggagacatctacagaacgctccaccccaaatcaacagaatatacattcttctcagcaccacatcacacttatttccacattgaccacatagttggaagtaaagcactcctcagtaaaagtaaaataacagaaattattacaaacggtctctcagaccacattgcaatcacactagacctcaggattgagaaagtcactcaaaaccgctcaactgcatggaaacaggacaagctgctcctgaatgagtactgggtacataacgaaatgaaggcagaaataaagatattctctgaaagcaatgagaacaaagacacaacataccagaatctctgggacacatttaaagcagtgtgtagagggaaatttatagcactaaatgcccacaagggaaagcaggaaagatcaaaaacgcataccctaacatcaccattaaaaggatgagagaagcaagagcaaacacattcaaaagctagcagaaggcaagaaataactaagatccgagcagaactgaaggagatagagacccaaaaaacgtgggatggtttataagtatgtggaaaatttctttgatggtttttccttgaaaaagtgaaacctaaatccactccgtttggatgtgggactatttacggttgttgcttcctaaacataaactacgtttaggctgatatttcagacaatgaaacctttgagtgcccgtagcgggatgatctcggttggtgagtgcagggaaggaggatgtaattccatcatatatactctctgtgcctaccgcatttggaaccatgcgagtgatacctatttataaaataaaataaaccaagcacaagtacgaacttagcaacactatattgagttaatagaacggtatcttgtatttcttctgtccagttatacttataaatgcctgcagggatttcaccacctcagggtggagagactgaatgcttgtgagggaattaggatggtggaatattggtgttaccagtgaagggggcgggatgtttgaaaatgctatgtttactcgttcttgggttccaataaaggagaaacagggcacaggagtcggaaggactagtggcaatagtgatgaaaggaccgccttatcatgctggcaatgttaattacccaggtgtaggaagccatacactgaggcggaagatcgcaagtcagagtggctggcaggcacaacctcctggcacaccagaggcaggtcttcaatacccactggtttccccaacaggctgcgtaagggaccctgagccacagtgagttggtcaaatgctcctgacagtgtggagaaaccaacaggcaaaacgtgggtgcaaaagtgatgagaccccacactttacactcgtggtgacaatgaagctattaagtaacagcttctcaacctatgctgtttcctgttggatgcacataatccatttgcactgcagacaattttaggatgtggtttacagtaaggtggatggtaccttatggcaaaaatctctcagaaatttatgtgtggttttaaagtcattccagtcctagcacgttgtgcttttcagagacgccatagctgtttttccctttgtaatatcaaagcagtaatatcttctctggaggcctgttgggtgaatttaatggaatcaagttaagtaggtgccagaaccattgctgttttccctccatagccctgccacccactgtaaaaaggttgatgagattacttaatgatttccaattaagttgtatttccaaatatcatgatttccattttaatgtagttggtatggagctctgtgagtgtgtgcttcttttattatggatcacgttcagcttctttttatttgcctcctagtcataatagtaaaactctactcctctactccgaggagtccctaccacccatctcatcactttccagcccagcactcttcatgctcattcatttaaagcattcaacattgtgtaaatgaatcttggaaggccaaagctactgaatttagcgaatttgtggaggcattgccacaaatcagccaggtgaagtttcacacaatcgaagactgcacaactcctagaaggcagcactatgctgcaaacccagacggccactcttctcacccctcgtccgtttgctgttctggataatgaggttcaaaagtcacctaggcaactgccaaaatagctgaaatggagaaagggcttcaggctggtgactagcagaggtccacctgacccccgtaagctgctgaacaagtagggctgccagaaatgtcccactagggaatttggtagagacgaagacatgctcaccggacaagggttcctcccaggatacgcccgagcggaagaagcgggctctgagccacgccctttcaccctcctctaccccgccctgggctggtgaaggtgcgcgccaggatgtggactactgagccctgaagaaataagtccttccactttgaccccatggaggattgcctgtgaggaacttaaacgagtctaccagtgtctagacacgggggcaggtctgtccggcacagcagctccctcaaggaggagaagagtgaggagaaaggaaactcaagtctcaccattctgtcctgggagagaagaggaggatctcatctctcatctgtccaaacaaggcaaggagactttctctcatctttccaagcaaggcaaggagactttttatcattaggaaacaaaaagaatttagaaggaatgaaagcagcccgtaaggtgaattcctaaggactgcccattgaaactgacaaaattgcccttgtttgatgagaggaatgagcagagcattgatgtggtgaacaaggatctagtgagactctcccagcatgtttctaccaaagctttatctaagcttctcagaacactctcctaataagcagatgtttggcctttcagaaagtcaacaagcaaaatgccttgagtgtcccaaaacactgatgccatgatgtgggctcctgactggcctccttttcctttgactggaccactgccacctcttggtagccatcgctttcatgatgctttgccttggagatcatattggtgaagccatgctccaactgccgcttacaatttgtcagagggatgcgtcaggatcgtgatccctcctgtttaaaatttccactgatagctctcgtcgtaactgcagctgatctgggcacagtggttttcacagccactgcaggattcatcttccacatcttctcacctcttcttgaaacaagctatacattcgtaaagagttcatttctttggggtagtgtccttacaagcttttcttaaaacgtcaatgatttcttcaatcttccacccaagcttcaccataaatttgatgtttcctcttgctgcaattttcgtggaattcatgttgctctgatgagagtccttttcagtggatgtctaaaccttcttagtgcctcaaactagatctagttcagaaaggttatcagaagttaggacaagtttattttagtgcaaaccattggaaatccatgcatagtttcttcaccatgtgcattttctatgaacctttggaagaccacctgtgttgaacattgcccaagtcctgggagagaagtgggtgcggtccgcttcctgtcctcaatttgcccgcagcggcggagtgcacagagcagggaaaggcagccccagagggatcccgccctccagcatgcagcagactgctggcccagtcctggctccaaggggtgctgtgtgggcccaagcaagttgaccaacctccctgaaccttaatttaatcctaggtagcccaattccagtagccattataggactgccctgcagggacagttacttaactcaggaaaagcaacctagctccaagtttagcaaccgggagttccagttgattccattagcgcaccccctgaggcattcccaagctggagtctggtggaagatgaggctcagtgtgattggactgaagcaccaacctatcaaggagaagtcccacccagtctgccctgtgcctatataaaggcgacaagtggcggccgcagcactcattgaagccgccagttgggagaggagcagagccaggccggtgctcccgaaggcagcaagatgttgcgagccacagctccctgctggttcccccctggatacccagaagctaagaaggtggccgaggaggcggccctggaggcaagccgccatttgggaggggagcagagccaggccggtgctcccgaaggcagcaagatgttgcgagccacagctccctgctggttccgccctggatacccagaagctaagaaggtggccgaggaggcggcc

SEQ ID NO: 57927 - DNA, 6913 bp, Homo sapiens
atgttgcgagccacagctccctgctggttcccccctggatacccagaagctaagaaggtggccgaggaggcggccctggaggcaagccgccatttgggaggggagcagagccaggccggtgctcccgaaggcagcaagatgttgcgagccacagctccctgctggttccgccctggatacccagaagctaagaaggtggccaaggaggcggccccggaggcaagccgccatttgggagcggagcagagcccggccggtgctcccgaaggcagcaagatgttgcgagccacagctccctgctggttcccacctggatacccagaagctaagaaggtggccgaggaggcggccctcgaggctccagaattcccactgccctctcatcagcctgcccagagcttcgggctctgggtgccccagatgcacaagcaggcctcagcatttgtggacatccaggcggagccccagaacaggggtccggcggtgcccccagcgtggcccaagatggtgacggagtcgtgctacttccctgcgcagaggggatcggcctgccgcttgccagccgccccaaggctgacagagaggccctcgggagtccgcatctcagcccccaggaagaggaagacgatcgcccactcttccagcccttgcttggtcacaggttacacagatgccaagagaacccgggtggccagcagcagccaacgctcccgtggctccaaggtcggcagacagccagggaagactcgcaacaggtcagggatggcatgcaagaccaccgccaccaccagctctaagcgaatcgtccgtcgtccatccttaccgagtttgagtttgaagaaacccattatcctccgaagctctgggtgccaagtccccaccgtcctccgccgaggctatctccaactgttcaccgaagagtgtctcaagttctgcgcctccaagcaggaggccgaggagaaggcgctgaacgaggagaaggtggcctacgactgcagccccaacaagaacaggtacctgaacgtggtcctgaacaccctcaagagactgaagggcctgacccccagctccatgcccggcctcagcagggccgccctgtacagccgcctccaggagttcctgctcacccaggaccagctcaaggagaacggctaccccttcccgcaccccgagcggcccggaggcgccgtcctcttcactggccaggggaaggggcccggcgactcctcctgcagggtctgctgccgttgtggcaccgagtacctggtgtcctcctcgggccgctgtgtacgcgaccagttgtgttattatcactgggggcgggtccgctcgagccaggtggctggaggccgggttagccagtacacctgctgtgcagctgctcctggctctgtgggctgccaggtggcaaagcagcacgtgcgggacggccgcaaggagagcctcgatggcttcgtggagaccttcaagaaagagttgtccagagacgcttatccaggaatctacgccttggactgtgagatgtgctacaccacgcatggcctggagctgacccgcgtcaccgtggtggacgccgacatgcgagtggtgtacgacaccttcgtcaagcccgacaacgagatcgtggactacaacaccaggttttccggagtcaccgaggccgacgtcgccaagacgagcatcacgttgccccaagtccaagccatcctgctgagctttttcagcgcccaaaccatcctcatcgggcacagcctggagagcgacctgctggccctgaagctcatccacaacaccgtggtggacacggccgtgctcttcccgcactacctgggtttcccctacaagcgctccctcaggaatctcgcggccgactacctggcacagatcatccaggacagccaggacggccacaactccagcgaggacgcaaacgcctgcctgcagctggtgatgtggaaggtccgacagcgcgcccagatccagccacgccaccggtccgcctctcccgccgccctggcctgtccttagccccaggcctcttccaaaaccgccatcagtcccgagagctcaccctgcccacctcgccgcaaagcgaaagaaactggagcagccggcggcaggagagggcaaaaagccaagagtaaccccaaccccccactcccggtcccccggaatccctgccgcggcccctcgggcctgtccacatccctctgcccctcccagacctctgtccttccaccaatcgcctcccgcagccccgagccgccactcccagtcccccgagtccctgccgcgcgccctcgcgcctgtccacatccctctgcccatccgagacctctgtccttacaccactagccaccccacgtgggacttccatggcttctgagtacaaggccagccccccggcccaccagctttcggaatgcctgcttacctctttttctgtagaggcaccacagggaggtgggtgaagcacttcggctctggagttacagatctgggttcaaggccaaattccaccacttactaggtttgtaatattggacagataacgtctttgcgcttctaccttttggtctttaaagtgtgatcaaaagagacttagactcccacataataataataataataatggcaaacttaacaccccactgtcaacattagacacaccaacgagacagaaagttaaaaaaggatatccgggaattgaactcagctctgcaccaagcggacctaggagacatgtacagaacgctccaccccaaatcaacagaatatacattcttctcagcaccacatcacacttatttccacattgaccacatagttggaagtaaagcactcctcagtaaaagtaaaataacagaaattattacaaacggtctctcagaccacattgcaatcacactagacctcaggattgagaaactcactcaaaaccgctcaaccgcatggaaaccggacaagctgctcctgaatgagtactgggtacataacgaaatgaaggcagaaataaagatattctctgaaagcaatgagaacaaagacacaacataccagaatctctgggacacatttaaagcagtgtgtagagggaaatttatagcactaaatgcccacaagggaaagcaggaaagatcaaaaatgcataccctaacatcaccattaaaaggatgagagaagcaagagcaaacacattcaaaagctagcagaaggcaagaaataactaagatccgagcagaactgaaggagatagagacccaaaaaacgtgggatggtttataagtatgtggaaaaattctttgatggtttttccttgaaaaagtgaaacctaaatccactccgtttggatgtgggactatttacggttgttgcttcctaaacatgaactacgtttaggctgatatttcagacaatgaaacctttgagtgcccgtagcgggaagatctcggttgctgagtgcagggaaggaggatgtaattccatcatatatactctctgtgcctaccgcatttggaaccatgcgagtgatacctatttataaaataaaataaaccaagcaaaagtacgaacttagcaacactatattgagttaatagaacggtatcttgtatttcttctgtccaggtatacttataaatgcctgcagggatttcaccacctcagggtggagggactgaatgcttgtgagggaattaggatggtggaatattggtgttaccagggaagggggcgggatgtttgaaaatgctatgtttactcgttcttgggttccaataaaggagaaacagggcacaggagtcggaaggactagtggcaatagtgatgaaaggacctccttatcatgctggcaatgttaattacccaggtgtaggaagccatacactgaggcggaagatcgcaagtcagagtggccggcaggcacaacctcctggcacaccagaggcaggtcttcaatacccactggtttccccaacaggctgcgtaagggaccctgagccacagtgagttggtcaaatgctcctgacagtgtggagaaaccaacagacaaaacgtgggtgcaaaagtgatgagaccccacactttacactcgtggtgacaatgaagctattaagtaacagcttctcaacctatgctgtttcctgttggatgcacataatccatttgcactgcagacaattttaggatgtggtttacagtaaggtggatggtaccttatggcaaaaatctctcagaaatttatgtgtggttttaaagtcattccagtcctagcacgttgtgcttttcagagacgccatagctgtttttccctttgtaatatcaaagcagtaatatgttctctggaggcctgttgggtgaatttaatggaatcaagttaagtaggtgccagaaccattgctgttttccctccatagccctgccacccactgtaaaaaggttgatgagattacttaatgatttccaattaagttgtatttccaaatatcatgatttccattttaatgtagttggtatggagctctgtgagtgtgtgcttcttttattatggatcacgttcagcttctttttatttgcctcctagtcataatagtaaaactctactcctctactccgaggagtccctaccacccatctcatcactttccagcccagcactcttcatgctcattcatttaaagcattcaacattgtgtaaatgaatcttggaaggcaaaagctactgaatttagcgaatttgtggaggcattgccacaaatcagccaggtgaagtttcacacaatcgaagactgcacaactcctagaaggcagcactatgctgcaaacccagacggccactcttctcacccctcgtccgtttgctgttctggataatgaggttcaaaagtcacctaggcaactgccaaaatagctgaaatggagaaagggcttcaggctggtgactagcagaggtccacctgacccccgtaagctgctgaacaagtagggctgccagaaatgtcccactagggaatttggtagagacgaagacatgctcaccggacaagggttcctcccaggatacgcccgagcggaagaagcgggctctgagccacgccctttcaccctcctctaccccgccctgggctggtgaaggtgcgcgccaggatgtggactaccgagccctgaagaaataagtccttccactttgaccccatggaggattgcctgtgaggaacttaaacgagtctaccagtgtctagacacgggggcaggtctgtccggcacagcagctccctcaaggaggagaagagtgaggagaaaggaaactcaagtctcaccattctgtcctgggagagaagaggaggatctcatctctcatctgtccaaacaagtcaaggagactttctctcatctttccaagcaaggcaaggagactttttatcattaggaaacaaaaagaatttagaaggaatgaaagcagcccgtaaggtgaattcctaaggactgcccattgaaactgacaaaattgcccttgtttgatgagaggaatgagcagagcattgatgtggtgaacaaggatctagtgagactttcccagcatgtttctaccaaagctttatctaagcttctcagaacactctcctaataagcagatgtttggcctttcagaaagtcaacaagcaaaatgccttgagtgtcccaaaacactgatgccatgatgtgggctcctgactggcctccttttcctttgactggaccgctgccacctcttggtagccatcgctttcatgatgctttgccttggagatcatattggtgaagccatgttccaactgccgcttacaatttgtcagagggatgcgtcaggatcgtgatccctcctgtttaaaatttccactgatagctctcgtcgtaactgcagctgatctgggcacagtggttttcacagccactgcaggattcatcttccacatcttctcacctcttcttgaaacaagctatacattcgtaaagagttcatttccttggggtagtgtccttataagcttttcttaatacatcaatgatttcttcattcttccacccaagcttcaccataaatttgatgtttcctcttgctgcaattttcgtggaattcatattgctctgacgggagtccttttcagtggatgtctcatccttcttagtgcctcaaactagatctagttcagaaagtttataagaagttaggacaagtttattttagtgcaaaccagtggaaatccatgcatagtttcttcaccatgtgcattttctatgaacctttggaagaccccctgtgttgaacattgcccaactcctgggagagaagtgggtgcggtccacttcctgtcctcaatttgtccgcagcggaggagtgcacagagcaaggaaaggcaaccccagagagatcctgccctccagcatgcagcagactgctggcccagtcctggctccattgggtgctgtgtgggcccaagcaagttgaccaacctccctgaaccttaatttaatcctaggtagcccaattccagtagccattataggactgccctgcagggacagttacttaactcaggaaaagcaacctagctccaagtttagcaaccgggagctccagttgattccattagcgcaccccctgaggcattcccaagctggagtctggtggaagatgaggctcagggtgattggactgaagcaccaacctatcaaggagaagtcccacccagtctgccctgtgcgtatataaaggcgacgcgtggcggccgcagcactcattgaagccgccagttgggagaggagcagagccaggccggtgctcccgaaggcagcaagatgttgcgagccacagctccctgctggttcccacctggatacccagaaactaagaaggtggccgaggaggcggccc

SEQ ID NO: 57928 - DNA, 7142 bp, Homo sapiens
atgttgcgagccacagctccctgctggttcccccctggatacccagaagctaagaaggtggccgaggaggcggccctggaggcaagccgccatttgggaggggagcagagccaggccggtgctcccgaaggcagcaagatgttgcgagccacagctccctgctggttccgccctggatacccagaagctaagaaggtggccaaggaggcggccccggaggcaagccgccatttgggagcggagcagagcccggccggtgctcccgaaggcagcaagatgttgcgagccacagctccctgctggttcccacctggatacccagaagctaagaaggtggccgaggaggcggccctcgaggctccagaattcccactgccctctcatcagcctgcccagagcttcgggctctgggtgccccagatgcacaagcaggcctcagcatttgtggacatccaggcggagccccagaacaggggtccggcggtgcccccagcgtggcccaagatggtgacggagtcgtgctacttccctgcgcagaggggatcggcctgccgcttgccagccgccccaaggctgacagagaggccctcgggagtccgcatctcagcccccaggaagaggaagacgatcgcccactcttccagcccttgcttggtcacaggttacacagatgccaagagaacccgggtggccagcagcagccaacgctcccgtggctccaaggtcggcagacagccagggaagacgcgcaacaggtcagggatggcatgcaagaccaccgccaccaccagctctaagcgaatcgtccgtcgtccatccttaccgagtttgagtttgaagaaacccattatcctccgaagctctgggtgtcaagtccccaccgtcctccgccgaggctatctccaactgttcaccgaagagtgtctcaagttctgcgcctccaagcaggaggccgaggagaaggcgctgaacgaggagaaggtggcctacgactgcagccccaacaagaacaggtacctgaacgtggtcctgaacaccctcaagagactgaagggcctgacccccagctccatgcccggcctcagcagggccgccctgtacagccgcctccaggagttcctgctcacccaggaccagctcaaggagaacggctaccccttcccgcaccccgagcggcccggaggcgccgtcctcttcactggccaggggaaggggcccggcgactcctcctgcagggtctgctgccgttgtggcaccgagtacctggtgtcctcctcgggccgctgtgtacgcgaccagttgtgttattatcactgggggcgggtccgctcgagccaggtggctggaggccgggttagccagtacacctgctgtgcagctgctcctggctctgtgggctgccaggtggcaaagcagcacgtgcgggacggccgcaaggagagcctccatggcttcgtggagaccttcaagaaagagttgtccagagacgcttatccaggaatctacgccttggactgtgagatgtgctacaccacgcatggcctagagctggcccgcgtcaccgtggtggacgccgacatgcgagtggtgtacgacaccttcgtcaagcccgacaacgagatcgtggactacaacaccaggttttccggagtcaccgaggccgacgtcgctaagacgagcatcacgttgccccaagtccaagccatcctgctgagctttttcagcgcccaaaccatcctcatcgggcacagcctggagagcgacctgctggccctgaagctcatccacagcaccgtggtggacacggccgtgctcttcccgcactacctgggtttcccctacaagcgctccctcaggaatctcgcggccgactacctggcacagatcatccaggacagccaggacggccacaactccagcgaggacgcaaacgcctgcctgcagctggtgatgtggaaggtccgacagcgcgcccagatccagccacgccaccggtccgcctctcccgccgccctggcctgtccttagccccaggcctcttccaaaaccgccatcagtcccgagagctcaccctgcccacctcgccgcaaagcgaaagaaactggagcagccggcggcaggagagggcaaaaagccaagagtaaccccaaccccccactcccggtcccccggaatccctgccgcggcccctcgggcctgtccacatccctctgcccctcccagacctctgtccttccaccaatcgcctcccgcagccccgagccgccactcccagtcccccgagtccctgccgcgcgccctcgcgcctgtccacatccctctgcccatccgagacctctgtccttacaccactagccaccccacgtgggacttccatggcttctgagtacaaggccagccccccggcccaccagctttcggaatgcctgcttacctctttttctgtagaggcaccacagggaggtgggtgaagcacttcggctctggagttacagatctgggttcaaggccaaattccaccacttactaggtttgtaatattggacagataacgtctttgcgcttctaccttttggtctttaaagtgtgatcaaaagagacttagactcccacatagtaataataataataatggcaaacttaacaccccactgtcaacattagacacaccaacgagacagaaagttaaaaaaggatatccgggaattgaactcagctctgcaccaagcggacctaggagacatgtacagaacgctccaccccaaatcaacagaatatacattcttctcagcaccacatcacacttatttccacattgaccacatagttggaagtaaagcactcctcagtaaaagtaaaataacagaaattattacaaacggtctctcagaccacaatgcaatcacactagacctcaggattgagaaactcactcaaaaccactcaactgcatggaaaccggacaagctgctcctgaatgagtactgggcacataacgaaatgaaggcagaaataaagatattctctgaaagtaatgagaacaaagacacaacataccagaatctctgggacacatttaaagcagtgtgtagagggaaatttatagcactaaatgcccacaagggaaagcaggaaagatcaaaaatgcataccctaacatcaccattaaaaggatgagagaagcaagagcaaacacattcaaaagctagcagaaggcaagaaataactaagatccgagcagaactgaaggagatagagacccaaaaaacgtgggatggtttataagtatgtggaaaaattctttgatggtttttccttgaaaaagtgaaacctaaatccactccgtttggatgtgggcctatttacggttgttgcttcctaaacataaactacgtttaggctgatatttcagacaatgaaacctttgagtgcccgtagcgggaagatctcggttgctgagtgcagggaaggaggatgtaattccatcatatatactctctgtgcctaccgcatttggaaccatgcgagtgatacgtatttataaaataaaataaaccaagcacaagtacgaacttagcaacactatattgagttaatagaacggtatcttgtatttcttctgtccaggtatacttataaatgcctgcagggatttcaccacctcagggtggagagactgaatgcttgtgagggaattaggatggtggaatattggtgttaccagggaagggggcgggatgtttgaaaatgctatgtttactcgttcttgggttccaataaaggagaaacagggcacaggagtcggaaggactagtggcaatagtgatgaaaggacctccttatcatgctggccatgttaattacccaggtgtaggaagccatacactgaggcggaagatcgcaagtcagagtggccggcaggcacaacgtcctggcacaccagaggcaggtcttcaatacccactggtttccccaacaggctgcgtaagggaccctgagccacagtgagttggtcaaatgctcctgacagtgtggagaaaccaacaggcaaaacgtgggtgcaaaagtgatgagaccccacactttacactcgtggtgacaatgaagctattatgtaacagcttctcaacctatgctgtttcctgttggatgcacataatccatttgcactgcagacaattttaggatgtggtttacagtaaggtggatggtaccttatggcaaaaatctctcagaaatttatgtgtggttttaaagtcattccagtcctagcacgttgtgcttttcagagacgccatagctgtttttccctttgtaatatcaaagcagtaatatgttctctggaggcctgttgggtgaatttaatggaatcaagttaagtaggtgccagaaccattgctgttttccctccatagccctgccacccactgtaaaaaggttgatgagattacttaatgatttccaattaagttgtatttccaaatatcatgatttccattttaatgtagttggtatggagctctgtgagtgtgtgcttcttttattatggatcacgttcagcttctttttatttgcctcctagtcataatagtaaaactctactcctctactccgaggagtccctaccacccatctcatcactttccagcccagcactcttcatgctcattcatttaaagcattcaacattgtgtaaatgaatcttggaaggcaaaagctactgaatttagcgaatttgtggaggcattgccacaaatcagccaggtgaagtttcacacaatcgaagactgcacaactcctagaaggcagcactatgctgcaaacccagacggccactcttctcacccctcgtccgtttgctgttctggataatgaggttcaaaagtcacctaggcaactgccaaaatagctgaaatggagaaagggcttcaggctggtgactagcaaaggtccacctgacccccgtaagctgctgaacaagtagggctgccagaaatgtcccactagggaatttggtagagacgaagacatgctcaccggacaagggttcctcccaggatacgcccgagcggaagaagcgggctctgagccacgccctttcaccctcctctaccccgccctgggctggtgaaggtgcgcgccaggatgtggactactgagccctgaagaaataagtccttccactttgaccccatggaggattgcctgtgaggaacttaaacgagtctaccagtgtctagacacgggggcaggtctgtccggcacagcagctccctcaaggaggagaagagtgaggagaaaggaaactcaagtctcaccattctgtcctgggagagaagaggaggatctcatctctcatctgtccaaacaaggcaaggagactttctctcatctttccaagcaaggcaaggagactttttatcattaggaaacaaaaagaatttaaaaggaatgaaagcagcccgtaaggtgaattcctaaggactgcccattgaaactgacaaaattgcccttgtttgatgagaggaatgagcagagcattgatgtggtgaacaaggatctagtgagactctcccagcatgtttctaccaaagctttatctaagcttctcagaacactctcctaataagcagatgtttggcctttcagaaagtcaacaagcaaaatgccttgagtgtcccaaaacactgatgccatgatgtgggctcctgactggcttccttttcctttgactggaccactgccacctcttggtagccatcgctttcatgatgctttgccttggcgatcatattggtgaagccatgttccaactgccgcttacaatttgtcagagggatgcgtcaggatcgtgatccctcctgttgaaaatttccactgatagctctcgtcgtaactgcagctcatctgggcacagtggttttcacagccactgcaggattcatcttccacatcttctcacctcttcttgaaacaagctatacattcgtaaagagttcatttctttggggtagtgtccttacaagcttttcttaaaacgtcaatgatttcttcaatcttccacccaagcttcaccataaatttgatgtttcctcttgctgcaattttcgtggaattcatgttgctctgatgggagtccttttcagtggatgtctcatccttcttagtgcctcaaactagatctagttcagaaaggttatcagaagttaggacaagtttattttagtgcaaaccagtggaaatccatgcatcgtttcttcaccatgtgcattttctatgaacctttggaagaccacctgtgttgaacattgcccaagtcctgggagagaagtgggtgcggtccgcttcctgtcctcaatttgcccgcagcggcggagtgcacagagcagggaaaggcagccccagagggatcccgccctccagcatgcagcagactgctggcccagtcctggctccaaggggtgctgtgtgggcccaagcaagttgaccaacctccctgaaccttaatttcatcctaggtagcccaattccagtagccattataggactgccctgcagggacagttacttaactcaggaaaagcaacctagctccaagtttagcaaccgggagttccagttgattccattagcgcaccccctgaggcattcccaagctggagtctggtggaagatgaggctcagtgtgattggactgaagcaccaacctatcaaggagaagtcccacccagtctgccctgtgcctatataaaggcgacaagtggcggccgcagcactcattgaagccgccagttgggagaggagcagagccaggccggtgctcccgaaggcagcaagatgttgcgagccacagctccctgctggttcccccctggatacccagaagctaagaaggtggccgaggaggcggccctggaggcaagccgccatctgggaggggagcagagccaggccggtgctcccgaaggcagcaagatgttgcgagccacagctccctgctggttcccccctggatacccagaagctaagaaggtggccaaggaggcggccccggaggcaagccgccatttgggagcggagcagagcccggccggtgctcccgaaggcagcaagatgttgcgagccacagctccctgctggtt

SEQ ID NO: 57929 - DNA, 6768 bp, Homo sapiens
atgttgcgagccacagctccctgctggttcccacctggatacccagaagctaagaaggtggccgaggaggcggccctcgaggctccagaattcccactgccctctcatcagcctgcccagagcttcgggctctgggtgccccagatgcacaagcaggcctcagcatttgtggacatccaggcggagccccagaacaggggtccggcggtgcccccagcgtggcccaagatggtgacggagtcgtgctacttccctgcgcagaggggatcggcctgccgcttgccagccgccccaaggctgacagagaggccctcgggagtccgcatctcagcccccaggaagaggaagacgatcgcccactcttccagcccttgcttggtcacaggttacacagatgccaagagaacccgggtggccagcagcagccaacgctccattggctcccaggtcggcagacagccagggaagacgcgcaagaggtcagggatggcatgcaagaccaccgccaccatcagctctaagcgaatcgtccgtcgtctatccttaccgagtttgaagaaacccattatcctccgaagctctgggtgccaagtccccaccatcctccgccgatgctatctccaactgttcaccgaagagtgtctcaagttctgcgcctccaagcaggaggccgaggagaaggcgctgaacgaggagaaggtggcctacgactgcagccccaacaagaacaggtacctgaacgtggtcctgaacaccctcaagagactgaagggcctgacccccagctccatgcccggcctcagcagggccgccctgtacagccgcctccaggagttcctgctcacccaggaccagctcaaggagaacggctaccccttcccgcaccccgagcggcccggaggcgccgtcctcttcactggccaggggaaggggcccggcgactcctcctgcagggtctgctgccgttgtggcaccgagtacctggtgtcctccttgggccgctgtgtacgcgaccagttgtgttattatcactgggggcgggtccgctcgagccaggtggctggaggccgggttagccagtacacctgctgtgcagctgctcctggctctgtgggctgccaggtggcaaagcagcacgtgcgggacggccgcaaggagagcctccatggcttcgtggagaccttcaagaaagagttgtccagagacgcttatccaggaatctacgccttggactgtgagatgtgctacaccacgcatggcctagagctgacccgcgtcaccgtggtggacgccgacatgcgagtggtgtacgacaccttcgtcaagcccgacaacgagatcgtggactacaacaccaggttttccggagtcaccgaggccgacgtcgccaagacgagcatcacgttgccccaagtccaagccatcctgctgagctttttcagcgcccaaaccatcctcatcgggcacagcctggagagcgacctgctggccctgaagctcatccacagcaccgtggtggacacggccgtgctcttcccgcactacctgggtttcccctacaagcgctccctcaggaatctcgcggccgactacctggcacagatcatccaggacagccaggacggccacaactccagcgaggacgcaaacgcctgcctgcagcttggtgatgtggaaggtcaacagcgcgcccagatccagccacgccaccggtccgcctctcccgccgccctggcctgtccttagccccaggcctcttccaaaaccgccatcagtcccgagagctcaccctgcccacctcgccgcaaagcgaaagaaactggagcagccggcggcaggagagggcaaaaagccaagagtaaccccaacccccgactcccggtaccccggaatccctgccgcggcccctcgggcctgtccacatccctctgcccctcccagacctctgaccgtccaccaagcgcctcccgcagccccgagccgccactcccaggcccccgagtccctgccgcgcgccctcgcgccggaccacatccctctgcccatccgagacctctgtccttacaccactagccaccccacgtgggacttccatggcttctgagtacaaggccagccccccggcccaccagctttcggaatgcctgcttacctctttttctgtagaggcaccacagggaggtgggtgaagcacttcggctctggagttacagatctgggttcaaggccaaattccaccacttactaggtttgtaatattggacagataacgtctttgcgcttctaccttttggtctttaaagtgtgatcaaaagagacttagactcccacatagtaataataataataatggcaaacttaacaccccactgtcaacattagacacaccaacgagacagaaagttaagaaaggatatccgggaattgagctcacctctgcaccaagcggacctaggagacatgtacagaacgctccaccccaaatcaacagaatatacattcttctcagcaccacatcacacttatttccacattgaccacatagttggaagtaaagcactcctcagtaaaagtaaaataacagaaattattacaaacggtctctcagaccacattgcaatcacactagacctcaggattgagaaactcactcaaaacggctcaactgcatggaaaccggacaagctgctcctgaatgagtactgggtacataacgaaatgaaggcagaaataaagatattctctgaaagcaatgagaacaaagacacaacataccagaatctctgggacacatttaaagcagtgtgtagagggaaatttatagcactaaatgcccacaagggaaagcaggaaagatcaaaaatgcataccctaacatcaccattaaaaggatgagagaagcaagagcaaacacattcaaaagctagcagaaggcaagaaataactaagatccgagcagaactgaaggagatagagacccaaaaaacgtgggatggtttataagtatgtggaaaaattctttgatggtttttccttgaaaaagtgaaacctaaatccactccgtttggatgtgggcctatttacggttgttgcttcctaaacataaactacgtttaggctgatatttcagacaatgaaacctttgagtgcccgtagcgggaagatctcggttgctgagtgcagggaaggaggatgtaattccatcatatatactctctgtgcctaccgcatttggaaccatgcgagtgatacgtatttataaaataaaataaaccaagcacaagtacgaacttagcaacactatattgagttaatagaacggtatcttgtatttcttctgtccaggtatacttataaatgcctgcagggatttcaccacctcagggtggagagactgaatgcttgtgagggaattaggatggtggaatattggtgttaccagggaagggggcgggatgtttgaaaatgctatgtttactcgttcttgggttccaataaaggagaaacagggcacaggagtcggaaggactagtggcaatagtgatgaaaggacctccttatcatgctggcaatgttaattacccaggtgtaggaagccatacactgaggcggaagatcgcaagtcagagtggccggcaggcacaacgtcctggcacaccagaggcaggtcttcaatacccactggtttccccaacaggctgcgtaagggaccctgagccacagtgagttggtgaaatgctcctgacagtgtggagaaaccaacaggcaaaacgtgggtgcaaaagtgatgagaccccacactttacactcgtggtgacaatgaagctattaagtaacagcttctcaacctatgctgtttcctgttggatgcacataatccatttgcactgcagacaattttaggatgtggtttacagtaaggtggatggtaccttatggcaaaaatctctcagaaatttatgtgtggttttaaagtcattccagtcctagcacgttgtgcttttcagagacgccatagctgtttttccctttgtaatatcaaagcagtaatatgttctctggaggcctgttgggtgaatttaatggaatcaagttaagtaggtgccagaaccattgctgttttccctccatagccctgccacccactgtaaaaaggttgatgagattacttaatgatttccaattaagttgtatttccaaatatcatgatttccattttaatgtagttggtatggagctctgtgagtgtgtgcttcttttattatggatcacgttcagcttctttttatttgcctcctagtcataatagtaaaactctactcctctactccgaggagtccctaccacccatctcatcactttccagcccagcactcttcatgctcattcatttaaagcattcaacattgtgtaaatgaatcttggaaggcaaaagctactgaatttagcgaatttgtggaggcattgccacaaatcagccaggtgaagtttcacacaatcgaagactgcacaactcctagaaggcagcactatgctgcaaacccagacggccactcttctcacccctcgtccgtttgctgttctggataatgaggttcaaaagtcacctaggcaactgccaaaatagctgaaatggagaaagggcttcaggctggtgactagcagaggtccacctgacccccgtaagctgctgaacaagtagggctgccagaaatgtcccactagggaatttggtagagacgaagacatgctcaccggacaagagttcctcccaggatacgcccgagcggaagaagcgggctctgagccacgccctttcaccctcctctaccccgccctgggctggtgaaggtgcgcgccaggatgtggactactgagccctgaagaaataagtccttccactttgaccccatggaggattgcctgtgaggaacttaaacgagtctaccagtgtctagacacgggggcaggtctgtccggcacagcagctccctcaaggaggagaagagtgaggagaaaggaaactcaagtctcaccattctgtcctgggagagaagaggaggatctcatctctcatctgtccaaacaaggcaaggagactttctctcatctttccaagcaaggcaaggagactttttatcattaggaaacaaaaagaatttagaaggaatgaaagcagcccgtaaggtgaattcctaaggactgcccattgaaactgacaaaattgcccttgtttgatgagaggaatgagcagagcattgatgtggtgaacaaggatctagtgagactttcccagcatgtttctaccaaagctttatctaagcttctcagaacactctcctaataagcagatgtttggcctttcagaaagtcaacaagcaaaatgccttgagtgtcccaaaacactgatgccatgatgtgggctcctgactggcctccttttcctttgactggaccactgccacctcttggtagccatcgctttcatgatgctttgccttggcgatcatattggtgaagccatgttccaactgccgcttacaatttgtcagagggatgcgtcaggatcgtgatccctcctgtttaaaatttccactgatagctctcgtcgtaactgcagctgatctgggcacagtggttttcgcagccactgcaggattcatcttccacatcttctcacctcttcttgaaacaagctatacattcgtaaagagttcatttctttggggtagtgtccttacaagcttttcttaaaacgtcaatgatttcttcaatcttccacccaagcttcaccataaatttgatgtttcctcttgctgcaattttcgtggaattcatgttgctctgatgggagtccttttcagtggatgtctcatccttcttagtgcctcaaactagatctagttcagaaaggttatcagaagttaggacaagtttattttagtgcaaaccagtggaaatccatgcatcgtttcttcaccatgtgcattttctatgaacctttggaagaccacctgtgttgaacattgcccaagtcctgggagagaagtgggtgcggtccgcttcctgtcctcaatttgcccgcagcggcggagtgcacagagcagggaaaggcagccccagagggatcccgccctccagcatgcagcagactgctggcccagtcctggctccaaggggtgctgtgtgggcccaagcaagttgaccaacctccctgaaccttaatttcatcctaggtagcccaattccagtagccattataggactgccctgcagggacagttacttaactcaggaaaagcaacctagctccaagtttagcaaccgggagttccagttgattccattagcgcaccccctgaggcattcccaagctggagtctggtggaagatgaggctcagtgtgattggactgaagcaccaacctatcaaggagaagtcccacccagtctgccctgtgcctatataaaggcgacaagtggcggccgcagcactcattgaagccgccagttgggagaggagcagagccaggccggtgctcccgaaggcagcaagatgttgcgagccacagctccctgctggttcccccctggatacccagaagctaagaaggtggccgaggaggcggccctggaggcaagccgccatttgggaggggagcagagccaggccggtgctcccgaaggcagcaagatgttgcgagccacagctccctgctggttccgccctggatacccagaagctaagaaggtggccgaggaggcggcc

SEQ ID NO: 57930 - DNA, 1970 bp, Homo sapiens
ggcgcggagctcgggcggccgtggaggaactcagcctcggccgcaggaggcgccgggagcggagccgccgggagtcgcgcaacaggtttccttctccatcgctgcgcccacaggggacgcgcgccctgccgggagaggggcttctcggttcgcactctcgctcccagtccaggcaaaatgaaagaccggctagcagaacttctggacttgtccaagcaatatgaccagcagttcccagacggggacgatgagtttgactcgccccacgaggacatcgtgttcgagacggaccacatcctggagtccctgtaccgagacatccgggacattcaggatgaaaaccagctgctggtggccgacgtgaagcggctgggaaagcagaacgcccgcttcctcacgtccatgcggcgcctcagcagcatcaagcgcgacaccaactccatcgccaaggccatcaaggcccggggcgaggtcatccactgcaagctgcgcgccatgaaggagctgagcgaggcggctgaggcccagcacggcccgcactcggcagtggcgcgcatttcgcgggcgcagtacaacgcgctcaccctcaccttccagcgcgccatgcacgactacaaccaggccgagatgaagcagcgcgacaactgcaagatccgcatccagcgccagctggagatcatgggcaaggaagtctcgggcgaccagatcgaggacatgttcgagcagggtaagtgggacgtgttttccgagaacttgctggccgacgtgaagggcgcgcgggccgccctcaacgagatcgagagccgccaccgcgaactgctgcgcctggagagccgcatccgcgacgtacacgagctcttcttgcagatggcggtgctggtggagaagcaggccgacaccctgaacgtcatcgagctcaacgtacaaaagacggtcgactacaccggccaggccaaggcgcaggtgcggaaggccgtgcagtacgaggagaagaacccctgccggaccctctgctgcttctgctgtccctgcctcaagtagcaggccggcccgggccgccaccgcccatcccagaccatggagcgcgctgggaaggacgcaccaaagccgggagctctgccctgcagggagttgccccaaccctttccggaactcagtctttagaaaagaaacgccaggttcaagaattgcaaaccagcctgtgcttggaaagatggttagttgataccgtccgatgattcttcagtaaagatagattcccacaaagttgtgcaatgtcattatatgacaccttgcactcttaccgtcttgacagaagccaagtaaggaactgaagttgtatctgactgtagggtgaatgtctgaggcctgcctcctaataaagactcaaggaggaagtcaattgggcatctgctaatagaatgaactcatgatggaaacttcagttcatttactttgtcctgaaaattccctggttctgttccattttgagcgaaattggccttgggaaaaaccacgttcttcctttccgattcttcatccggtctacgctatgcaattcctccccaaatatagatcttatttctgctcatttcccctacttattaaaatcacaccaaacacttactattttcttatctctttcactttttaaatatctttcaccaggttatattttggtattatttttccaaacatttttaagcactgaatatcgaacaagcactcaaattgaagtatcagtcatgttttgtgtatttttcgctgataaaaattatttaacatttatatttttacttgattacatatgcacatgtatgtaaatgtaaaatactaatattcactaatatatgtacataatgatcaattggtttaacttcttttatgtaagtatggtatataaatttcaagacgaaaaaaaaaaaaaaaaaaaaaaaaaaaaaaaaaaaaaaaaaaaaaaaaaaaaaaaa

SEQ ID NO: 57931 - DNA, 1669 bp, Homo sapiens
ctccctcagcaaggacagcagaggaccagctaagagggagagaagcaactacagaccccccctgaaaacaaccctcagacgccacatcccctgacaagctgccaggcaggttctcttcctctcacatactgacccacggctccaccctctctcccctggaaaggacaccatgagcactgaaagcatgatccgggacgtggagctggccgaggaggcgctccccaagaagacaggggggccccagggctccaggcggtgcttgttcctcagcctcttctccttcctgatcgtggcaggcgccaccacgctcttctgcctgctgcactttggagtgatcggcccccagagggaagagttccccagggacctctctctaatcagccctctggcccaggcagtcagatcatcttctcgaaccccgagtgacaagcctgtagcccatgttgtagcaaaccctcaagctgaggggcagctccagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctgtgaggaggacgaacatccaaccttcccaaacgcctcccctgccccaatccctttattaccccctccttcagacaccctcaacctcttctggctcaaaaagagaattgggggcttagggtcggaacccaagcttagaactttaagcaacaagaccaccacttcgaaacctgggattcaggaatgtgtggcctgcacagtgaagtgctggcaaccactaagaattcaaactggggcctccagaactcactggggcctacagctttgatccctgacatctggaatctggagaccagggagcctttggttctggccagaatgctgcaggacttgagaagacctcacctagaaattgacacaagtggaccttaggccttcctctctccagatgtttccagacttccttgagacacggagcccagccctccccatggagccagctccctctatttatgtttgcacttgtgattatttattatttatttattatttatttatttacagatgaatgtatttatttgggagaccggggtatcctgggggacccaatgtaggagctgccttggctcagacatgttttccgtgaaaacggagctgaacaataggctgttcccatgtagccccctggcctctgtgccttcttttgattatgttttttaaaatatttatctgattaagttgtctaaacaatgctgatttggtgaccaactgtcactcattgctgagcctctgctccccaggggagttgtgtctgtaatcgccctactattcagtggcgagaaataaagtttgcttagaaaagaa

SEQ ID NO: 57932 - DNA, 1024 bp, Homo sapiens
cggctcgaggtgagaaggaaactgcaagagtggggcagagaaccagagtgtcagagcaaaacctcctctatctgcacatcctggggacgaaccgggcagccggagagctgcggccggcccagtcccgctccgcctttgaagggtaaaacccaaggcggggccttggttctggcagaagggacgctatgaccgcagaattcctctccctgctttgcctcgggctgtgtctgggctacgaagatgagaaaaagaatgagaaaccgcccaagccctccctccacgcctggcccagctcggtggttgaagccgagagcaatgtgaccctgaagtgtcaggctcattcccagaatgtgacatttgtgctgcgcaaggtgaacgactctgggtacaagcaggaacagagctcggcagaaaacgaagctgaattccccttcacggacctgaagcctaaggatgctgggaggtacttttgtgcctacaagacaacagcctcccatgagtggtcagaaagcagtgaacacttgcagctggtggtcacagataaacacgatgaacttgaagctccctcaatgaaaacagacaccagaaccatctttgtcgccatcttcagctgcatctccatccttctcctcttcctctcagtcttcatcatctacagatgcagccagcacggttcatcatctgaggaatccaccaagagaaccagccattccaaacttccggagcargaggctgccgaggcagatttatccaatatggaaagggtatctctctcgacggcagacccccaaggagtgacctatgctgagctaagcaccagcgccctgtctgaggcagcttcagacaccacccaggagcccccaggatctcatgaatatgcggcactgaaagtgtagcaagaagacagccctggccactaaaggaggggggatcgtgctggccaaggttatcggaaatctggagatgcagatactgtgtttccttgctcttcgtccatatcaataaaattaagtttctcgtctta

SEQ ID NO: 57933 - protein, 384 aa, Homo sapiens
MVSGDYSLGLNDLNVSPPELTVHVGDSALMGCVFQSTEDKCIFKIDWTLSPGEHAKDEYVLYYYSNLSVPIGRFQNRVHLMGDNLCNDGSLLLQDVQEADQGTYICEIRLKGESQVFKKAVVLHVLPEEPKELMVHVGGLIQMGCVFQSTEVKHVTKVEWIFSGRRAKEEIVFRYYHKLRMSAEYSQSWGHFQNRVNLVGDIFRNDGSIMLQGVRESDGGNYTCSIHLGNLVFKKTIVLHVSPEEPRTLVTPAALRPLVLGGNQLVIIVGIVCATILLLPVLILIVKKTCGNKSSVNSTVLVKNTKKTNPEIKEKPCHFERCEGEKHIYSPIIVREVIEEEEPSEKSEATYMTMHPVWPSLRSDRNNSLEKKSGGGMPKTQQAF

SEQ ID NO: 57934 - protein, 199 aa, Homo sapiens
MEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGN

SEQ ID NO: 57935 - protein, 382 aa, Homo sapiens
MNPQIRNPMERMYRDTFYDNFENEPILYGRSYTWLCYEVKIKRGRSNLLWDTGVFRGQVYFKPQYHAEMCFLSWFCGNQLPAYKCFQITWFVSWTPCPDCVAKLAEFLSEHPNVTLTISAARLYYYWERDYRRALCRLSQAGARVTIMDYEEFAYCWENFVYNEGQQFMPWYKFDENYAFLHRTLKEILRYLMDPDTFTFNFNNDPLVLRRRQTYLCYEVERLDNGTWVLMDQHMGFLCNEAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFEYCWDTFVYRQGCPFQPWDGLEEHSQALSGRLRAILQNQGN

SEQ ID NO: 57936 - protein, 168 aa, Homo sapiens
MASERPEPEVEEAGQVFLLMKKDYRISRNVRLAWFLSHLHQTVQATPQEMLLQSEQELEVLSVLPPGWQPDEPVVPRPFLLVPSTRVTFLAWQYRFVIELDLSPSTGIVDDSTGEILFDEVFHALSRCLGGLLRPFRVPGSCIDFQPEIYVTIQAYSSIIGLQSHQMI

SEQ ID NO: 57937 - protein, 482 aa, Homo sapiens
MASFSAETNSTDLLSQPWNEPPVILSMVILSLTFLLGLPGNGLVLWVAGLKMQRTVNTIWFLHLTLADLLCCLSLPFSLAHLALQGQWPYGRFLCKLIPSIIVLNMFASVFLLTAISLDRCLVVFKPIWCQNHRNVGMACSICGCIWVVAFVMCIPVFVYREIFTTDNHNRCGYKFGLSSSLDYPDFYGDPLENRSLENIVQPPGEMNDRLDPSSFQTNDHPWTVPTVFQPQTFQRPSADSLPRGSARLTSQNLYSNVFKPADVVSPKIPSGFPIEDHETSPLDNSDAFLSTHLKLFPSASSNSFYESELPQGFQDYYNLGQFTDDDQVPTPLVAITITRLVVGFLLPSVIMIACYSFIVFRMQRGRFAKSQSKTFRVAVVVVAVFLVCWTPYHIFGVLSLLTDPETPLGKTLMSWDHVCIALASANSCFNPFLYALLGKDFRKKARQSIQGILEAAFSEELTRSTHCPSNNVISERNSTTV

SEQ ID NO: 57938 - protein, 93 aa, Homo sapiens
MQVSTAALAVLLCTMALCNQVLSAPLAADTPTACCFSYTSRQIPQNFIADYFETSSQCSKPSVIFLTKRGRQVCADPSEEWVQKYVSDLELSA

SEQ ID NO: 57939 - protein, 93 aa, Homo sapiens
MQVSTAALAVLLCTMALCNQVLSAPLAADTPTACCFSYTSRQIPQNFIADYFETSSQCSKPSVIFLTKRGRQVCADPSEEWVQKYVSDLEPSA

SEQ ID NO: 57940 - protein, 344 aa, Homo sapiens
MANYTLAPEDEYDVLIEGELESDEAEQCDKYDAQALSAQLVPSLCSAVFVIGVLDNLLVVLILVKYKGLKRVENIYLLNLAVSNLCFLLTLPFWAHAGGDPMCKILIGLYFVGLYSETFFNCLLTVQRYLVFLHKGNFFSARRRVPCGIITSVLAWVTAILATLPEFVVYKPQMEDQKYKCAFSRTPFLPADETFWKHFLTLKMNISVLVLPLFIFTFLYVQMRKTLRFREQRYSLFKLVFAIMVVFLLMWAPYNIAFFLSTFKEHFSLSDCKSSYNLDKSVHITKLIATTHCCINPLLYAFLDGTFSKYLCRCFHLRSNTPLQPRGQSAQGTSREEPDHSTEV

SEQ ID NO: 57941 - protein, 238 aa, Homo sapiens
MCRRCKPELGQNFQSASGICICHWLQIRRTRSREGRAMWLPPALLLLSLSGCFSIQGPESVRAPEQGSLTVQCHYKQGWETYIKWWCRGVRWDTCKILIETRGSEQGEKSDRVSIKDNQKDRTFTVTMEGLRRDDADVYWCGIERRGPDLGTQVKVIVDPEGAASTTASSPTNSNMAVFIGSHKRNHYMLLVFVKVPILLILVTAILWLKGSQRVPEEPGEQPIYMNFSEPLTKDMAT

SEQ ID NO: 57942 - protein, 1036 aa, Homo sapiens
MKMASTRCKLARYLEDLEDVDLKKFKMHLEDYPPQKGCIPLPRGQTEKADHVDLATLMIDFNGEEKAWAMAVWIFAAINRRDLYEKAKRDEPKWGSDNARVSNPTVICQEDSIEEEWMGLLEYLSRISICKMKKDYRKKYRKYVRSRFQCIEDRNARLGESVSLNKRYTRLRLIKEHRSQQEREQELLAIGKTKTCESPVSPIKMELLFDPDDEHSEPVHTVVFQGAAGIGKTILARKMMLDWASGTLYQDRFDYLFYIHCREVSLVTQRSLGDLIMSCCPDPNPPIHKIVRKPSRILFLMDGFDELQGAFDEHIGPLCTDWQKAERGDILLSSLIRKKLLPEASLLITTRPVALEKLQHLLDHPRHVEILGFSEAKRKEYFFKYFSDEAQARAAFSLIQENEVLFTMCFIPLVCWIVCTGLKQQMESGKSLAQTSKTTTAVYVFFLSSLLQPRGGSQEHGLCAHLWGLCSLAADGIWNQKILFEESDLRNHGLQKADVSAFLRMNLFQKEVDCEKFYSFIHMTFQEFFAAMYYLLEEEKEGRTNVPGSRLKLPSRDVTVLLENYGKFEKGYLIFVVRFLFGLVNQERTSYLEKKLSCKISQQIRLELLKWIEVKAKAKKLQIQPSQLELFYCLYEMQEEDFVQRAMDYFPKIEINLSTRMDHMVSSFCIENCHRVESLSLGFLHNMPKEEEEEEKEGRHLDMVQCVLPSSSHAACSHGLVNSHLTSSFCRGLFSVLSTSQSLTELDLSDNSLGDPGMRVLCETLQHPGCNIRRLWLGRCGLSHECCFDISLVLSSNQKLVELDLSDNALGDFGIRLLCVGLKHLLCNLKKLWLVSCCLTSACCQDLASVLSTSHSLTRLYVGENALGDSGVAILCEKAKNPQCNLQKLGLVNSGLTSVCCSALSSVLSTNQNLTHLYLRGNTLGDKGIKLLCEGLLHPDCKLQVLELDNCNLTSHCCWDLSTLLTSSQSLRKLSLGNNDLGDLGVMMFCEVLKQQSCLLQNLGLSEMYFNYETKSALETLQEEKPELTVVFEPSW

SEQ ID NO: 57943 - protein, 922 aa, Homo sapiens
MKMASTRCKLARYLEDLEDVDLKKFKMHLEDYPPQKGCIPLPRGQTEKADHVDLATLMIDFNGEEKAWAMAVWIFAAINRRDLYEKAKRDEPKWGSDNARVSNPTVICQEDSIEEEWMGLLEYLSRISICKMKKDYRKKYRKYVRSRFQCIEDRNARLGESVSLNKRYTRLRLIKEHRSQQEREQELLAIGKTKTCESPVSPIKMELLFDPDDEHSEPVHTVVFQGAAGIGKTILARKMMLDWASGTLYQDRFDYLFYIHCREVSLVTQRSLGDLIMSCCPDPNPPIHKIVRKPSRILFLMDGFDELQGAFDEHIGPLCTDWQKAERGDILLSSLIRKKLLPEASLLITTRPVALEKLQHLLDHPRHVEILGFSEAKRKEYFFKYFSDEAQARAAFSLIQENEVLFTMCFIPLVCWIVCTGLKQQMESGKSLAQTSKTTTAVYVFFLSSLLQPRGGSQEHGLCAHLWGLCSLAADGIWNQKILFEESDLRNHGLQKADVSAFLRMNLFQKEVDCEKFYSFIHMTFQEFFAAMYYLLEEEKEGRTNVPGSRLKLPSRDVTVLLENYGKFEKGYLIFVVRFLFGLVNQERTSYLEKKLSCKISQQIRLELLKWIEVKAKAKKLQIQPSQLELFYCLYEMQEEDFVQRAMDYFPKIEINLSTRMDHMVSSFCIENCHRVESLSLGFLHNMPKEEEEEEKEGRHLDMVQCVLPSSSHAACSHGLGRCGLSHECCFDISLVLSSNQKLVELDLSDNALGDFGIRLLCVGLKHLLCNLKKLWLVNSGLTSVCCSALSSVLSTNQNLTHLYLRGNTLGDKGIKLLCEGLLHPDCKLQVLELDNCNLTSHCCWDLSTLLTSSQSLRKLSLGNNDLGDLGVMMFCEVLKQQSCLLQNLGLSEMYFNYETKSALETLQEEKPELTVVFEPSW

SEQ ID NO: 57944 - protein, 219 aa, Homo sapiens
MNSSKSSETQCTERGCFSSQMFLWTVAGIPILFLSACFITRCVVTFRIFQTCDEKKFQLPENFTELSCYNYGSGSVKNCCPLNWEYFQSSCYFFSTDTISWALSLKNCSAMGAHLVVINSQEEQEFLSYKKPKMREFFIGLSDQVVEGQWQWVDGTPLTKSLSFWDVGEPNNIATLEDCATMRDSSNPRQNWNDVTCFLNYFRICEMVGINPLNKGKSL

SEQ ID NO: 57945 - protein, 168 aa, Homo sapiens
MEYHPDLENLDEDGYTQLHFDSQSNTRIAVVSEKGVLSSPCPPNWIIYEKSCYLFSMSLNSWDGSKRQCWQLGSNLLKIDSSNELGFIVKQVSSQPDNSFWIGLSRPQTEVPWLWEDGSTFSSNLFQIRTTATQENPSPNCVWIHVSVIYDQLCSVPSYSICEKKFSM

SEQ ID NO: 57946 - protein, 107 aa, Homo sapiens
MAHATLSAAPSNPRLLRVALLLLLLVAASRRAAGASVVTELRCQCLQTLQGIHLKNIQSVNVRSPGPHCAQTEVIATLKNGKKACLNPASPMVQKIIEKILNKGSTN

SEQ ID NO: 57947 - protein, 178 aa, Homo sapiens
MDPKQTTLLCLGLYGKPFLSADRGLVLMPGENISLTCSSAHIPFDRFSLAKEGELSLPQHQSGEHPANFSLGPVDLNVSGIYRCYGWYNRSPYLWSFPSNALELVVTDSIHQDYTTQNLIRMAVAGLVLVALLAILVENWHSHTALNKEASADVAEPSWSQQMCQPGLTFARTPSVCK

SEQ ID NO: 57948 - protein, 350 aa, Homo sapiens
METNSSLPTNISGGTPAVSAGYLFLDIITYLVFAVTFVLGVLGNGLVIWVAGFRMTHTVTTISYLNLAVADFCFTSTLPFFMVRKAMGGHWPFGWFLCKFVFTIVDINLFGSVFLIALIALDRCVCVLHPVWTQNHRTVSLAKKVIIGPWVMALLLTLPVIIRVTTVPGKTGTVACTFNFSPWTNDPKERINVAVAMLTVRGIIRFIIGFSAPMSIVAVSYGLIATKIHKQGLIKSSRPLRVLSFVAAAFFLCWSPYQVVALIATVRIRELLQGMYKEIGIAVDVTSALAFFNSCLNPMLYVFMGQDFRERLIHALPASLERALTEDSTQTSDTATNSTLPSAEVELQAK

SEQ ID NO: 57949 - protein, 439 aa, Homo sapiens
MTSILTVLICLGLSLDPRTHVQAGPLPKPTLWAEPGSVITQGSPVTLRCQGSLETQEYHLYREKKTALWITRIPQELVKKGQFPILSITWEHAGRYCCIYGSHTVGLSESSDPLELVVTGAYSKPTLSALPSPVVTSGGNVTIQCDSQVAFDGFILCKEGEDEHPQCLNSHSHARGSSRAIFSVGPVSPSRRWSYRCYGYDSRAPYVWSLPSDLLGLLVPGVSKKPSLSVQPGPVVAPGEKLTFQCGSDAGYDRFVLYKEWGRDFLQRPGRQPQAGLSQANFTLGPVSRSYGGQYTCSGAYNLSSEWSAPSDPLDILITGQIRARPFLSVRPGPTVASGENVTLLCQSQGGMHTFLLTKEGAADSPLRLKSKRQSHKYQAEFPMSPVTSAHAGTYRCYGSLSSNPYLLTHPSDPLELVVSGAAETLSPPQNKSDSKAGE

SEQ ID NO: 57950 - protein, 598 aa, Homo sapiens
MTPIVTVLICLGLSLGPRTHVQTGTIPKPTLWAEPDSVITQGSPVTLSCQGSLEAQEYRLYREKKSASWITRIRPELVKNGQFHIPSITWEHTGRYGCQYYSRARWSELSDPLVLVMTGAYPKPTLSAQPSPVVTSGGRVTLQCESQVAFGGFILCKEGEDEHPQCLNSQPHARGSSRAIFSVGPVSPNRRWSHRCYGYDLNSPYVWSSPSDLLELLVPGVSKKPSLSVQPGPVVAPGESLTLQCVSDVGYDRFVLYKEGERDLRQLPGRQPQAGLSQANFTLGPVSRSYGGQYRCYGAYNLSSEWSAPSDPLDILITGQIHGTPFISVQPGPTVASGENVTLLCQSWRQFHTFLLTKAGAADAPLRLRSIHEYPKYQAEFPMSPVTSAHAGTYRCYGSLNSDPYLLSHPSEPLELVVSGPSMGSSPPPTGPISTPAGPEDQPLTPTGSDPQSGLGRHLGVVIGILVAVVLLLLLLLLLFLILRHRRQGKHWTSTQRKADFQHPAGAVGPEPTDRGLQWRSSPAADAQEENLYAAVKDTQPEDGVEMDTRAAASEAPQDVTYAQLHSLTLRRKATEPPPSQEREPPAEPSIYATLAIH

SEQ ID NO: 57951 - protein, 238 aa, Homo sapiens
MQGWFNICRSINVTHHINRTKDKNHMIISIDAEKAFNKIQHRFMLKTLNKLGIEGPCLKIIRAICDKRTANIILNGQQLEAFPLKTGTRQGCPLSPLLFNIVLEVLARAIRQVKEIKGIQIGREEVNLSLLADDMILYLENPVVSAQRPLKLINNFSKVSGYRINVQKSLAFLYTSNSKADSQISNELPFTIATKRIKYLGIQLTREVKDLYKENYKPPLKEIGDDTQKNGKTFQAHG

SEQ ID NO: 57952 - protein, 238 aa, Homo sapiens
MQGWFNICRSINVTHHINRTKDKNHMIISIDAEKAFDKIQHRFMLKTLNKLGIEGPCLKIIRAICDKRTANIILNGQQLEAFPLKTGTRQGCPLSPLLFNIVLEVLARAIRQVKEIKGIQIGREEVNLSLLADDMILYLENPVVSAQRPLKLINNFSKVSGYRINVQKSLAFLYTSNSKADSQISNELPFTIATKRIKYLGIQLTREVKDLYKENYKPLLKEIGDDTQKNGKTFQAHG

SEQ ID NO: 57953 - protein, 356 aa, Homo sapiens [sequence omitted]

SEQ ID NO: 57954 - protein, 344 aa, Homo sapiens
MANYTLAPEDEYDVLIEGELESDEAEQCDKYDAQALSAQLVPSLCSAVFVIGVLDNLLVVLILVKYKGLKRVENIYLLNLAVSNLCFLLTLPFWAHAGGDPMCKILIGLYFVGLYSETFFNCLLTVQRYLVFLHKGNFFSARRRVPCGIITSVLAWVTAILATLPEYVVYKPQMEDQKYKCAFSRTPFLPADETFWKHFLTLKMNISVLVLPLFIFTFLYVQMRKTLRFREQRYSLFKLVFAIMVVFLLMWAPYNIAFFLSTFKEHFSLSDCKSSYNLDKSVHITKLIATTHCCINPLLYAFLDGTFSKYLCRCFHLRSNTPLQPRGQSAQGTSREEPDHSTEV

SEQ ID NO: 57955 - protein, 344 aa, Homo sapiens; identical to SEQ ID NO: 57954

SEQ ID NO: 57956 - protein, 252 aa, Homo sapiens
MGRNQSRKAENSKNESTSSPPKGHSSSPATEQSGTENDFDELTEVGFRRSVTTNFYELKEDVQTHRKEAKNLEKRLDKWLTRINSVEKTLSDMMELKTMARELRDTCSSFKSRFNQVEERVSVIEDQINEVKREDKVRDKKVRNKQSLQEIWDYVKRPNLRVIGVPESDGENGTKLENMLQDIIQENFPNLARQANIQIQEIQRTPQRYSSRRATPRHIIVRFTKVEMKQKVLRAAREKGPVTHKGNSGSLS

SEQ ID NO: 57957 - protein, 93 aa, Homo sapiens; identical to SEQ ID NO: 57938

SEQ ID NO: 57958 - protein, 64 aa, Homo sapiens
MQVSTAALAVLLCTMALCNQVLSAPLAADTPTACCFSYTSRQIPQNFIADYFETSSQCSKPSVM

SEQ ID NO: 57959 - protein, 104 aa, Homo sapiens
MFIQNLLWEKNVRNKDNHCMEVIRLKGLVSIKDKSQQVIVQGVHELCDLEETPVSWKDDTERTNRLVLIGRNLDKDILKQLFIATVTETEKQWTTHFKEDQVCT

SEQ ID NO: 57960 - protein, 214 aa, Homo sapiens
MHSGERPYECKICGKGFCSANSFQRHEKTHSGEKPYKCKQCGKAFIHSSSLRYHERIHTGEKPYECKQCGKAFRSSSHLQLHGRTHTGEKPYECQECGKAFRSMKNLQSHERTQTHVRIHSGERPYKCKLCGKGFYCPKSLQRHEKTHTGEKLYECKQCGEAFSSSSSFRYHERTHTGEKPYKCKQCGKAFRAASVLRMHGRTHPEDKPYECKQ

SEQ ID NO: 57961 - protein, 338 aa, Homo sapiens
MGKKQNRKTGNSKMQSASPPPKERSSSPATEQSWMENDFDELREEGFRRSNYSELREDIQTKGKEVENFEKNLEECITRITNTEKCLKELMELKTKARELREECRSLRSRCDQLEERVSAMEDEMNEMKREGKFREKRIKRNEQSLQEIWDYVKRPNLRLIGVPESDVENGTKLENTLQDIIQENFPNLARQAKVQIQEIQRTPQRYSSRRATPRHIIVRFTKVEMKEKMLRAAREKGRVTLKGKPIRLTADLSAETLQARREWGPIFNILKEKNFQPRISYPAKLSFISEGEIKYFIDKQMLRDFVTTRPALKELLKEALNMERNNRYQPLQNHAKM

SEQ ID NO: 57962 - protein, 252 aa, Homo sapiens; identical to SEQ ID NO: 57956

SEQ ID NO: 57963 - protein, 214 aa, Homo sapiens; identical to SEQ ID NO: 57960

SEQ ID NO: 57964 - protein, 534 aa, Homo sapiens
MTPIVTVLICLGLSLGPRTHVQTGTIPKPTLWAEPDSVITQGSPVTLSCQGSLEAQEYRLYREKKSASWITRIRPELVKNGQFHIPSITWEHTGRYGCQYYSRARWSELSDPLVLVMTGAYPKPTLSAQPSPVVTSGGRVTLQCESQVAFGGFILCKEGEDEHPQCLNSQPHARGSSRAIFSVGPVSPNRRWSHRCYGYDLNSPYVWSSPSDLLELLVPGVSKKPSLSVQPGPVVAPGESLTLQCVSDVGYDRFVLYKEGERDLRQLPGRQPQAGLSQANFTLGPVSRSYGGQYRCYGAHNLSSECSAPSDPLDILITGQIRGTPFISVQPGPTVASGENVTLLCQSWRQFHTFLLTKAGAADAPLRLRSIHEYPKYQAEFPMSPVTSAHAGTYRCYGSLNSDPYLLSHPSEPLELVVSGPSMGSSPPPTGPISTPAGPEDQPLTPTGSDPQSGLGRHLGVVIGILVAVVLLLLLLLLLFLILRHRRQGKHWTSTQRKADFQHPAGAVGPEPTDRGLQWRSSPAADAQEENLCE

SEQ ID NO: 57965 - protein, 896 aa, Homo sapiens
MNYVGQLAGQVIVTVKELYKGINQATLSGCIDVIVVQQQDGSYQCSPFHVRFGKLGVLRSKEKVIDIEINGSAVDLHMKLGDNGEAFFVEETEEEYEKLPAYLATSPIPTEDQFFKDIDTPLVKSGGDETPSQSSDISHVLETETIFTPSSVKKKKRRRKKYKQDSKKEEQAASAAAEDTCDVGVSSDDDKGAQAARGSSNASLKEEECKEPLLFHSGDHYPLSDGDWSPLETTYPQTACPKSDSELEVKPAESLLRSESHMEWTWGGFPESTKVSKRERSDHHPRTATITPSENTHFRVIPSEDNLISEVEKDASMEDTVCTIVKPKPRALGTQMSDPTSVAELLEPPLESTQISSMLDADHLPNAALAEAPSESKPAAKVDSPSKKKGVHKRSQHQGPDDIYLDDLKGLEPEVAALYFPKSESEPGSRQWPESDTLSGSQSPQSVGSAAADSGTECLSDSAMDLPDVTLSLCGGLSENGEISKEKFMEHIITYHEFAENPGLIDNPNLVIRIYNRYYNWALAAPMILSLQVFQKSLPKATVESWVKDKMPKKSGRWWFWRKRESMTKQLPESKEGKSEAPPASDLPSSSKEPAGARPAENDSSSDEGSQELEESITVDPIPTEPLSHGSTTSYKKSLRLSSDQIAKLKLHDGPNDVVFSITTQYQGTCRCAGTIYLWNWNDKIIISDIDGTITKSDALGQILPQLGKDWTHQGIAKLYHSINENGYKFLYCSARAIGMADMTRGYLHWVNDKGTILPRGPLMLSPSSLFSAFHREVIEKKPEKFKIECLNDIKNLFAPSKQPFYAAFGNRPNDVYAYTQVGVPDCRIFTVNPKGELIQERTKGNKSSYHRLSELVEHVFPLLSKEQNSAFPCPEFSSFCYWRDPIPEVDLDDLS

SEQ ID NO: 57966 - protein, 118 aa, Homo sapiens
MLSRNDDICIYGGLGLGGLLLLAVVLLSACLCWLHRRVKRLERSWPRAPQSRNSTMHLCRGCQCPAVRDLTSGAETREAPRRIQELTMPALLRTNPPEHPRHLPQPRRVDRVPLWSSQ

SEQ ID NO: 57967 - protein, 75 aa, Homo sapiens
MMPRAPQSRNSTMHLCRGCQCPAVRDLTSGAETREAPRRIQELTMPALLRTNPPEHPRHLPQPRRVDRVPLWSSQ

SEQ ID NO: 57968 - protein, 51 aa, Homo sapiens
MLSRNDVKRLERSWRLPVPSSEGPDLRGRDKRGTKEDPRADYACIAENKPT

SEQ ID NO: 57969 - protein, 63 aa, Homo sapiens
MHLCRGCQCPAVRDLTSGAETREAPRRIQELTMPALLRTNPPEHPRHLPQPRRVDRVPLWSSQ

SEQ ID NO: 57970 - protein, 39 aa, Homo sapiens
MMRLPVPSSEGPDLRGRDKRGTKEDPRADYACIAENKPT

SEQ ID NO: 57971 - protein, 526 aa, Homo sapiens
MSLVEAISLWNEGVLAADKKDWKGALDAFSAVQDPHSRICFNIGCMYTILKNMTEAEKAFTRSINRDKHLAVAYFQRGMLYYQTEKYDLAIKDLKEALIQLRGNQLIDYKILGLQFKLFACEVLYNIAFMYAKKEEWKKAEEQLALATSMKSEPRHSKIDKAMECVWKQKLYEPVVIPVGKLFRPNERQVAQLAKKDYLGKATVVASVVDQDSFSGFAPLQPQAAEPPPRPKTPEIFRALEGEAHRVLFGFVPETKEELQVMPGNIVFVLKKGNDNWATVMFNGQKGLVPCNYLEPVELRIHPQQQPQEESSPQSDIPAPPSSKAPGRPQLSPGQKQKEEPKEVKLSVPMPYTLKVHYKYTVVMKTQPGLPYSQVRDMVSKKLELRLEHTKLSYRPRDSNELVPLSEDSMKDAWGQVKNYCLTLWCENTVGDQGFPDEPKESEKADANNQTTEPQLKKGSQVEALFSYEATQPEDLEFQEGDIILVLSKVNEEWLEGECKGKVGIFPKVFVEDCATTDLESTRREV

SEQ ID NO: 57972 - protein, 318 aa, Homo sapiens [sequence omitted]

SEQ ID NO: 57973 - protein, 583 aa, Homo sapiens [sequence omitted]

SEQ ID NO: 57974 - protein, 675 aa, Homo sapiens
MLRATAPCWFPPGYPEAKKVAEEAALEASRHLGGEQSQAGAPEGSKMLRATAPCWFRPGYPEAKKVAKEAAPEASRHLGAEQSPAGAPEGSKMLRATAPCWFPPGYPEAKKVAEEAALEAPEFPLPSHQPAQSFGLWVPQMHKQASAFVDIQAEPQNRGPAVPPAWPKMVTESCYFPAQRGSACRLPAAPRLTERPSGVRISAPRKRKTIAHSSSPCLVTGYTDAKRTRVASSSQRSRGSKVGRQPGKTRNRSGMACKTTATTSSKRIVRRPSLPSLSLKKPIILRSSGCQVPTVLRRGYLQLFTEECLKFCASKQEAEEKALNEEKVAYDCSPNKNRYLNVVLNTLKRLKGLTPSSMPGLSRAALYSRLQEFLLTQDQLKENGYPFPHPERPGGAVLFTGQGKGPGDSSCRVCCRCGTEYLVSSSGRCVRDQLCYYHWGRVRSSQVAGGRVSQYTCCAAAPGSVGCQVAKQHVRDGRKESLDGFVETFKKELSRDAYPGIYALDCEMCYTTHGLELTRVTVVDADMRVVYDTFVKPDNEIVDYNTRFSGVTEADVAKTSITLPQVQAILLSFFSAQTILIGHSLESDLLALKLIHNTVVDTAVLFPHYLGFPYKRSLRNLAADYLAQIIQDSQDGHNSSEDANACLQLVMWKVRQRAQIQPRHRSASPAALACP

SEQ ID NO: 57975 - protein, 675 aa, Homo sapiens
MLRATAPCWFPPGYPEAKKVAEEAALEASRHLGGEQSQAGAPEGSKMLRATAPCWFRPGYPEAKKVAKEAAPEASRHLGAEQSPAGAPEGSKMLRATAPCWFPPGYPEAKKVAEEAALEAPEFPLPSHQPAQSFGLWVPQMHKQASAFVDIQAEPQNRGPAVPPAWPKMVTESCYFPAQRGSACRLPAAPRLTERPSGVRISAPRKRKTIAHSSSPCLVTGYTDAKRTRVASSSQRSRGSKVGRQPGKTRNRSGMACKTTATTSSKRIVRRPSLPSLSLKKPIILRSSGCQVPTVLRRGYLQLFTEECLKFCASKQEAEEKALNEEKVAYDCSPNKNRYLNVVLNTLKRLKGLTPSSMPGLSRAALYSRLQEFLLTQDQLKENGYPFPHPERPGGAVLFTGQGKGPGDSSCRVCCRCGTEYLVSSSGRCVRDQLCYYHWGRVRSSQVAGGRVSQYTCCAAAPGSVGCQVAKQHVRDGRKESLHGFVETFKKELSRDAYPGIYALDCEMCYTTHGLELARVTVVDADMRVVYDTFVKPDNEIVDYNTRFSGVTEADVAKTSITLPQVQAILLSFFSAQTILIGHSLESDLLALKLIHSTVVDTAVLFPHYLGFPYKRSLRNLAADYLAQIIQDSQDGHNSSEDANACLQLVMWKVRQRAQIQPRHRSASPAALACP

SEQ ID NO: 57976 - protein, 581 aa, Homo sapiens
MLRATAPCWFPPGYPEAKKVAEEAALEAPEFPLPSHQPAQSFGLWVPQMHKQASAFVDIQAEPQNRGPAVPPAWPKMVTESCYFPAQRGSACRLPAAPRLTERPSGVRISAPRKRKTIAHSSSPCLVTGYTDAKRTRVASSSQRSIGSQVGRQPGKTRKRSGMACKTTATISSKRIVRRLSLPSLKKPIILRSSGCQVPTILRRCYLQLFTEECLKFCASKQEAEEKALNEEKVAYDCSPNKNRYLNVVLNTLKRLKGLTPSSMPGLSRAALYSRLQEFLLTQDQLKENGYPFPHPERPGGAVLFTGQGKGPGDSSCRVCCRCGTEYLVSSLGRCVRDQLCYYHWGRVRSSQVAGGRVSQYTCCAAAPGSVGCQVAKQHVRDGRKESLHGFVETFKKELSRDAYPGIYALDCEMCYTTHGLELTRVTVVDADMRVVYDTFVKPDNEIVDYNTRFSGVTEADVAKTSITLPQVQAILLSFFSAQTILIGHSLESDLLALKLIHSTVVDTAVLFPHYLGFPYKRSLRNLAADYLAQIIQDSQDGHNSSEDANACLQLGDVEGQQRAQIQPRHRSASPAALACP

SEQ ID NO: 57977 - protein, 287 aa, Homo sapiens
MKDRLAELLDLSKQYDQQFPDGDDEFDSPHEDIVFETDHILESLYRDIRDIQDENQLLVADVKRLGKQNARFLTSMRRLSSIKRDTNSIAKAIKARGEVIHCKLRAMKELSEAAEAQHGPHSAVARISRAQYNALTLTFQRAMHDYNQAEMKQRDNCKIRIQRQLEIMGKEVSGDQIEDMFEQGKWDVFSENLLADVKGARAALNEIESRHRELLRLESRIRDVHELFLQMAVLVEKQADTLNVIELNVQKTVDYTGQAKAQVRKAVQYEEKNPCRTLCCFCCPCLK

SEQ ID NO: 57978 - protein, 233 aa, Homo sapiens
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 57979 - protein, 236 aa, Homo sapiens
MTAEFLSLLCLGLCLGYEDEKKNEKPPKPSLHAWPSSVVEAESNVTLKCQAHSQNVTFVLRKVNDSGYKQEQSSAENEAEFPFTDLKPKDAGRYFCAYKTTASHEWSESSEHLQLVVTDKHDELEAPSMKTDTRTIFVAIFSCISILLLFLSVFIIYRCSQHGSSSEESTKRTSHSKLPEQEAAEADLSNMERVSLSTADPQGVTYAELSTSALSEAASDTTQEPPGSHEYAALKV

SEQ ID NO: 57980 - DNA, 20 bp, Homo sapiens
gatcgtgaagaagacctgtg

SEQ ID NO: 57981 - DNA, 20 bp, Homo sapiens
gatctacagggtcacttggt

SEQ ID NO: 57982 - DNA, 20 bp, Homo sapiens
gatcggtaaccggcgactac

SEQ ID NO: 57983 - DNA, 20 bp, Homo sapiens
gatctttcacttctttggtt

SEQ ID NO: 57984 - DNA, 20 bp, Homo sapiens
gatcgctgtcttgtggtatt

SEQ ID NO: 57985 - DNA, 20 bp, Homo sapiens
gatcatggctcaccacaacc

SEQ ID NO: 57986 - DNA, 20 bp, Homo sapiens
gatcattgcaaactcaacac

SEQ ID NO: 57987 - DNA, 20 bp, Homo sapiens
gatccccaggatgcccactt

SEQ ID NO: 57988 - DNA, 20 bp, Homo sapiens
gatcgcctgtgccgtggctt

SEQ ID NO: 57989 - DNA, 20 bp, Homo sapiens
gatcttgtgtacccttcacc

SEQ ID NO: 57990 - DNA, 20 bp, Homo sapiens
gatcacagccctgaacaaaa

SEQ ID NO: 57991 - DNA, 20 bp, Homo sapiens
gatcggcctggggaaataat

SEQ ID NO: 57992 - DNA, 20 bp, Homo sapiens
gatcccatgtgtaaaattct

SEQ ID NO: 57993 - DNA, 20 bp, Homo sapiens
gatccgaccagacccaggga

SEQ ID NO: 57994 - DNA, 20 bp, Homo sapiens
gatcttgagagtgacaggat

SEQ ID NO: 57995 - DNA, 20 bp, Homo sapiens
gatcacagagggagcgcagg

SEQ ID NO: 57996 - DNA, 20 bp, Homo sapiens
gatcatggtcagagtggagt

SEQ ID NO: 57997 - DNA, 20 bp, Homo sapiens
gatcaacaggagagaccttt

SEQ ID NO: 57998 - DNA, 20 bp, Homo sapiens
gatccacatggtctgccttc

SEQ ID NO: 57999 - DNA, 20 bp, Homo sapiens
gatccttccggtggagtgtc

SEQ ID NO: 58000 - DNA, 20 bp, Homo sapiens
gatctttccacacttctgac

SEQ ID NO: 58001 - DNA, 20 bp, Homo sapiens
gatcttttctcacttcaatc

SEQ ID NO: 58002 - DNA, 20 bp, Homo sapiens
gatctcaccagattttgtat

SEQ ID NO: 58003 - DNA, 20 bp, Homo sapiens
gatccctagacatggaatca

SEQ ID NO: 58004 - DNA, 20 bp, Homo sapiens
gatcaacaatttaatgtatt

SEQ ID NO: 58005 - DNA, 20 bp, Homo sapiens
gatcaccactggcatctctg

SEQ ID NO: 58006 - DNA, 20 bp, Homo sapiens
gatcataagactgtcatgta

SEQ ID NO: 58007 - DNA, 20 bp, Homo sapiens
gatctctcctttttataaca

SEQ ID NO: 58008 - DNA, 20 bp, Homo sapiens
gatcttaatgggaaagaata

SEQ ID NO: 58009 - DNA, 20 bp, Homo sapiens
gatcactgttagggtaaggg

SEQ ID NO: 58010 - DNA, 20 bp, Homo sapiens
gatccagagttgccgcaagt

SEQ ID NO: 58011 - DNA, 20 bp, Homo sapiens
gatccgcatggccgtggcag

SEQ ID NO: 58012 - DNA, 20 bp, Homo sapiens
gatcgatttgcacccacctt

SEQ ID NO: 58013 - DNA, 20 bp, Homo sapiens
gatcttcaatctctgatatc

SEQ ID NO: 58014 - DNA, 20 bp, Homo sapiens
gatccgctgttagtctgatg

SEQ ID NO: 58015 - DNA, 20 bp, Homo sapiens
gatcttagttatttcttgcc

SEQ ID NO: 58016 - DNA, 20 bp, Homo sapiens
gatctttcctgctttctctt

SEQ ID NO: 58017 - DNA, 20 bp, Homo sapiens
gatcgcggtgaccgtgggca

SEQ ID NO: 58018 - DNA, 20 bp, Homo sapiens
gatcattgggccctgggtga

SEQ ID NO: 58019 - DNA, 20 bp, Homo sapiens
gatccttccatcttcttgaa

SEQ ID NO: 58020 - DNA, 20 bp, Homo sapiens
gatcactgaactgcacgctc

SEQ ID NO: 58021 - DNA, 20 bp, Homo sapiens
gatcccaaaaattacccaaa

SEQ ID NO: 58022 - DNA, 20 bp, Homo sapiens
gatcgtacaggtgcatcgtg

SEQ ID NO: 58023 - DNA, 20 bp, Homo sapiens
gatctcctgtccatcagcca

SEQ ID NO: 58024 - DNA, 20 bp, Homo sapiens
gatcaccgagtccggccgca

SEQ ID NO: 58025 - DNA, 20 bp, Homo sapiens
gatcaccttccaggtgaagg

SEQ ID NO: 58026 - DNA, 20 bp, Homo sapiens
gatcttgtaatccgactttt

SEQ ID NO: 58027 - DNA, 20 bp, Homo sapiens
gatcaatacacgaatatcct

SEQ ID NO: 58028 - DNA, 20 bp, Homo sapiens
gatcccacaggagcttgtga

SEQ ID NO: 58029 - DNA, 20 bp, Homo sapiens
gatccgtgccagacccttcc

SEQ ID NO: 58030 - DNA, 20 bp, Homo sapiens
gatctgtctaatattgtcag

SEQ ID NO: 58031 - DNA, 20 bp, Homo sapiens
gatctttcacctccctagtt

SEQ ID NO: 58032 - DNA, 20 bp, Homo sapiens
gatctttctaactttttgat

SEQ ID NO: 58033 - DNA, 20 bp, Homo sapiens
gatctttgttgatttaaagt

SEQ ID NO: 58034 - DNA, 20 bp, Homo sapiens
gatctttgttggtttaaaat

SEQ ID NO: 58035 - DNA, 20 bp, Homo sapiens
gatcgtctgaagccttcttc

SEQ ID NO: 58036 - DNA, 20 bp, Homo sapiens
gatcatctgaagccttcttc

SEQ ID NO: 58037 - DNA, 20 bp, Homo sapiens
gatctcaaactccatgctgg

SEQ ID NO: 58038 - DNA, 20 bp, Homo sapiens
gatcgttctcttttgctgac

SEQ ID NO: 58039 - DNA, 20 bp, Homo sapiens
gatcaatttgaacggaggct

SEQ ID NO: 58040 - DNA, 20 bp, Homo sapiens
gatcaatagccgctactggt

SEQ ID NO: 58041 - DNA, 20 bp, Homo sapiens
gatccacaaggcattagagc

SEQ ID NO: 58042 - DNA, 20 bp, Homo sapiens
gatctatttaagataacctt

SEQ ID NO: 58043 - DNA, 20 bp, Homo sapiens
gatctgaaatatcccataat

SEQ ID NO: 58044 - DNA, 20 bp, Homo sapiens
gatcttaggcaaaataccag

SEQ ID NO: 58045 - DNA, 20 bp, Homo sapiens
gatcccttattttacatgaa

SEQ ID NO: 58046 - DNA, 20 bp, Homo sapiens
gatcctcccctctgcttttt

SEQ ID NO: 58047 - DNA, 20 bp, Homo sapiens
gatcctggattaaagactcc

SEQ ID NO: 58048 - DNA, 20 bp, Homo sapiens
gatcttgaattcttcaaggt

SEQ ID NO: 58049 - DNA, 20 bp, Homo sapiens
gatccaccctcagcagcagc

SEQ ID NO: 58050 - DNA, 20 bp, Homo sapiens
gatctggacttcatccagca

SEQ ID NO: 58051 - DNA, 20 bp, Homo sapiens
gatctttaggtcatcaaaag

SEQ ID NO: 58052 - DNA, 20 bp, Homo sapiens
gatcctggaattttctcacg

SEQ ID NO: 58053 - DNA, 20 bp, Homo sapiens
gatccggacttcaggaataa

SEQ ID NO: 58054 - DNA, 20 bp, Homo sapiens
gatcaaggccggaccccact

SEQ ID NO: 58055 - DNA, 20 bp, Homo sapiens
gatccagccagggcagagag

SEQ ID NO: 58056 - DNA, 20 bp, Homo sapiens
gatccgggggacccctttgc

SEQ ID NO: 58057 - DNA, 20 bp, Homo sapiens
gatctaacctagactaaaat

SEQ ID NO: 58058 - DNA, 20 bp, Homo sapiens
gatcgggaaaggaacccatt

SEQ ID NO: 58059 - DNA, 20 bp, Homo sapiens
gatctttgttggtttaaagt

SEQ ID NO: 58060 - DNA, 20 bp, Homo sapiens
gatctcagcacaccagaagg

SEQ ID NO: 58061 - DNA, 20 bp, Homo sapiens
gatcattatgtacatatatt

SEQ ID NO: 58062 - DNA, 20 bp, Homo sapiens
gatcttatttctgctcattt

SEQ ID NO: 58063 - DNA, 20 bp, Homo sapiens
gatccctgacatctggaatc

SEQ ID NO: 58064 - DNA, 20 bp, Homo sapiens
gatcctccccacttggactg

SEQ ID NO: 58065 - DNA, 20 bp, Homo sapiens
gatcgcatccgcttggtggt

SEQ ID NO: 58066 - DNA, 20 bp, Homo sapiens
gatctaccagcctcccaagg

SEQ ID NO: 58067 - DNA, 20 bp, Homo sapiens
gatcatcaacaagtcttcta

SEQ ID NO: 58068 - DNA, 20 bp, Homo sapiens
gatcgtgctggccaaggtta

SEQ ID NO: 58069 - DNA, 7445 bp, Homo sapiens
ctgtctacggcagctattccagaggcaacaactgcttccctctgttctcatctccccattggtggctggcgacccgaatttgggaatggggagattgcccacctgttatctttgagcagactaatctcttgtaagcagaagtgccattcggagtctccagagccctgtggcttggggctgggaatgtccccctgacttcaggctttcctaagtgtattgcttttctctgagaatggtctaggtttttaattttttaattgtaagaatctgtaatacagcatttttatttcggtcttattcgttgtgctcaaaggcaggaaacaactattaatttgccttctcgaatcttaatagttataagattcattctctttcattgctctgctaggcataaaacacacttcgaacatgggtaactcattcgactgtggagttcttttaattcttatgaaagatttcaaatcctctggaagccaaaatgggacacagtaaacagattcgaattttacttctgaacgaaatggagaaactggaaaagaccctcttcagacttgaacaagggtatgagctacagttccgattaggcccaactttacagggaaaagcagttaccgtgtatacaaattacccatttcctggagaaacatttaatagagaaaaattccgttctctggattgggaaaatccaacagaaagagaagatgattctgataaatactgtaaacttaatctgcaacaatctggttcatttcagtattatttccttcaaggaaatgagaaaagtggtggaggttacatagttgtggaccccattttacgtgttggtgctgataatcatgtgctacccttggactgtgttactcttcagacatttttagctaagtgtttgggaccttttgatgaatgggaaagcagacttagggttgcaaaagaatcaggctacaacatgattcattttaccccattgcagactcttggactatctaggtcatgctactcccttgccaatcagttagaattaaatcctgacttttcaagacctaatagaaagtatacctggaatgatgttggacagctagtggaaaaattaaaaaaggaatggaatgttatttgtattactgatgttgtctacaatcatactgctgctaatagtaaatggatccaggaacatccagaatgtgcctataatcttgtgaattctccacacttaaaacctgcctgggtcttagacagagcactttggcgtttctcctgtgatgttgcagaagggaaatacaaagaaaagggaatacctgctttgattgaaaatgatcaccatatgaattccatccgaaaaataatttgggaggatatttttccaaagcttaaactctgggaatttttccaagtagatgtcaacaaagcggttgagcaatttagaagacttcttacacaagaaaataggcgagtaaccaagtctgatccaaaccaacaccttacgattattcaagatcctgaatacagacggtttggctgtactgtagatatgaacattgcactaacgactttcataccacatgacaaggggccagcagcaattgaagaatgctgtaattggtttcataaaagaatggaggaattaaattcagagaagcatcgactcattaactatcatcaggaacaggcagttaattgccttttgggaaatgtgttttatgaacgactggctggccatggtccaaaactaggacctgtcactagaaagcatcctttagttaccaggtattttactttcccatttgaagagatagacttctccatggaagaatctatgattcatctgccaaataaagcttgttttctgatggcacacaatggatgggtaatgggagatgatcctcttcgaaactttgctgaaccgggttcagaagtttacctaaggagagaacttatttgctggggagacagtgttaaattacgctatgggaataaaccagaggactgtccttatctctgggcacacatgaaaaaatacactgaaataactgcaacttatttccagggagtacgtcttgataactgccactcaacacctcttcacgtagctgagtacatgttggatgctgctaggaatttgcaacccaatttatatgtagtagctgaactgttcacaggaagtgaagatctggacaatgtctttgttactagactgggcattagttccttaataagagaggcaatgagtgcatataatagtcatgaagagggcagattagtttaccgatatggaggagaacctgttggatcctttgttcagccctgtttgaggcctttaatgccagctattgcacatgccctgtttatggatattacgcatgataatgagtgtcctattgtgcatagatcagcgtatgatgctcttccaagtactacaattgtttctatggcatgttgtgctagtggaagtacaagaggctatgatgaattagtgcctcatcagatttcagtggtttctgaagaacggttttacactaagtggaatcctgaagcattgccttcaaacacaggtgaagttaatttccaaagcggcattattgcagccaggtgtgctatcagtaaacttcatcaggagcttggagccaagggttttattcaggtgtatgtggatcaagttgatgaagacatagtggcagtaacaagacactcacctagcatccatcagtctgttgtggctgtatctagaactgctttcaggaatcccaagacttcattttacagcaaggaagtgcctcaaatgtgcatccctggcaaaattgaagaagtagttcttgaagctagaactattgagagaaacacgaaaccttataggaaggatgagaattcaatcaatggaacaccagatatcacagtagaaattagagaacatattcagcttaatgaaagtaaaattgttaaacaagctggagttgccacaaaagggcccaatgaatatattcaagaaatagaatttgaaaacttgtctccaggaagtgttattatattcagagttagtcttgatccacatgcacaagtcgctgttggaattcttcgaaatcatctgacacaattcagtcctcactttaaatctggcagcctagctgttgacaatgcagatcctatattaaaaattccttttgcttctcttgcctccagattaactttggctgagctaaatcagatcctttaccgatgtgaatcagaagaaaaggaagatggtggagggtgctatgacataccaaactggtcagcccttaaatatgcaggtcttcaaggtttaatgtctgtattggcagaaataagaccaaagaatgacttggggcatcctttttgtaataatttgagatctggagattggatgattgactatgtcagtaaccggcttatttcacgatcaggaactattgctgaagttggtaaatggttgcaggctatgttcttctacctgaagcagatcccacgttaccttatcccatgttactttgatgctatattaattggtgcatataccactcttctggatacagcatggaagcagatgtcaagctttgttcagaatggttcaacctttgtgaaacacctttcattgggttcagttcaactgtgtggagtaggaaaattcccttccctgccaattctttcacctgccctaatggatgtaccttataggttaaatgagatcacaaaagaaaaggagcaatgttgtgtttctctagctgcaggcttacctcatttttcttctggtattttccgctgctggggaagggatacttttattgcacttagaggtatactgctgattactggacgctatgtagaagccaggaatattattttagcatttgcgggtaccctgaggcatggtctcattcctaatctactgggtgaagggatttatgccagatacaattgtcgggatgctgtgtggtggtggctgcagtgtatccaggattactgtaaaatggttccaaatggtctagacattctcaagtgcccagtttccagaatgtatcctacagatgattctgctcctttgcctgctggcacactggatcagccattgtttgaagtcatacaggaagcaatgcaaaaacacatgcagggcatacagttccgagaaaggaatgctggtccccagatagatcgaaacatgaaggacgaaggttttaatataactgcaggagttgatgaagaaacaggatttgtttatggaggaaatcgtttcaattgtggcacatggatggataaaatgggagaaagtgacagagctagaaacagaggaatcccagccacaccaagagatgggtctgctgtggaaattgtgggcctgagtaaatctgctgttcgctggttgctggaattatccaaaaaaaatattttcccttatcatgaagtcacagtaaaaagacatggaaaggctataaaggtctcatatgatgagtggaacagaaaaatacaagacaactttgaaaagctatttcatgtttccgaagacccttcagatttaaatgaaaagcatccaaatctggttcacaaacgtggcatatacaaagatagttatggagcttcaagtccttggtgtgactatcagctcaggcctaattttaccatagcaatggttgtggcccctgagctctttactacagaaaaagcagggaaagctttggagattgcagaaaaaaaattgcttggtccccttggcatgaaaactttagatccagatgatatggtttactgtggaatttatgacaatgcattagacaatgacaactacaatcttgctaaaggtttcaattatcaccaaggacctgagtggctgtggcctattgggtattttcttcgtgcaaaattatatttttccagattgatgggcccggagactactgcaaagactatagttttggttaaaaatgttctttcccgacattatgttcatcttgagagatccccttggaaaggacttccagaactgaccaatgagaatgcccagtactgtcctttcagctgtgaaacacaagcctggtcaattgctactattcttgagacactttatgatttatagtttattacagatattaagtatgcaattactgtattataggatgcaaggtcatcatatgtaaatgctatatgcacaggctcaagttgttttaaaaatctcatttattataatattgatgctcaattaggtaagattgtaaaagcattgattttttttaatgtacagaggtagatttcaatttgaatcagaaagaaatatcattaccaatgaaatgtgtttgagttcagtaagaattattcaaatgcctagaaatccatagtttggaaaataaaaatcatgtcatcttctatttgtacagaaatgaaaataaaatatgaaaataatgaaagaaatgaaaagatagcttttaattgtggtatatataatcttcagtaacaatacatactgaatacgctgtggttcattaatattaacaccacgtactatagtattcttagaatacagtgctcactgcatttaataaatatttaataaatgatgaatgatagaagtttccatctacaatatatgttcctaaatggagcacagatgttcaaactatgctttcattttttcactgatatattaatttttgtgtaatgaatgccaacagtatattttatatgatttacttatgtgaggaaacatgcaaagcattaggaaatttatttcctaaaaacagttttgtaaaattagtattgagttctattgagtattataagatagcttacattttcaaaatggaaattgtcggtcatatttctagaactttaaagaaaaaagaatgttatattagttttctaaaactcaactatctttagtcatgttcaaaaatctattgctagatcatagtagatactggttttctattaactcaaaacctacattgacaagtttaacattgagaagaatcttaacaaaaatatggatatgaattcagtagatatcttaaattcaataaaatcactggaagtttttcatgataacttattttaagatgccttaaaaatcttaaagtcacaaaaggaaaaaggtttttaacatttacatgagttaacattttttcatagaacttatttcctagatagaattttttactgttttttactgttttcttaagaaaacagttaaatcattatgcattcagttggaagaaagtagtggcaagaattctttcattgctatataatattcagtggctcatttatacctaataaaataatggtattttaaaataatgctactttcaaagtagcatttttttagttagtttacaggttacatacccaaaaccttaactatgactaagaaattaaagaagaaaaccagcaaactaaaacttctgggcagcaaaaatatataaatgcttcagatgtcaaatacccatgcttgaaagctcgtgtaatttactttaagattatctgcctgctcttcttcaaagctgaccttgctttagaaatagttttaactagcttagttttctggtttccaaaactaaaatagattaaatcctacaaatttaaggacagttgtgacagtaatctgaccactatctataaatacattggacattggtttccaaatctccctttctcttcagttccttccttgttcaatatatacccttctctaaactgtgcgggtaaaaggaatgactgtccttgagagaaccattagtttatcaaaggtttatgtagttttgttgctgtaccctaactttgatattcagggaggtaggaaaggtaacagaaaaccagcatatttaatcaaagcaagaagtaatcgctgacagttaaatgtgaccaaaaaaattaaaagttcacaatttttttaatgtagccatttggggttatctctagtaaggcagatacccacgttggtaaatttttaggatattgtgttgcactagaaaactaagtggttcatatttctaatgaggaagattaatgaaagaacattgttatattctgcgtggtatattttaaagtttaagaaggcatgttaaacattatttcctctatggtagttaaaatacagaattagatttttaacaggtgtcatttgactaaacgtttcggtagaatgcttcatacttgagtgatgctggataaggtattgtatttcaacaatggactatgccttggtttttcactaatcaaaatcaaaattactctttaacatgataaatgaatttaccagtttagtatgctgtggtattttaataagttttcaaagataattgggaaaacatgagactggtcatattgatgaatattgtaacatgtgaattgtgatccatttctgatatgtcttgaactactgtgtctagtaggcaaatgtcattgttacctctgtgtgttaagaaaataaaaatattttctaaaggtcg

SEQ ID NO: 58070 - DNA, 7367 bp, Homo sapiens
cccggaagtgggccagaggtacggtccgctcccacctggggcgagtgcgcgcacggccaggttgggtaccgggtgcgcccaggaacccgcgcgaggcgaagtcgctgagactctgcctgcttctcacccagctgcctcggcgctgccccggtcgctcgccgcccctccctttgcccttcacggcgcccggccctccttgggctgcggcttctgtgcgaggctgggcagccagcccttccccttctgtttctccccgtcccctccccccgaccgtagcaccagagtcgcgggtcctgcagtgccccagaagccgcacgtataactccctcggcgggtaactcattcgactgtggagttcttttaattcttatgaaagatttcaaatcctctggaagccaaaatgggacacagtaaacagattcgaattttacttctgaacgaaatggagaaactggaaaagaccctcttcagacttgaacaagggtatgagctacagttccgattaggcccaactttacagggaaaagcagttaccgtgtatacaaattacccatttcctggagaaacatttaatagagaaaaattccgttctctggattgggaaaatccaacagaaagagaagatgattctgataaatactgtaaacttaatctgcaacaatctggttcatttcagtattatttccttcaaggaaatgagaaaagtggtggaggttacatagttgtggaccccattttacgtgttggtgctgataatcatgtgctacccttggactgtgttactcttcagacatttttagctaagtgtttgggaccttttgatgaatgggaaagcagacttagggttgcaaaagaatcaggctacaacatgattcattttaccccattgcagactcttggactatctaggtcatgctactcccttgccaatcagttagaattaaatcctgacttttcaagacctaatagaaagtatacctggaatgatgttggacagctagtggaaaaattaaaaaaggaatggaatgttatttgtattactgatgttgtctacaatcatactgctgctaatagtaaatggatccaggaacatccagaatgtgcctataatcttgtgaattctccacacttaaaacctgcctgggtcttagacagagcactttggcgtttctcctgtgatgttgcagaagggaaatacaaagaaaagggaatacctgctttgattgaaaatgatcaccatatgaattccatccgaaaaataatttgggaggatatttttccaaagcttaaactctgggaatttttccaagtagatgtcaacaaagcggttgagcaatttagaagacttcttacacaagaaaataggcgagtaaccaagtctgatccaaaccaacaccttacgattattcaagatcctgaatacagacggtttggctgtactgtagatatgaacattgcactaacgactttcataccacatgacaaggggccagcagcaattgaagaatgctgtaattggtttcataaaagaatggaggaattaaattcagagaagcatcgactcattaactatcatcaggaacaggcagttaattgccttttgggaaatgtgttttatgaacgactggctggccatggtccaaaactaggacctgtcactagaaagcatcctttagttaccaggtattttactttcccatttgaagagatagacttctccatggaagaatctatgattcatctgccaaataaagcttgttttctgatggcacacaatggatgggtaatgggagatgatcctcttcgaaactttgctgaaccgggttcagaagtttacctaaggagagaacttatttgctggggagacagtgttaaattacgctatgggaataaaccagaggactgtccttatctctgggcacacatgaaaaaatacactgaaataactgcaacttatttccagggagtacgtcttgataactgccactcaacacctcttcacgtagctgagtacatgttggatgctgctaggaatttgcaacccaatttatatgtagtagctgaactgttcacaggaagtgaagatctggacaatgtctttgttactagactgggcattagttccttaataagagaggcaatgagtgcatataatagtcatgaagagggcagattagtttaccgatatggaggagaacctgttggatcctttgttcagccctgtttgaggcctttaatgccagctattgcacatgccctgtttatggatattacgcatgataatgagtgtcctattgtgcatagatcagcgtatgatgctcttccaagtactacaattgtttctatggcatgttgtgctagtggaagtacaagaggctatgatgaattagtgcctcatcagatttcagtggtttctgaagaacggttttacactaagtggaatcctgaagcattgccttcaaacacaggtgaagttaatttccaaagcggcattattgcagccaggtgtgctatcagtaaacttcatcaggagcttggagccaagggttttattcaggtgtatgtggatcaagttgatgaagacatagtggcagtaacaagacactcacctagcatccatcagtctgttgtggctgtatctagaactgctttcaggaatcccaagacttcattttacagcaaggaagtgcctcaaatgtgcatccctggcaaaattgaagaagtagttcttgaagctagaactattgagagaaacacgaaaccttataggaaggatgagaattcaatcaatggaacaccagatatcacagtagaaattagagaacatattcagcttaatgaaagtaaaattgttaaacaagctggagttgccacaaaagggcccaatgaatatattcaagaaatagaatttgaaaacttgtctccaggaagtgttattatattcagagttagtcttgatccacatgcacaagtcgctgttggaattcttcgaaatcatctgacacaattcagtcctcactttaaatctggcagcctagctgttgacaatgcagatcctatattaaaaattccttttgcttctcttgcctccagattaactttggctgagctaaatcagatcctttaccgatgtgaatcagaagaaaaggaagatggtggagggtgctatgacataccaaactggtcagcccttaaatatgcaggtcttcaaggtttaatgtctgtattggcagaaataagaccaaagaatgacttggggcatcctttttgtaataatttgagatctggagattggatgattgactatgtcagtaaccggcttatttcacgatcaggaactattgctgaagttggtaaatggttgcaggctatgttcttctacctgaagcagatcccacgttaccttatcccatgttactttgatgctatattaattggtgcatataccactcttctggatacagcatggaagcagatgtcaagctttgttcagaatggttcaacctttgtgaaacacctttcattgggttcagttcaactgtgtggagtaggaaaattcccttccctgccaattctttcacctgccctaatggatgtaccttataggttaaatgagatcacaaaagaaaaggagcaatgttgtgtttctctagctgcaggcttacctcatttttcttctggtattttccgctgctggggaagggatacttttattgcacttagaggtatactgctgattactggacgctatgtagaagccaggaatattattttagcatttgcgggtaccctgaggcatggtctcattcctaatctactgggtgaagggatttatgccagatacaattgtcgggatgctgtgtggtggtggctgcagtgtatccaggattactgtaaaatggttccaaatggtctagacattctcaagtgcccagtttccagaatgtatcctacagatgattctgctcctttgcctgctggcacactggatcagccattgtttgaagtcatacaggaagcaatgcaaaaacacatgcagggcatacagttccgagaaaggaatgctggtccccagatagatcgaaacatgaaggacgaaggttttaatataactgcaggagttgatgaagaaacaggatttgtttatggaggaaatcgtttcaattgtggcacatggatggataaaatgggagaaagtgacagagctagaaacagaggaatcccagccacaccaagagatgggtctgctgtggaaattgtgggcctgagtaaatctgctgttcgctggttgctggaattatccaaaaaaaatattttcccttatcatgaagtcacagtaaaaagacatggaaaggctataaaggtctcatatgatgagtggaacagaaaaatacaagacaactttgaaaagctatttcatgtttccgaagacccttcagatttaaatgaaaagcatccaaatctggttcacaaacgtggcatatacaaagatagttatggagcttcaagtccttggtgtgactatcagctcaggcctaattttaccatagcaatggttgtggcccctgagctctttactacagaaaaagcagggaaagctttggagattgcagaaaaaaaattgcttggtccccttggcatgaaaactttagatccagatgatatggtttactgtggaatttatgacaatgcattagacaatgacaactacaatcttgctaaaggtttcaattatcaccaaggacctgagtggctgtggcctattgggtattttcttcgtgcaaaattatatttttccagattgatgggcccggagactactgcaaagactatagttttggttaaaaatgttctttcccgacattatgttcatcttgagagatccccttggaaaggacttccagaactgaccaatgagaatgcccagtactgtcctttcagctgtgaaacacaagcctggtcaattgctactattcttgagacactttatgatttatagtttattacagatattaagtatgcaattactgtattataggatgcaaggtcatcatatgtaaatgctatatgcacaggctcaagttgttttaaaaatctcatttattataatattgatgctcaattaggtaagattgtaaaagcattgattttttttaatgtacagaggtagatttcaatttgaatcagaaagaaatatcattaccaatgaaatgtgtttgagttcagtaagaattattcaaatgcctagaaatccatagtttggaaaataaaaatcatgtcatcttctatttgtacagaaatgaaaataaaatatgaaaataatgaaagaaatgaaaagatagcttttaattgtggtatatataatcttcagtaacaatacatactgaatacgctgtggttcattaatattaacaccacgtactatagtattcttagaatacagtgctcactgcatttaataaatatttaataaatgatgaatgatagaagtttccatctacaatatatgttcctaaatggagcacagatgttcaaactatgctttcattttttcactgatatattaatttttgtgtaatgaatgccaacagtatattttatatgatttacttatgtgaggaaacatgcaaagcattaggaaatttatttcctaaaaacagttttgtaaaattagtattgagttctattgagtattataagatagcttacattttcaaaatggaaattgtcggtcatatttctagaactttaaagaaaaaagaatgttatattagttttctaaaactcaactatctttagtcatgttcaaaaatctattgctagatcatagtagatactggttttctattaactcaaaacctacattgacaagtttaacattgagaagaatcttaacaaaaatatggatatgaattcagtagatatcttaaattcaataaaatcactggaagtttttcatgataacttattttaagatgccttaaaaatcttaaagtcacaaaaggaaaaaggtttttaacatttacatgagttaacattttttcatagaacttatttcctagatagaattttttactgttttttactgttttcttaagaaaacagttaaatcattatgcattcagttggaagaaagtagtggcaagaattctttcattgctatataatattcagtggctcatttatacctaataaaataatggtattttaaaataatgctactttcaaagtagcatttttttagttagtttacaggttacatacccaaaaccttaactatgactaagaaattaaagaagaaaaccagcaaactaaaacttctgggcagcaaaaatatataaatgcttcagatgtcaaatacccatgcttgaaagctcgtgtaatttactttaagattatctgcctgctcttcttcaaagctgaccttgctttagaaatagttttaactagcttagttttctggtttccaaaactaaaatagattaaatcctacaaatttaaggacagttgtgacagtaatctgaccactatctataaatacattggacattggtttccaaatctccctttctcttcagttccttccttgttcaatatatacccttctctaaactgtgcgggtaaaaggaatgactgtccttgagagaaccattagtttatcaaaggtttatgtagttttgttgctgtaccctaactttgatattcagggaggtaggaaaggtaacagaaaaccagcatatttaatcaaagcaagaagtaatcgctgacagttaaatgtgaccaaaaaaattaaaagttcacaatttttttaatgtagccatttggggttatctctagtaaggcagatacccacgttggtaaatttttaggatattgtgttgcactagaaaactaagtggttcatatttctaatgaggaagattaatgaaagaacattgttatattctgcgtggtatattttaaagtttaagaaggcatgttaaacattatttcctctatggtagttaaaatacagaattagatttttaacaggtgtcatttgactaaacgtttcggtagaatgcttcatacttgagtgatgctggataaggtattgtatttcaacaatggactatgccttggtttttcactaatcaaaatcaaaattactctttaacatgataaatgaatttaccagtttagtatgctgtggtattttaataagttttcaaagataattgggaaaacatgagactggtcatattgatgaatattgtaacatgtgaattgtgatccatttctgatatgtcttgaactactgtgtctagtaggcaaatgtcattgttacctctgtgtgttaagaaaataaaaatattttctaaaggtcg

SEQ ID NO: 58071 - DNA, 7165 bp, Homo sapiens
ctgtctacggcagctattccagaggcaacaactgcttccctctgttctcatctccccattggtggctggcgacccgaatttgggaatggggagattgcccacctgttatctttgagcagactaatctcttgggtaactcattcgactgtggagttcttttaattcttatgaaagatttcaaatcctctggaagccaaaatgggacacagtaaacagattcgaattttacttctgaacgaaatggagaaactggaaaagaccctcttcagacttgaacaagggtatgagctacagttccgattaggcccaactttacagggaaaagcagttaccgtgtatacaaattacccatttcctggagaaacatttaatagagaaaaattccgttctctggattgggaaaatccaacagaaagagaagatgattctgataaatactgtaaacttaatctgcaacaatctggttcatttcagtattatttccttcaaggaaatgagaaaagtggtggaggttacatagttgtggaccccattttacgtgttggtgctgataatcatgtgctacccttggactgtgttactcttcagacatttttagctaagtgtttgggaccttttgatgaatgggaaagcagacttagggttgcaaaagaatcaggctacaacatgattcattttaccccattgcagactcttggactatctaggtcatgctactcccttgccaatcagttagaattaaatcctgacttttcaagacctaatagaaagtatacctggaatgatgttggacagctagtggaaaaattaaaaaaggaatggaatgttatttgtattactgatgttgtctacaatcatactgctgctaatagtaaatggatccaggaacatccagaatgtgcctataatcttgtgaattctccacacttaaaacctgcctgggtcttagacagagcactttggcgtttctcctgtgatgttgcagaagggaaatacaaagaaaagggaatacctgctttgattgaaaatgatcaccatatgaattccatccgaaaaataatttgggaggatatttttccaaagcttaaactctgggaatttttccaagtagatgtcaacaaagcggttgagcaatttagaagacttcttacacaagaaaataggcgagtaaccaagtctgatccaaaccaacaccttacgattattcaagatcctgaatacagacggtttggctgtactgtagatatgaacattgcactaacgactttcataccacatgacaaggggccagcagcaattgaagaatgctgtaattggtttcataaaagaatggaggaattaaattcagagaagcatcgactcattaactatcatcaggaacaggcagttaattgccttttgggaaatgtgttttatgaacgactggctggccatggtccaaaactaggacctgtcactagaaagcatcctttagttaccaggtattttactttcccatttgaagagatagacttctccatggaagaatctatgattcatctgccaaataaagcttgttttctgatggcacacaatggatgggtaatgggagatgatcctcttcgaaactttgctgaaccgggttcagaagtttacctaaggagagaacttatttgctggggagacagtgttaaattacgctatgggaataaaccagaggactgtccttatctctgggcacacatgaaaaaatacactgaaataactgcaacttatttccagggagtacgtcttgataactgccactcaacacctcttcacgtagctgagtacatgttggatgctgctaggaatttgcaacccaatttatatgtagtagctgaactgttcacaggaagtgaagatctggacaatgtctttgttactagactgggcattagttccttaataagagaggcaatgagtgcatataatagtcatgaagagggcagattagtttaccgatatggaggagaacctgttggatcctttgttcagccctgtttgaggcctttaatgccagctattgcacatgccctgtttatggatattacgcatgataatgagtgtcctattgtgcatagatcagcgtatgatgctcttccaagtactacaattgtttctatggcatgttgtgctagtggaagtacaagaggctatgatgaattagtgcctcatcagatttcagtggtttctgaagaacggttttacactaagtggaatcctgaagcattgccttcaaacacaggtgaagttaatttccaaagcggcattattgcagccaggtgtgctatcagtaaacttcatcaggagcttggagccaagggttttattcaggtgtatgtggatcaagttgatgaagacatagtggcagtaacaagacactcacctagcatccatcagtctgttgtggctgtatctagaactgctttcaggaatcccaagacttcattttacagcaaggaagtgcctcaaatgtgcatccctggcaaaattgaagaagtagttcttgaagctagaactattgagagaaacacgaaaccttataggaaggatgagaattcaatcaatggaacaccagatatcacagtagaaattagagaacatattcagcttaatgaaagtaaaattgttaaacaagctggagttgccacaaaagggcccaatgaatatattcaagaaatagaatttgaaaacttgtctccaggaagtgttattatattcagagttagtcttgatccacatgcacaagtcgctgttggaattcttcgaaatcatctgacacaattcagtcctcactttaaatctggcagcctagctgttgacaatgcagatcctatattaaaaattccttttgcttctcttgcctccagattaactttggctgagctaaatcagatcctttaccgatgtgaatcagaagaaaaggaagatggtggagggtgctatgacataccaaactggtcagcccttaaatatgcaggtcttcaaggtttaatgtctgtattggcagaaataagaccaaagaatgacttggggcatcctttttgtaataatttgagatctggagattggatgattgactatgtcagtaaccggcttatttcacgatcaggaactattgctgaagttggtaaatggttgcaggctatgttcttctacctgaagcagatcccacgttaccttatcccatgttactttgatgctatattaattggtgcatataccactcttctggatacagcatggaagcagatgtcaagctttgttcagaatggttcaacctttgtgaaacacctttcattgggttcagttcaactgtgtggagtaggaaaattcccttccctgccaattctttcacctgccctaatggatgtaccttataggttaaatgagatcacaaaagaaaaggagcaatgttgtgtttctctagctgcaggcttacctcatttttcttctggtattttccgctgctggggaagggatacttttattgcacttagaggtatactgctgattactggacgctatgtagaagccaggaatattattttagcatttgcgggtaccctgaggcatggtctcattcctaatctactgggtgaagggatttatgccagatacaattgtcgggatgctgtgtggtggtggctgcagtgtatccaggattactgtaaaatggttccaaatggtctagacattctcaagtgcccagtttccagaatgtatcctacagatgattctgctcctttgcctgctggcacactggatcagccattgtttgaagtcatacaggaagcaatgcaaaaacacatgcagggcatacagttccgagaaaggaatgctggtccccagatagatcgaaacatgaaggacgaaggttttaatataactgcaggagttgatgaagaaacaggatttgtttatggaggaaatcgtttcaattgtggcacatggatggataaaatgggagaaagtgacagagctagaaacagaggaatcccagccacaccaagagatgggtctgctgtggaaattgtgggcctgagtaaatctgctgttcgctggttgctggaattatccaaaaaaaatattttcccttatcatgaagtcacagtaaaaagacatggaaaggctataaaggtctcatatgatgagtggaacagaaaaatacaagacaactttgaaaagctatttcatgtttccgaagacccttcagatttaaatgaaaagcatccaaatctggttcacaaacgtggcatatacaaagatagttatggagcttcaagtccttggtgtgactatcagctcaggcctaattttaccatagcaatggttgtggcccctgagctctttactacagaaaaagcagggaaagctttggagattgcagaaaaaaaattgcttggtccccttggcatgaaaactttagatccagatgatatggtttactgtggaatttatgacaatgcattagacaatgacaactacaatcttgctaaaggtttcaattatcaccaaggacctgagtggctgtggcctattgggtattttcttcgtgcaaaattatatttttccagattgatgggcccggagactactgcaaagactatagttttggttaaaaatgttctttcccgacattatgttcatcttgagagatccccttggaaaggacttccagaactgaccaatgagaatgcccagtactgtcctttcagctgtgaaacacaagcctggtcaattgctactattcttgagacactttatgatttatagtttattacagatattaagtatgcaattactgtattataggatgcaaggtcatcatatgtaaatgctatatgcacaggctcaagttgttttaaaaatctcatttattataatattgatgctcaattaggtaagattgtaaaagcattgattttttttaatgtacagaggtagatttcaatttgaatcagaaagaaatatcattaccaatgaaatgtgtttgagttcagtaagaattattcaaatgcctagaaatccatagtttggaaaataaaaatcatgtcatcttctatttgtacagaaatgaaaataaaatatgaaaataatgaaagaaatgaaaagatagcttttaattgtggtatatataatcttcagtaacaatacatactgaatacgctgtggttcattaatattaacaccacgtactatagtattcttagaatacagtgctcactgcatttaataaatatttaataaatgatgaatgatagaagtttccatctacaatatatgttcctaaatggagcacagatgttcaaactatgctttcattttttcactgatatattaatttttgtgtaatgaatgccaacagtatattttatatgatttacttatgtgaggaaacatgcaaagcattaggaaatttatttcctaaaaacagttttgtaaaattagtattgagttctattgagtattataagatagcttacattttcaaaatggaaattgtcggtcatatttctagaactttaaagaaaaaagaatgttatattagttttctaaaactcaactatctttagtcatgttcaaaaatctattgctagatcatagtagatactggttttctattaactcaaaacctacattgacaagtttaacattgagaagaatcttaacaaaaatatggatatgaattcagtagatatcttaaattcaataaaatcactggaagtttttcatgataacttattttaagatgccttaaaaatcttaaagtcacaaaaggaaaaaggtttttaacatttacatgagttaacattttttcatagaacttatttcctagatagaattttttactgttttttactgttttcttaagaaaacagttaaatcattatgcattcagttggaagaaagtagtggcaagaattctttcattgctatataatattcagtggctcatttatacctaataaaataatggtattttaaaataatgctactttcaaagtagcatttttttagttagtttacaggttacatacccaaaaccttaactatgactaagaaattaaagaagaaaaccagcaaactaaaacttctgggcagcaaaaatatataaatgcttcagatgtcaaatacccatgcttgaaagctcgtgtaatttactttaagattatctgcctgctcttcttcaaagctgaccttgctttagaaatagttttaactagcttagttttctggtttccaaaactaaaatagattaaatcctacaaatttaaggacagttgtgacagtaatctgaccactatctataaatacattggacattggtttccaaatctccctttctcttcagttccttccttgttcaatatatacccttctctaaactgtgcgggtaaaaggaatgactgtccttgagagaaccattagtttatcaaaggtttatgtagttttgttgctgtaccctaactttgatattcagggaggtaggaaaggtaacagaaaaccagcatatttaatcaaagcaagaagtaatcgctgacagttaaatgtgaccaaaaaaattaaaagttcacaatttttttaatgtagccatttggggttatctctagtaaggcagatacccacgttggtaaatttttaggatattgtgttgcactagaaaactaagtggttcatatttctaatgaggaagattaatgaaagaacattgttatattctgcgtggtatattttaaagtttaagaaggcatgttaaacattatttcctctatggtagttaaaatacagaattagatttttaacaggtgtcatttgactaaacgtttcggtagaatgcttcatacttgagtgatgctggataaggtattgtatttcaacaatggactatgccttggtttttcactaatcaaaatcaaaattactctttaacatgataaatgaatttaccagtttagtatgctgtggtattttaataagttttcaaagataattgggaaaacatgagactggtcatattgatgaatattgtaacatgtgaattgtgatccatttctgatatgtcttgaactactgtgtctagtaggcaaatgtcattgttacctctgtgtgttaagaaaataaaaatattttctaaaggtcg

SEQ ID NO: 58072 - DNA, 7105 bp, Homo sapiens
ctgtctacggcagctattccagaggcaacaactgcttccctctgttctcatctccccattggtggctggcgacccgaatttgggaatggggagattgcccacctgttatctttgagcagactaatctcttaagccaaaatgggacacagtaaacagattcgaattttacttctgaacgaaatggagaaactggaaaagaccctcttcagacttgaacaagggtatgagctacagttccgattaggcccaactttacagggaaaagcagttaccgtgtatacaaattacccatttcctggagaaacatttaatagagaaaaattccgttctctggattgggaaaatccaacagaaagagaagatgattctgataaatactgtaaacttaatctgcaacaatctggttcatttcagtattatttccttcaaggaaatgagaaaagtggtggaggttacatagttgtggaccccattttacgtgttggtgctgataatcatgtgctacccttggactgtgttactcttcagacatttttagctaagtgtttgggaccttttgatgaatgggaaagcagacttagggttgcaaaagaatcaggctacaacatgattcattttaccccattgcagactcttggactatctaggtcatgctactcccttgccaatcagttagaattaaatcctgacttttcaagacctaatagaaagtatacctggaatgatgttggacagctagtggaaaaattaaaaaaggaatggaatgttatttgtattactgatgttgtctacaatcatactgctgctaatagtaaatggatccaggaacatccagaatgtgcctataatcttgtgaattctccacacttaaaacctgcctgggtcttagacagagcactttggcgtttctcctgtgatgttgcagaagggaaatacaaagaaaagggaatacctgctttgattgaaaatgatcaccatatgaattccatccgaaaaataatttgggaggatatttttccaaagcttaaactctgggaatttttccaagtagatgtcaacaaagcggttgagcaatttagaagacttcttacacaagaaaataggcgagtaaccaagtctgatccaaaccaacaccttacgattattcaagatcctgaatacagacggtttggctgtactgtagatatgaacattgcactaacgactttcataccacatgacaaggggccagcagcaattgaagaatgctgtaattggtttcataaaagaatggaggaattaaattcagagaagcatcgactcattaactatcatcaggaacaggcagttaattgccttttgggaaatgtgttttatgaacgactggctggccatggtccaaaactaggacctgtcactagaaagcatcctttagttaccaggtattttactttcccatttgaagagatagacttctccatggaagaatctatgattcatctgccaaataaagcttgttttctgatggcacacaatggatgggtaatgggagatgatcctcttcgaaactttgctgaaccgggttcagaagtttacctaaggagagaacttatttgctggggagacagtgttaaattacgctatgggaataaaccagaggactgtccttatctctgggcacacatgaaaaaatacactgaaataactgcaacttatttccagggagtacgtcttgataactgccactcaacacctcttcacgtagctgagtacatgttggatgctgctaggaatttgcaacccaatttatatgtagtagctgaactgttcacaggaagtgaagatctggacaatgtctttgttactagactgggcattagttccttaataagagaggcaatgagtgcatataatagtcatgaagagggcagattagtttaccgatatggaggagaacctgttggatcctttgttcagccctgtttgaggcctttaatgccagctattgcacatgccctgtttatggatattacgcatgataatgagtgtcctattgtgcatagatcagcgtatgatgctcttccaagtactacaattgtttctatggcatgttgtgctagtggaagtacaagaggctatgatgaattagtgcctcatcagatttcagtggtttctgaagaacggttttacactaagtggaatcctgaagcattgccttcaaacacaggtgaagttaatttccaaagcggcattattgcagccaggtgtgctatcagtaaacttcatcaggagcttggagccaagggttttattcaggtgtatgtggatcaagttgatgaagacatagtggcagtaacaagacactcacctagcatccatcagtctgttgtggctgtatctagaactgctttcaggaatcccaagacttcattttacagcaaggaagtgcctcaaatgtgcatccctggcaaaattgaagaagtagttcttgaagctagaactattgagagaaacacgaaaccttataggaaggatgagaattcaatcaatggaacaccagatatcacagtagaaattagagaacatattcagcttaatgaaagtaaaattgttaaacaagctggagttgccacaaaagggcccaatgaatatattcaagaaatagaatttgaaaacttgtctccaggaagtgttattatattcagagttagtcttgatccacatgcacaagtcgctgttggaattcttcgaaatcatctgacacaattcagtcctcactttaaatctggcagcctagctgttgacaatgcagatcctatattaaaaattccttttgcttctcttgcctccagattaactttggctgagctaaatcagatcctttaccgatgtgaatcagaagaaaaggaagatggtggagggtgctatgacataccaaactggtcagcccttaaatatgcaggtcttcaaggtttaatgtctgtattggcagaaataagaccaaagaatgacttggggcatcctttttgtaataatttgagatctggagattggatgattgactatgtcagtaaccggcttatttcacgatcaggaactattgctgaagttggtaaatggttgcaggctatgttcttctacctgaagcagatcccacgttaccttatcccatgttactttgatgctatattaattggtgcatataccactcttctggatacagcatggaagcagatgtcaagctttgttcagaatggttcaacctttgtgaaacacctttcattgggttcagttcaactgtgtggagtaggaaaattcccttccctgccaattctttcacctgccctaatggatgtaccttataggttaaatgagatcacaaaagaaaaggagcaatgttgtgtttctctagctgcaggcttacctcatttttcttctggtattttccgctgctggggaagggatacttttattgcacttagaggtatactgctgattactggacgctatgtagaagccaggaatattattttagcatttgcgggtaccctgaggcatggtctcattcctaatctactgggtgaagggatttatgccagatacaattgtcgggatgctgtgtggtggtggctgcagtgtatccaggattactgtaaaatggttccaaatggtctagacattctcaagtgcccagtttccagaatgtatcctacagatgattctgctcctttgcctgctggcacactggatcagccattgtttgaagtcatacaggaagcaatgcaaaaacacatgcagggcatacagttccgagaaaggaatgctggtccccagatagatcgaaacatgaaggacgaaggttttaatataactgcaggagttgatgaagaaacaggatttgtttatggaggaaatcgtttcaattgtggcacatggatggataaaatgggagaaagtgacagagctagaaacagaggaatcccagccacaccaagagatgggtctgctgtggaaattgtgggcctgagtaaatctgctgttcgctggttgctggaattatccaaaaaaaatattttcccttatcatgaagtcacagtaaaaagacatggaaaggctataaaggtctcatatgatgagtggaacagaaaaatacaagacaactttgaaaagctatttcatgtttccgaagacccttcagatttaaatgaaaagcatccaaatctggttcacaaacgtggcatatacaaagatagttatggagcttcaagtccttggtgtgactatcagctcaggcctaattttaccatagcaatggttgtggcccctgagctctttactacagaaaaagcagggaaagctttggagattgcagaaaaaaaattgcttggtccccttggcatgaaaactttagatccagatgatatggtttactgtggaatttatgacaatgcattagacaatgacaactacaatcttgctaaaggtttcaattatcaccaaggacctgagtggctgtggcctattgggtattttcttcgtgcaaaattatatttttccagattgatgggcccggagactactgcaaagactatagttttggttaaaaatgttctttcccgacattatgttcatcttgagagatccccttggaaaggacttccagaactgaccaatgagaatgcccagtactgtcctttcagctgtgaaacacaagcctggtcaattgctactattcttgagacactttatgatttatagtttattacagatattaagtatgcaattactgtattataggatgcaaggtcatcatatgtaaatgctatatgcacaggctcaagttgttttaaaaatctcatttattataatattgatgctcaattaggtaagattgtaaaagcattgattttttttaatgtacagaggtagatttcaatttgaatcagaaagaaatatcattaccaatgaaatgtgtttgagttcagtaagaattattcaaatgcctagaaatccatagtttggaaaataaaaatcatgtcatcttctatttgtacagaaatgaaaataaaatatgaaaataatgaaagaaatgaaaagatagcttttaattgtggtatatataatcttcagtaacaatacatactgaatacgctgtggttcattaatattaacaccacgtactatagtattcttagaatacagtgctcactgcatttaataaatatttaataaatgatgaatgatagaagtttccatctacaatatatgttcctaaatggagcacagatgttcaaactatgctttcattttttcactgatatattaatttttgtgtaatgaatgccaacagtatattttatatgatttacttatgtgaggaaacatgcaaagcattaggaaatttatttcctaaaaacagttttgtaaaattagtattgagttctattgagtattataagatagcttacattttcaaaatggaaattgtcggtcatatttctagaactttaaagaaaaaagaatgttatattagttttctaaaactcaactatctttagtcatgttcaaaaatctattgctagatcatagtagatactggttttctattaactcaaaacctacattgacaagtttaacattgagaagaatcttaacaaaaatatggatatgaattcagtagatatcttaaattcaataaaatcactggaagtttttcatgataacttattttaagatgccttaaaaatcttaaagtcacaaaaggaaaaaggtttttaacatttacatgagttaacattttttcatagaacttatttcctagatagaattttttactgttttttactgttttcttaagaaaacagttaaatcattatgcattcagttggaagaaagtagtggcaagaattctttcattgctatataatattcagtggctcatttatacctaataaaataatggtattttaaaataatgctactttcaaagtagcatttttttagttagtttacaggttacatacccaaaaccttaactatgactaagaaattaaagaagaaaaccagcaaactaaaacttctgggcagcaaaaatatataaatgcttcagatgtcaaatacccatgcttgaaagctcgtgtaatttactttaagattatctgcctgctcttcttcaaagctgaccttgctttagaaatagttttaactagcttagttttctggtttccaaaactaaaatagattaaatcctacaaatttaaggacagttgtgacagtaatctgaccactatctataaatacattggacattggtttccaaatctccctttctcttcagttccttccttgttcaatatatacccttctctaaactgtgcgggtaaaaggaatgactgtccttgagagaaccattagtttatcaaaggtttatgtagttttgttgctgtaccctaactttgatattcagggaggtaggaaaggtaacagaaaaccagcatatttaatcaaagcaagaagtaatcgctgacagttaaatgtgaccaaaaaaattaaaagttcacaatttttttaatgtagccatttggggttatctctagtaaggcagatacccacgttggtaaatttttaggatattgtgttgcactagaaaactaagtggttcatatttctaatgaggaagattaatgaaagaacattgttatattctgcgtggtatattttaaagtttaagaaggcatgttaaacattatttcctctatggtagttaaaatacagaattagatttttaacaggtgtcatttgactaaacgtttcggtagaatgcttcatacttgagtgatgctggataaggtattgtatttcaacaatggactatgccttggtttttcactaatcaaaatcaaaattactctttaacatgataaatgaatttaccagtttagtatgctgtggtattttaataagttttcaaagataattgggaaaacatgagactggtcatattgatgaatattgtaacatgtgaattgtgatccatttctgatatgtcttgaactactgtgtctagtaggcaaatgtcattgttacctctgtgtgttaagaaaataaaaatattttctaaaggtcg

SEQ ID NO: 58073 - DNA, 7180 bp, Homo sapiens
tgtataagaatttgcacatcccaagttgctatgtgaataggaatgtacgtttccaggggaaggagaaagagacattacagagcagacagctctatgatgtttactatacttgctaaaatgtgaaattcagctaaattggaatacaaagtagtgccaaaacagcattaggtttgcggagttattttaaacataattgaaaaatcaaggttttttaatactttaaataaaacatctgtttttcaatgtggtaatttaagtcctacgatgagtttattaacatgtgctttttatttagggtatgagctacagttccgattaggcccaactttacagggaaaagcagttaccgtgtatacaaattacccatttcctggagaaacatttaatagagaaaaattccgttctctggattgggaaaatccaacagaaagagaagatgattctgataaatactgtaaacttaatctgcaacaatctggttcatttcagtattatttccttcaaggaaatgagaaaagtggtggaggttacatagttgtggaccccattttacgtgttggtgctgataatcatgtgctacccttggactgtgttactcttcagacatttttagctaagtgtttgggaccttttgatgaatgggaaagcagacttagggttgcaaaagaatcaggctacaacatgattcattttaccccattgcagactcttggactatctaggtcatgctactcccttgccaatcagttagaattaaatcctgacttttcaagacctaatagaaagtatacctggaatgatgttggacagctagtggaaaaattaaaaaaggaatggaatgttatttgtattactgatgttgtctacaatcatactgctgctaatagtaaatggatccaggaacatccagaatgtgcctataatcttgtgaattctccacacttaaaacctgcctgggtcttagacagagcactttggcgtttctcctgtgatgttgcagaagggaaatacaaagaaaagggaatacctgctttgattgaaaatgatcaccatatgaattccatccgaaaaataatttgggaggatatttttccaaagcttaaactctgggaatttttccaagtagatgtcaacaaagcggttgagcaatttagaagacttcttacacaagaaaataggcgagtaaccaagtctgatccaaaccaacaccttacgattattcaagatcctgaatacagacggtttggctgtactgtagatatgaacattgcactaacgactttcataccacatgacaaggggccagcagcaattgaagaatgctgtaattggtttcataaaagaatggaggaattaaattcagagaagcatcgactcattaactatcatcaggaacaggcagttaattgccttttgggaaatgtgttttatgaacgactggctggccatggtccaaaactaggacctgtcactagaaagcatcctttagttaccaggtattttactttcccatttgaagagatagacttctccatggaagaatctatgattcatctgccaaataaagcttgttttctgatggcacacaatggatgggtaatgggagatgatcctcttcgaaactttgctgaaccgggttcagaagtttacctaaggagagaacttatttgctggggagacagtgttaaattacgctatgggaataaaccagaggactgtccttatctctgggcacacatgaaaaaatacactgaaataactgcaacttatttccagggagtacgtcttgataactgccactcaacacctcttcacgtagctgagtacatgttggatgctgctaggaatttgcaacccaatttatatgtagtagctgaactgttcacaggaagtgaagatctggacaatgtctttgttactagactgggcattagttccttaataagagaggcaatgagtgcatataatagtcatgaagagggcagattagtttaccgatatggaggagaacctgttggatcctttgttcagccctgtttgaggcctttaatgccagctattgcacatgccctgtttatggatattacgcatgataatgagtgtcctattgtgcatagatcagcgtatgatgctcttccaagtactacaattgtttctatggcatgttgtgctagtggaagtacaagaggctatgatgaattagtgcctcatcagatttcagtggtttctgaagaacggttttacactaagtggaatcctgaagcattgccttcaaacacaggtgaagttaatttccaaagcggcattattgcagccaggtgtgctatcagtaaacttcatcaggagcttggagccaagggttttattcaggtgtatgtggatcaagttgatgaagacatagtggcagtaacaagacactcacctagcatccatcagtctgttgtggctgtatctagaactgctttcaggaatcccaagacttcattttacagcaaggaagtgcctcaaatgtgcatccctggcaaaattgaagaagtagttcttgaagctagaactattgagagaaacacgaaaccttataggaaggatgagaattcaatcaatggaacaccagatatcacagtagaaattagagaacatattcagcttaatgaaagtaaaattgttaaacaagctggagttgccacaaaagggcccaatgaatatattcaagaaatagaatttgaaaacttgtctccaggaagtgttattatattcagagttagtcttgatccacatgcacaagtcgctgttggaattcttcgaaatcatctgacacaattcagtcctcactttaaatctggcagcctagctgttgacaatgcagatcctatattaaaaattccttttgcttctcttgcctccagattaactttggctgagctaaatcagatcctttaccgatgtgaatcagaagaaaaggaagatggtggagggtgctatgacataccaaactggtcagcccttaaatatgcaggtcttcaaggtttaatgtctgtattggcagaaataagaccaaagaatgacttggggcatcctttttgtaataatttgagatctggagattggatgattgactatgtcagtaaccggcttatttcacgatcaggaactattgctgaagttggtaaatggttgcaggctatgttcttctacctgaagcagatcccacgttaccttatcccatgttactttgatgctatattaattggtgcatataccactcttctggatacagcatggaagcagatgtcaagctttgttcagaatggttcaacctttgtgaaacacctttcattgggttcagttcaactgtgtggagtaggaaaattcccttccctgccaattctttcacctgccctaatggatgtaccttataggttaaatgagatcacaaaagaaaaggagcaatgttgtgtttctctagctgcaggcttacctcatttttcttctggtattttccgctgctggggaagggatacttttattgcacttagaggtatactgctgattactggacgctatgtagaagccaggaatattattttagcatttgcgggtaccctgaggcatggtctcattcctaatctactgggtgaagggatttatgccagatacaattgtcgggatgctgtgtggtggtggctgcagtgtatccaggattactgtaaaatggttccaaatggtctagacattctcaagtgcccagtttccagaatgtatcctacagatgattctgctcctttgcctgctggcacactggatcagccattgtttgaagtcatacaggaagcaatgcaaaaacacatgcagggcatacagttccgagaaaggaatgctggtccccagatagatcgaaacatgaaggacgaaggttttaatataactgcaggagttgatgaagaaacaggatttgtttatggaggaaatcgtttcaattgtggcacatggatggataaaatgggagaaagtgacagagctagaaacagaggaatcccagccacaccaagagatgggtctgctgtggaaattgtgggcctgagtaaatctgctgttcgctggttgctggaattatccaaaaaaaatattttcccttatcatgaagtcacagtaaaaagacatggaaaggctataaaggtctcatatgatgagtggaacagaaaaatacaagacaactttgaaaagctatttcatgtttccgaagacccttcagatttaaatgaaaagcatccaaatctggttcacaaacgtggcatatacaaagatagttatggagcttcaagtccttggtgtgactatcagctcaggcctaattttaccatagcaatggttgtggcccctgagctctttactacagaaaaagcagggaaagctttggagattgcagaaaaaaaattgcttggtccccttggcatgaaaactttagatccagatgatatggtttactgtggaatttatgacaatgcattagacaatgacaactacaatcttgctaaaggtttcaattatcaccaaggacctgagtggctgtggcctattgggtattttcttcgtgcaaaattatatttttccagattgatgggcccggagactactgcaaagactatagttttggttaaaaatgttctttcccgacattatgttcatcttgagagatccccttggaaaggacttccagaactgaccaatgagaatgcccagtactgtcctttcagctgtgaaacacaagcctggtcaattgctactattcttgagacactttatgatttatagtttattacagatattaagtatgcaattactgtattataggatgcaaggtcatcatatgtaaatgctatatgcacaggctcaagttgttttaaaaatctcatttattataatattgatgctcaattaggtaagattgtaaaagcattgattttttttaatgtacagaggtagatttcaatttgaatcagaaagaaatatcattaccaatgaaatgtgtttgagttcagtaagaattattcaaatgcctagaaatccatagtttggaaaataaaaatcatgtcatcttctatttgtacagaaatgaaaataaaatatgaaaataatgaaagaaatgaaaagatagcttttaattgtggtatatataatcttcagtaacaatacatactgaatacgctgtggttcattaatattaacaccacgtactatagtattcttagaatacagtgctcactgcatttaataaatatttaataaatgatgaatgatagaagtttccatctacaatatatgttcctaaatggagcacagatgttcaaactatgctttcattttttcactgatatattaatttttgtgtaatgaatgccaacagtatattttatatgatttacttatgtgaggaaacatgcaaagcattaggaaatttatttcctaaaaacagttttgtaaaattagtattgagttctattgagtattataagatagcttacattttcaaaatggaaattgtcggtcatatttctagaactttaaagaaaaaagaatgttatattagttttctaaaactcaactatctttagtcatgttcaaaaatctattgctagatcatagtagatactggttttctattaactcaaaacctacattgacaagtttaacattgagaagaatcttaacaaaaatatggatatgaattcagtagatatcttaaattcaataaaatcactggaagtttttcatgataacttattttaagatgccttaaaaatcttaaagtcacaaaaggaaaaaggtttttaacatttacatgagttaacattttttcatagaacttatttcctagatagaattttttactgttttttactgttttcttaagaaaacagttaaatcattatgcattcagttggaagaaagtagtggcaagaattctttcattgctatataatattcagtggctcatttatacctaataaaataatggtattttaaaataatgctactttcaaagtagcatttttttagttagtttacaggttacatacccaaaaccttaactatgactaagaaattaaagaagaaaaccagcaaactaaaacttctgggcagcaaaaatatataaatgcttcagatgtcaaatacccatgcttgaaagctcgtgtaatttactttaagattatctgcctgctcttcttcaaagctgaccttgctttagaaatagttttaactagcttagttttctggtttccaaaactaaaatagattaaatcctacaaatttaaggacagttgtgacagtaatctgaccactatctataaatacattggacattggtttccaaatctccctttctcttcagttccttccttgttcaatatatacccttctctaaactgtgcgggtaaaaggaatgactgtccttgagagaaccattagtttatcaaaggtttatgtagttttgttgctgtaccctaactttgatattcagggaggtaggaaaggtaacagaaaaccagcatatttaatcaaagcaagaagtaatcgctgacagttaaatgtgaccaaaaaaattaaaagttcacaatttttttaatgtagccatttggggttatctctagtaaggcagatacccacgttggtaaatttttaggatattgtgttgcactagaaaactaagtggttcatatttctaatgaggaagattaatgaaagaacattgttatattctgcgtggtatattttaaagtttaagaaggcatgttaaacattatttcctctatggtagttaaaatacagaattagatttttaacaggtgtcatttgactaaacgtttcggtagaatgcttcatacttgagtgatgctggataaggtattgtatttcaacaatggactatgccttggtttttcactaatcaaaatcaaaattactctttaacatgataaatgaatttaccagtttagtatgctgtggtattttaataagttttcaaagataattgggaaaacatgagactggtcatattgatgaatattgtaacatgtgaattgtgatccatttctgatatgtcttgaactactgtgtctagtaggcaaatgtcattgttacctctgtgtgttaagaaaataaaaatattttctaaaggtcg

SEQ ID NO: 58074 - DNA, 7178 bp, Homo sapiens
gggtaactcattcgactgtggagttcttttaattcttatgaaagatttcaaatcctctggaagccaaaatgggacacagtaaacagattcgaattttacttctgaacgaaatggagaaactggaaaagaccctcttcagacttgaacaagaaactgggtctcactatgttgcccaggttgatattgaactcctggactcaagcaaccctccctctttggcctctgaaagtactgggattacaagcataagccaccgggcatggccccacttctgagcattaatttatttattgggtatgagctacagttccgattaggcccaactttacagggaaaagcagttaccgtgtatacaaattacccatttcctggagaaacatttaatagagaaaaattccgttctctggattgggaaaatccaacagaaagagaagatgattctgataaatactgtaaacttaatctgcaacaatctggttcatttcagtattatttccttcaaggaaatgagaaaagtggtggaggttacatagttgtggaccccattttacgtgttggtgctgataatcatgtgctacccttggactgtgttactcttcagacatttttagctaagtgtttgggaccttttgatgaatgggaaagcagacttagggttgcaaaagaatcaggctacaacatgattcattttaccccattgcagactcttggactatctaggtcatgctactcccttgccaatcagttagaattaaatcctgacttttcaagacctaatagaaagtatacctggaatgatgttggacagctagtggaaaaattaaaaaaggaatggaatgttatttgtattactgatgttgtctacaatcatactgctgctaatagtaaatggatccaggaacatccagaatgtgcctataatcttgtgaattctccacacttaaaacctgcctgggtcttagacagagcactttggcgtttctcctgtgatgttgcagaagggaaatacaaagaaaagggaatacctgctttgattgaaaatgatcaccatatgaattccatccgaaaaataatttgggaggatatttttccaaagcttaaactctgggaatttttccaagtagatgtcaacaaagcggttgagcaatttagaagacttcttacacaagaaaataggcgagtaaccaagtctgatccaaaccaacaccttacgattattcaagatcctgaatacagacggtttggctgtactgtagatatgaacattgcactaacgactttcataccacatgacaaggggccagcagcaattgaagaatgctgtaattggtttcataaaagaatggaggaattaaattcagagaagcatcgactcattaactatcatcaggaacaggcagttaattgccttttgggaaatgtgttttatgaacgactggctggccatggtccaaaactaggacctgtcactagaaagcatcctttagttaccaggtattttactttcccatttgaagagatagacttctccatggaagaatctatgattcatctgccaaataaagcttgttttctgatggcacacaatggatgggtaatgggagatgatcctcttcgaaactttgctgaaccgggttcagaagtttacctaaggagagaacttatttgctggggagacagtgttaaattacgctatgggaataaaccagaggactgtccttatctctgggcacacatgaaaaaatacactgaaataactgcaacttatttccagggagtacgtcttgataactgccactcaacacctcttcacgtagctgagtacatgttggatgctgctaggaatttgcaacccaatttatatgtagtagctgaactgttcacaggaagtgaagatctggacaatgtctttgttactagactgggcattagttccttaataagagaggcaatgagtgcatataatagtcatgaagagggcagattagtttaccgatatggaggagaacctgttggatcctttgttcagccctgtttgaggcctttaatgccagctattgcacatgccctgtttatggatattacgcatgataatgagtgtcctattgtgcatagatcagcgtatgatgctcttccaagtactacaattgtttctatggcatgttgtgctagtggaagtacaagaggctatgatgaattagtgcctcatcagatttcagtggtttctgaagaacggttttacactaagtggaatcctgaagcattgccttcaaacacaggtgaagttaatttccaaagcggcattattgcagccaggtgtgctatcagtaaacttcatcaggagcttggagccaagggttttattcaggtgtatgtggatcaagttgatgaagacatagtggcagtaacaagacactcacctagcatccatcagtctgttgtggctgtatctagaactgctttcaggaatcccaagacttcattttacagcaaggaagtgcctcaaatgtgcatccctggcaaaattgaagaagtagttcttgaagctagaactattgagagaaacacgaaaccttataggaaggatgagaattcaatcaatggaacaccagatatcacagtagaaattagagaacatattcagcttaatgaaagtaaaattgttaaacaagctggagttgccacaaaagggcccaatgaatatattcaagaaatagaatttgaaaacttgtctccaggaagtgttattatattcagagttagtcttgatccacatgcacaagtcgctgttggaattcttcgaaatcatctgacacaattcagtcctcactttaaatctggcagcctagctgttgacaatgcagatcctatattaaaaattccttttgcttctcttgcctccagattaactttggctgagctaaatcagatcctttaccgatgtgaatcagaagaaaaggaagatggtggagggtgctatgacataccaaactggtcagcccttaaatatgcaggtcttcaaggtttaatgtctgtattggcagaaataagaccaaagaatgacttggggcatcctttttgtaataatttgagatctggagattggatgattgactatgtcagtaaccggcttatttcacgatcaggaactattgctgaagttggtaaatggttgcaggctatgttcttctacctgaagcagatcccacgttaccttatcccatgttactttgatgctatattaattggtgcatataccactcttctggatacagcatggaagcagatgtcaagctttgttcagaatggttcaacctttgtgaaacacctttcattgggttcagttcaactgtgtggagtaggaaaattcccttccctgccaattctttcacctgccctaatggatgtaccttataggttaaatgagatcacaaaagaaaaggagcaatgttgtgtttctctagctgcaggcttacctcatttttcttctggtattttccgctgctggggaagggatacttttattgcacttagaggtatactgctgattactggacgctatgtagaagccaggaatattattttagcatttgcgggtaccctgaggcatggtctcattcctaatctactgggtgaagggatttatgccagatacaattgtcgggatgctgtgtggtggtggctgcagtgtatccaggattactgtaaaatggttccaaatggtctagacattctcaagtgcccagtttccagaatgtatcctacagatgattctgctcctttgcctgctggcacactggatcagccattgtttgaagtcatacaggaagcaatgcaaaaacacatgcagggcatacagttccgagaaaggaatgctggtccccagatagatcgaaacatgaaggacgaaggttttaatataactgcaggagttgatgaagaaacaggatttgtttatggaggaaatcgtttcaattgtggcacatggatggataaaatgggagaaagtgacagagctagaaacagaggaatcccagccacaccaagagatgggtctgctgtggaaattgtgggcctgagtaaatctgctgttcgctggttgctggaattatccaaaaaaaatattttcccttatcatgaagtcacagtaaaaagacatggaaaggctataaaggtctcatatgatgagtggaacagaaaaatacaagacaactttgaaaagctatttcatgtttccgaagacccttcagatttaaatgaaaagcatccaaatctggttcacaaacgtggcatatacaaagatagttatggagcttcaagtccttggtgtgactatcagctcaggcctaattttaccatagcaatggttgtggcccctgagctctttactacagaaaaagcagggaaagctttggagattgcagaaaaaaaattgcttggtccccttggcatgaaaactttagatccagatgatatggtttactgtggaatttatgacaatgcattagacaatgacaactacaatcttgctaaaggtttcaattatcaccaaggacctgagtggctgtggcctattgggtattttcttcgtgcaaaattatatttttccagattgatgggcccggagactactgcaaagactatagttttggttaaaaatgttctttcccgacattatgttcatcttgagagatccccttggaaaggacttccagaactgaccaatgagaatgcccagtactgtcctttcagctgtgaaacacaagcctggtcaattgctactattcttgagacactttatgatttatagtttattacagatattaagtatgcaattactgtattataggatgcaaggtcatcatatgtaaatgctatatgcacaggctcaagttgttttaaaaatctcatttattataatattgatgctcaattaggtaagattgtaaaagcattgattttttttaatgtacagaggtagatttcaatttgaatcagaaagaaatatcattaccaatgaaatgtgtttgagttcagtaagaattattcaaatgcctagaaatccatagtttggaaaataaaaatcatgtcatcttctatttgtacagaaatgaaaataaaatatgaaaataatgaaagaaatgaaaagatagcttttaattgtggtatatataatcttcagtaacaatacatactgaatacgctgtggttcattaatattaacaccacgtactatagtattcttagaatacagtgctcactgcatttaataaatatttaataaatgatgaatgatagaagtttccatctacaatatatgttcctaaatggagcacagatgttcaaactatgctttcattttttcactgatatattaatttttgtgtaatgaatgccaacagtatattttatatgatttacttatgtgaggaaacatgcaaagcattaggaaatttatttcctaaaaacagttttgtaaaattagtattgagttctattgagtattataagatagcttacattttcaaaatggaaattgtcggtcatatttctagaactttaaagaaaaaagaatgttatattagttttctaaaactcaactatctttagtcatgttcaaaaatctattgctagatcatagtagatactggttttctattaactcaaaacctacattgacaagtttaacattgagaagaatcttaacaaaaatatggatatgaattcagtagatatcttaaattcaataaaatcactggaagtttttcatgataacttattttaagatgccttaaaaatcttaaagtcacaaaaggaaaaaggtttttaacatttacatgagttaacattttttcatagaacttatttcctagatagaattttttactgttttttactgttttcttaagaaaacagttaaatcattatgcattcagttggaagaaagtagtggcaagaattctttcattgctatataatattcagtggctcatttatacctaataaaataatggtattttaaaataatgctactttcaaagtagcatttttttagttagtttacaggttacatacccaaaaccttaactatgactaagaaattaaagaagaaaaccagcaaactaaaacttctgggcagcaaaaatatataaatgcttcagatgtcaaatacccatgcttgaaagctcgtgtaatttactttaagattatctgcctgctcttcttcaaagctgaccttgctttagaaatagttttaactagcttagttttctggtttccaaaactaaaatagattaaatcctacaaatttaaggacagttgtgacagtaatctgaccactatctataaatacattggacattggtttccaaatctccctttctcttcagttccttccttgttcaatatatacccttctctaaactgtgcgggtaaaaggaatgactgtccttgagagaaccattagtttatcaaaggtttatgtagttttgttgctgtaccctaactttgatattcagggaggtaggaaaggtaacagaaaaccagcatatttaatcaaagcaagaagtaatcgctgacagttaaatgtgaccaaaaaaattaaaagttcacaatttttttaatgtagccatttggggttatctctagtaaggcagatacccacgttggtaaatttttaggatattgtgttgcactagaaaactaagtggttcatatttctaatgaggaagattaatgaaagaacattgttatattctgcgtggtatattttaaagtttaagaaggcatgttaaacattatttcctctatggtagttaaaatacagaattagatttttaacaggtgtcatttgactaaacgtttcggtagaatgcttcatacttgagtgatgctggataaggtattgtatttcaacaatggactatgccttggtttttcactaatcaaaatcaaaattactctttaacatgataaatgaatttaccagtttagtatgctgtggtattttaataagttttcaaagataattgggaaaacatgagactggtcatattgatgaatattgtaacatgtgaattgtgatccatttctgatatgtcttgaactactgtgtctagtaggcaaatgtcattgttacctctgtgtgttaagaaaataaaaatattttctaaaggtcg

SEQ ID NO: 58075 - DNA, 2341 bp, Homo sapiens
ttttatagtgtcagtcagtcaccccacagtctcctctctcttcttttctactgtgctatcctagaatcaaggatttcagcaacaatgcctctgttcaaactcccagctgaagagaaacaaattgatgatgcaatgcgcaactttgctgaaaaagtgtttgcctctgaagtcaaagatgaaggaggtcgtcaggagatttccccctttgatgtggatgagatctgtccgatttctcatcatgagatgcaagcacacatattccatctggagactctgtccacctccacagaagccaggagaaaaaagcgtttccaaggacggaagactgttaatttgtccattccactaagtgaaacatcttccaccaaactgtcccacattgatgaatacatttcctcatctccaacctaccagaccgtgcctgattttcagagagtgcagattactggtgactatgcctctggggttacagttgaagattttgaaattgtttgcaaaggtctgtatcgggcactatgcatacgtgagaaatacatgcagaagtcgtttcagaggttccctaaaaccccttccaaatacttgcggaacattgatggtgaggcttgggtagcaaatgagagcttctatccagtctttactcctcctgtgaagaagggagaggaccccttccgaacagacaaccttcctgaaaacctgggctatcacctcaaaatgaaggacggtgtagtttacgtctatcctaatgaagcagcagtcagcaaagatgagcctaagccacttccttacccaaatctggacaccttcttagacgatatgaattttttacttgctttaattgctcaaggacctgttaagacctatacccaccggcgcctgaagttcctctcctccaagttccaggtccatcagatgcttaacgagatggacgagttaaaggagctgaaaaacaacccccaccgagatttttataactgcaggaaggtggacacccatatccatgcagccgcttgcatgaaccagaaacatctgctgcgttttattaagaaatcttaccaaattgatgctgacagagtggtctatagcaccaaagagaagaatctgaccctaaaggaactttttgctaaattaaaaatgcatccttatgacctgactgttgattctctggatgttcatgctggacgccagaccttccagcgttttgataagttcaatgacaaatataatcctgtaggagcaagtgagctacgggacctctacttgaagacagacaattacattaatggggaatattttgccactatcatcaaggaggtaggtgcggacctggtggaggccaagtaccagcatgctgagccccgcctgtccatctatggccgcagtcctgatgagtggagcaaactctcctcctggttcgtctgcaatcgcatccactgccccaacatgacatggatgatccaggttcccaggatctatgatgtgttccgttccaagaatttccttccacattttggaaaaatgctggagaatattttcatgccagtgtttgaggccaccatcaacccccaggctgacccagaactcagtgtcttcctcaagcatatcactggctttgacagtgtggatgatgagtccaaacacagtggccacatgttctcctccaagagtcccaagccccaggagtggacattggaaaagaatccatcttacacttactatgcctactacatgtatgcaaacatcatggtgctcaacagcctgagaaaggaacgaggcatgaatacgtttctgttccgacctcactgtggagaagctggagccctcacccatctcatgacagcattcatgatagcagatgatatctctcatggcctaaatttaaaaaagagtcccgtgctacagtacttgtttttcttagcccaaattcccatcgccatgtcaccactaagtaacaatagcctatttctagagtatgccaaaaatccttttttggatttccttcagaaagggctaatgatctcactgtctacagatgacccaatgcaattccactttaccaaggagcccctaatggaagaatatgctattgctgcacaagtcttcaagctgagcacctgtgatatgtgcgaagtggcaaggaacagtgtcttgcagtgtggaatttctcatgaggagaaagtaaagtttctgggcgacaattaccttgaggaaggccctgctggaaatgatatccggaggacaaatgtagcccaaatccgcatggcctatcgctatgaaacctggtgttatgaactcaatttaattgctgagggtcttaaatcaacagaataaaaaaaagtaaacc

SEQ ID NO: 58076 - DNA, 2181 bp, Homo sapiens
actggggggtgtgaggaacaggggggaccatggacttcatcagcattcagcagttggtaagtggagaaagagttgaagggaaagtgttgggatttggacatggagttcctgaccctggagcctggcctagtgactggaggaggggcccccaagaggctgtggcccgggagaagctgaaattggaagaagagaagaagaagaaacttgaaagatttaacagtaccagatttaatctggataacctggctgacttggaaaacttggttcaaagacggaaaaagcgactgagacacagagtcccccccaggaaacctgagcccctggttaagccgcagtcccaggcccaggtggagcctgtgggcctggagatgttcctgaaggcagctgctgagaaccaggagtacctgattgacaagtacttgacagacggaggggaccccaatgcccatgacaagctccaccgcaccgccttgcactgggcctgtctgaagggtcacagccagctggtgaacaagctgctggtggcaggtgccacagtggacgcgcgagacttgctggacaggacacctgtgttctgggcctgccgcggaggacatctggtcatcctcaaacagctgcttaaccagggagcccgggtcaatgcccgggacaagatcgggagcacccccctgcacgtggcagtgcgcacccggcaccccgactgcctggagcacctcatcgagtgtggcgcccacctgaacgcacaggataaggaaggggacacggctctgcacgaggccgtgcggcacggcagctacaaagccatgaagctactgctgctctatggggccgagctgggggtgcggaacgcggcctccgtgaccccggtgcagctggctcgagactggcagcgcggcatccgggaggccctgcaggcccacgtggcgcatccccgcacccggtgctgaccgcagcaccgccccccgccgcgcctttcgcactgccaccattccatcctgtgccccgcccccgcgtctgcacctctgtggttcctgccctcagccctggttcctccctctctggcctgtgccgcctcagcagccctggcagaactgaagagcggcaccgggcccagcaggcaaagagagaggcctccctggcttcgagtgtcaggggagccgcgttccctcccagggctggagcagaggaccacaaggcagcagaaagcgcgggtccagatgagggccaggaaggggaggagagtgagggccaagaacgagccttaagggagcagtcccaagctggagccacccagggctgggtctgggagtcctcagtgtccacttgtcccaggttagggggcttgccttgctctctccagggccagtctgtgtgtgtggggactcagcccgtggccggcagatgccatccaggatgtacaaggtgcagccaaggcaggccatgcaggggccgggcctgtctgcagctggtggatgcctgtgggcatggctttctctggggaccccattcctgtcagtagcaaccctggcagtgtccggagcggctctagacaactttggtcataggaactctggaggtgggttctggtcatctgaggtggctactcaacaggtttgaggccccacagcaacagaagtccaggacccactaggttgcctcagaagccctaagactgatgagctggagcgcgcatttgagagaagcctcgcacccactgtgtactggccccgctcaggccggcctggcacaccgttgcctgctggcggctctcatggggaagcgcctgggcactggggattgcttgtggcccactcaactcttggggcagtggcccgtaaccctagtttgcctgaggcccttatgtccccttatgttcctggtactggagcttgagctcttgcctggaacgctgcagctgcacccaccctgcttgatcccacctgggaggccaggacactgaggagctctgaacccagcccacagggaagcagaggaagctcctgccctgtggcgacagccagcgtgcacccagacgctggtgccatggcgaagcaggcgttcaagaccatggagaagacaactcctcatctagaaaatgaggacacctcagtgacaaacacacctttttataccaatcagtatcctctgttcattaaaactggctatccattaaaaaaaaaa

SEQ ID NO: 58077 - DNA, 1195 bp, Homo sapiens
ctgccgccagggcctggcccagacctgcctgcctctctcctctccctcagtgactcctgagccacagcccctccatggcccagaaggaagaggctgctgtggccactgaggctgcctcccagaatggggaggatctggagaacctggacgaccctgagaagctgaaagagctgattgagctgccgccctttgagattgtcacaggagaacggctgcctgccaacttctttaaattccagttccggaatgtggagtacagttccgggaggaacaagaccttcctctgctatgtggttgaagcacagggcaaggggggccaagtgcaggcatctcggggatacctagaggatgagcatgcggctgcccatgcagaggaagctttcttcaacaccatcctgccagccttcgacccagccctgcggtacaatgtcacctggtatgtgtcctccagcccctgtgcagcgtgtgctgaccgcattatcaaaacccttagcaagaccaagaacctgcgtctgctcattctggtgggtcgactcttcatgtgggaggagccggagatccaggctgctctgaagaagctgaaggaggctggctgtaaactgcgcatcatgaagccccaggacttcgaatatgtctggcagaattttgtggagcaagaagagggtgaatccaaggcctttcagccctgggaggacattcaggagaacttcctatactacgaggagaagttggcagacatcctgaagtagggcaactgggctttgcctcacgtattcctgctgccaccaagagacagcaatgacatgtacagccatctgggacatgcctgtcttcctaataccatttggagctggacaacatttgacaccaaccaatcatactggacaaggcccttagaggacttgaaatatacttctcatgctgtagtttatttaggctgtgactctctctctaatgctgctctcgggaaggacgaaagtgacctgcaaggagagaaatgcaaccatacatgggctccagtcaactatgggactgaaggtcctaattgctcacccaagggggctgcttaacacaaacagcctcagacccgaggtttagatttctgaaatatgcattttatgttaagttgggtatttttttaaaaaaagaaaaacagcaacattaataaaagaagtggtgtgtttttaaaaaaaaa

SEQ ID NO: 58078 - DNA, 1069 bp, Homo sapiens
atgaacctcatggacatcaccaagatcttctccctcctgcagcccgacaaggaggaggaggacactgacacagaggagaagcaggctctcaatcaagcagtgtatgacaacgactcctatactttggaccagcttttgcgccaggagcgttacaaacgtttcatcaacagcaggagtggctggggtgttcctgggacacccttgcgcttggctgcttcttatggccacttgagctgtttgcaagtcctcttagcccatggtgctgatgttgacagcttggatgtcaaggcacagacgccacttttcactgctgtcagtcatggccatctggactgtgtacgtgtgcttttggaagctggtgcctctcctggtggtagcatctacaacaactgttctcccgtgctcacagctgcccgtgatggtgctgttgctatcctgcaggagctcctagaccatggtgcagaggccaacgtcaaagctaaactaccagtctgggcatcaaacatagcttcatgttctggccccctctatttggccgcagtctacgggcacctggactgtttccgcctgcttttgctccacggggcagaccctgactacaactgcactgaccagggcctattggctcgtgtcccaagaccccgcaccctccttgaaatctgcctccatcataattgtgagccagagtatatccagctgttaatcgattttggtgctaatatctaccttccatctctctcccttgacctgacctcacaagatgataaaggcattgcattgctgctacaggcccgagccactccacggtcacttctatcacaggtccgtttagtcgtccgcagagccttgtgccaggctggccagccacaagccatcaaccagctggatattcctcccatgttgattagctacctaaaacaccaactgtaatcttgcagtctccccaggaacttatgatgcctccgaaaaccacctggggactcacgtagctggagagcattacagcctcatccacttacctggagctgctctcctgtattatcctccacaataaaattctccagaaaat

SEQ ID NO: 58079 - DNA, 1229 bp, Homo sapiens
gacccgaggggggcccccacgcccgctctggcctctcaggtcaggccctcccctcccctcccctcccctcccccgcccctgtgtctccgcgagccggctgtgtgcctgcgagagcgtgcacacccgcgggaccttcccttttgttccaccctgacctctaccttctctaccttgtgctgaccccgctggggtgcaggggttcccttcggaggaggccggggctcaaggtgtgcagctcggccgcctctccctaactctgcaccagcgccttctctctctctctctctctctctctctctctctctctctctctctctctctctctctcaagatctccctcctgctaagtctgcgctgctgcaggagggctgggggaagggcaggggtgtggagagggggtgcctggtgtcttctttctctctctgcccccaccaagtgcggacgcatcgagcttcggcccccacccctgcattcgcgattggctcccggaggaggtggctggtgctgccgccgctgcagcatctcctagggagccgcgaccctgcgcccgccgccgctgccgctgtcaccagcccggccccaggggtgccctgggctccgcggctgaggcacctagggagttgcccccctagtggacggcctctcaggagatcctgaccaccctctgggaacctggactcctccaagcatcgtctttctcgcctgcatcttcggagagaggtgctgagcccttcctcatggatacggggtcccgggaggcagccttcaccagggacctgcccaggaaaccagcagatgcccagctgtagctgtgcattgatggcgccgtgcggcccggccgcaggtcccgcagccgtggagaggacccagcaggtggcgcggggagagcccggctcggcacgtggtcagctccaagtcagccctgaaatgtccattactcacaaagaaaaggaaaatgctcatttgaaagaaattcttctctttgtcaatgctgaggcattctctcagccccagccccacagtgctccagtgtgtgaagggcaacagctgacggggaagttcagcacatctgtgctgaccagggctggaggcgatgccagtccgtgcagctgggaacgcctcctctgctatggctggagccactgctgaagggactccacctggcacctatgccaccaatggcccctgaacgggtatctaggcccacccttaataaagatgagctgctc

SEQ ID NO: 58080 - DNA, 1835 bp, Homo sapiens
aatgtagactgagcgctcctgctactgctgcctgttgctgagaggaagaccgcagaaaattctggattcaaacatttattgctttttttgttttgctttgtttttgttttctttccttttgccttcagaagatgaacaatgaaaccacaaccctgatatccttgaaggaggcaatgaaaaggttgctgagggctatagggagggagcaagcatgggtctgctattctgggaagatggagtagaccacaaactccaagcgttagaaacacagttcaaagaactagacttcaccaaggataacctgatgcagaaattcgaacatcatagtaaggctttggcaagccaagcagcccaagatgagatgtggacagcagttcgggcactccagctcacttcaatggaattgaatattttatacagctacgtcattgaagtacttatctgcttgcatactcgtgtgcttgagaagctgccagacctggtgagaggtcttccaaccttagcctctgtactcagaagaaaagttaagaacaagcgcgttagagttgtatgggagtccatactggaggagtgtgggctgcaagaaggagacatcacagcactttgtaccttctttattgcacgtggtaacaaggcagaacactatactgctaaagtgaggcagatgtacatcagggatgtcacgttcctaattactaacatggtaaagaaccaggctctgcaggacagtttgctgagggctgtgcaggtaattgagaaggggaaagcagttaggacccctgaaaagcaaaagtcatccctcgaagagttgataccatctgtcaaaaactaacctgttaccctatgacccagtgattccacctacagtaatttatcttggaaacagcaaaaagtatgcacaatttattatagtcttatttttatagcaaagagtgagaggatgttaaataaattatgacaaattgatacaatagatactttctttgcagccatataaaagaatgaagaagctctttgtgtaatgatatgaagtgatcaccaaatgtattgttgttttcaaatgtttatttccaatatacattgctaagtggaaaaaaggtgacaaatatatatatataaatatatatataacacatattagtttacatatccataaacttcttctgcagagatacacaagacagtgataacattagttgtcaggaaagaaagctaagaggctaggggtcaaagacaagaggaagtcttttcactgttaatccattttttacattttcaattttgaaccatgtgaatgtattacctatttaaaaaataaacaaggccggacatggtggctcatgcctataatccaagcaccttaggaggccaaggtaggaggatcacttgagctcaggggtttcagaccagcctgggcaacacagtgatagcaataggaggcaggtaaattcctaggcagacagggaggggtccctggtgaaactcaaccttcaagccaaggacagtctaaagcctgaaaaccaagctatgagttctggataaatccatgagccagactgagagctcccattctcgtctggcaccctctctcctgattggtccttacccttcacctattttatacatacctacccttccgcgattggtcctctacactatcgtgcctatttctgaatggtgctttgtcaagcatagccacagaccaatcagcatgcacttgcccatttctagcccacaaaaacccatagactcaggctcgtggccagcaacccaccttcgggtcccctctcactgccaagagccgttctgtcactcaataaattctactttgcctt

SEQ ID NO: 58081 - DNA, 1800 bp, Homo sapiens
ctgagtgacctttcaggcagaatgtagactgagcgctcctgctactgctgcctgttgctgagaggaagaccgcagaaaattctggattcaaacatttattgctttttttgttttgctttgtttttgttttctttccttttgccttcagaagatgaacaatgaaaccacaaccctgatatccttgaaggaggcaatgaaaagagtagaccacaaactccaagcgttagaaacacagttcaaagaactagacttcaccaaggataacctgatgcagaaattcgaacatcatagtaaggctttggcaagccaagcagcccaagatgagatgtggacagcagttcgggcactccagctcacttcaatggaattgaatattttatacagctacgtcattgaagtacttatctgcttgcatactcgtgtgcttgagaagctgccagacctggtgagaggtcttccaaccttagcctctgtactcagaagaaaagttaagaacaagcgcgttagagttgtatgggagtccatactggaggagtgtgggctgcaagaaggagacatcacagcactttgtaccttctttattgcacgtggtaacaaggcagaacactatactgctaaagtgaggcagatgtacatcagggatgtcacgttcctaattactaacatggtaaagaaccaggctctgcaggacagtttgctgagggctgtgcaggtaattgagaaggggaaagcagttaggacccctgaaaagcaaaagtcatccctcgaagagttgataccatctgtcaaaaactaacctgttaccctatgacccagtgattccacctacagtaatttatcttggaaacagcaaaaagtatgcacaatttattatagtcttatttttatagcaaagagtgagaggatgttaaataaattatgacaaattgatacaatagatactttctttgcagccatataaaagaatgaagaagctctttgtgtaatgatatgaagtgatcaccaaatgtattgttgttttcaaatgtttatttccaatatacattgctaagtggaaaaaaggtgacaaatatatatatataaatatatatataacacatattagtttacatatccataaacttcttctgcagagatacacaagacagtgataacattagttgtcaggaaagaaagctaagaggctaggggtcaaagacaagaggaagtcttttcactgttaatccattttttacattttcaattttgaaccatgtgaatgtattacctatttaaaaaataaacaaggccggacatggtggctcatgcctataatccaagcaccttaggaggccaaggtaggaggatcacttgagctcaggggtttcagaccagcctgggcaacacagtgatagcaataggaggcaggtaaattcctaggcagacagggaggggtccctggtgaaactcaaccttcaagccaaggacagtctaaagcctgaaaaccaagctatgagttctggataaatccatgagccagactgagagctcccattctcgtctggcaccctctctcctgattggtccttacccttcacctattttatacatacctacccttccgcgattggtcctctacactatcgtgcctatttctgaatggtgctttgtcaagcatagccacagaccaatcagcatgcacttgcccatttctagcccacaaaaacccatagactcaggctcgtggccagcaacccaccttcgggtcccctctcactgccaagagccgttctgtcactcaataaattctactttgcctta

SEQ ID NO: 58082 - DNA, 1835 bp, Homo sapiens; identical to SEQ ID NO: 58080

SEQ ID NO: 58083 - DNA, 1800 bp, Homo sapiens; identical to SEQ ID NO: 58081

SEQ ID NO: 58084 - DNA, 2207 bp, Homo sapiens
tccggcgccccgcgccgcctccgctgcgggtcgggagcgcgcgtctccgccgcacctcggatctaggagctactcgcccggccctgggcggtgggaggcggcggcggcggcggcgctcgcgcacctcggaggagccaggagccggaaccagggccgagcccgcgggccggggctagccagccggtcggagatgtccgcccagaggttaatttctaacagaacctcccagcaatcggcatctaattctgattacacctgggaatatgaatattatgagattggaccagtttcctttgaaggactgaaggctcataaatattccattgtgattggattttgggttggtcttgcagtcttcgtgatttttatgtttattgtgctgaccttgctgaccaagacaggagccccacaccaagacaatgcagagtcctcagagaagagattcagaatgaacagctttgtgtcagactttggaagacctctggagccagataaagtattttctcgccaaggcaacgaggagtccaggtctctctttcactgctacatcaatgaggtggaacgcttggacagagccaaagcttgtcaccagaccacagcccttgacagtgacgtccaactccaggaagccatcagaagcagtgggcagccagaggaggagctgaacaggctcatgaagtttgacatccccaactttgtgaacacagaccagaactactttggggaggatgatcttctgatttctgaaccacctattgttctggaaactaagccactttcccagacctcacacaaagacctggattgagaaacatgctctgtaaagggtcttcctgaagatgtggattctatctttatgtagcaagaaatctacatccaccaaaattgtgtgtgtttgggggagagagagacatagagatagagacagagaggcagagaagagacccctttagaagagagctgagctgattaagctgagtggttttttgttttgttttgtttttgctttttaatacatttggagctttgggagtattaaagtatttacaccaagcttgtccaacccgtggcatgtgtcccaggacagctttgaatgtggcccaatacaaattttaaactttattaaaacatgagttttgtttttttttttgctattttttttaaagctcgtcagctatcgttagtgttagtgtactttatgtgtggcccaagacaactcttcttccagtgtggcacagggaagctaaaagattggacacctctgatttatactagctcgttttgcttgttgaaaaatttggccaaatacctattgtcagcattcttgggtgaggattagcctaccatgttctaatctggccctgccactactatgctctacctttggtgagttgctttacctctctgggctgccccatttttaactgtaggttgacaggtctagagtgatccatcccacctctaatattttgtgaatttatgactttgccttcagatgaggctgagctatacataaaacagtataaactagggtactgcctcgtatctcttgtaggctctctcaaatctctgtaccttccacttaaccctaattgagccaagctttagtcaggggatctggttgtctaccagaatgtcaggagactcatcttacacagtcatggtggccaatgtttctggtgggttgtgctgaaacagctcttctgagaacttccaaccacccatgctctaacctggagacagccatcccctgcctcagaataagtaccaattcgtagtacatgtatggtactcttgtccccaagaaatgttaggaagcttgtcagctgaatgagaggaggtgccttctgggtatctctgtgttggtgtatctgtgccattggctacagaacaagaaaaatactatttgccatgctattaccttggcagatgtgtaggtgatagtcatctggctttgagctgagatggtcagtgggttgtaaattccccactagcagatattcagggtggcctgagttatgtaaacaagtgagcaacacagctttaatttcatggaggaatcaaagctgcacactggtattaaaacaacttgattttgcgcacacagttgcatgcatggcaagctgttaacctctgggtggcattttcattatgaatttgttcaccacctgtcttgcttaagctacaaaataaatgcatttgactgc

SEQ ID NO: 58085 - DNA, 1292 bp, Homo sapiens
acctaccactggccctgcgtatgtggtgcagcctctcttcaatccctaagaactggttctttcaaagcatgtattttctgaagaaactttagaaccacgtttattttaaaagaacgaattggagaaaacaaatcgattaatgctcacagcttcttgggtgctttctcacgggtaaagccatggcatccgtaccttccattggttgccttctagccagaaatcagtattatcgaaagtccagtgtttcttcagttagttctttaactagctctgattctgttaacttcatagatgacgacaaaccacagcaagggttgcctgaagtggcagaatccacctggtggtttaaatcgtttttccattctgaacctgtgctttcaaatgtgagaataaaagatctgtctgctactggcatgaacagttgattctgacaatcaagatcctctgcctgctgcagtggtccatacatgaacagctccccttcagcgccccagctattccaggactcttctccattgtaagaagacagaaatgtgtctgagatctcatttatgagacaagatcacagcagccactgatataaaaaaagtttaggcatttttctcaacacaaagactatcgctggaagtggcacttgctacctggtgcatctttgaaaagtgtgcctttagaaacaagacacccttttaaagtaatatgtcttcaaatgttgtgacttacataaagtagctctttcattttttatatcatttttattaaaaaaacttaagttagactctttttctgtctgttgagtgatttatttattatgccttaaaactgacttgtcaatgtttcgcataatggtttaaagggcattgaattcgaaattttagaaaataattgtaaaaattcaatttttttaaaagaatgaaggttggaaatagcatatgtatcattaagtatattagagctaatcaattggtcattgtatagactttaaaatttatgactttaaataatatttaataacatggaaaattatattatggcattaaaaattagcataatacaccatatatggtacaatcgtagttgtattaaaaagttacatatgcataaagatagactggaaggaactgtaccaaaatgctgacagggctatttctggagatgggattatgggcgtttttcattctctttttaatatatttttccatatctcccaatttttctaatatgacaagtattgtgcgtaattagaaaataataaatgttaatacaaaaaaaaaaaaaaaaaaaaaaaaaaaaaa

SEQ ID NO: 58086 - DNA, 6160 bp, Homo sapiens
tcaggccggcagcggggagccgagtggaggctaattttacttgctgggagcgaggagagtaatcctcctgccccccactcctgccccgccccctggctggctcagcagggcagctcagccgacagcctcagccagcctagtccccaaggcgggggcattggggacacagggaagggaaagcactggggtgggggagcaggagaaagccagattcccagggaagccatggagccatcctcaccccaggatgaaggcctgaggaagaaacagcccaagaagccagttcctgagattctgccaaggccaccccgggctttgttctgcctgaccctggagaaccccctgaggaaggcctgcatcagcattgtagaatggaagcccttcgagacgatcatcttgctcaccatctttgccaattgtgtggccctggccgtgtacctgcccatgccggaagatgacaacaactctctgaacctcggcctggagaagctggagtatttcttcctcattgtcttctcgattgaagccgccatgaagatcattgcctacggcttcttattccaccaggacgcttacctgcgcagtggctggaatgtgctggacttcaccattgtcttcctgggggtcttcaccgtgattctggaacaggttaacgtcatccaaagccacacagccccaatgagcagcaaaggagccggcttggatgtcaaggccctcagagccttccgagtgctcagacccctccggctggtgtcgggggtgcctagcctgcaggtggtcctgaactccatcttcaaggccatgctccccctctttcacatcgccctgctggtcctctttatggtcatcatctatgccatcatcgggctggagctcttcaagggcaagatgcacaagacctgctacttcattggtacagatatcgtggccacggtggagaatgaagagccatcgccctgcgccaggacgggctcagggcgccggtgcaccatcaatggcagtgagtgccggggcggctgcccagggcccaaccatggcatcacccacttcgacaacttcggcttctccatgctcaccgtgtaccagtgcattaccatggagggatggactgacgtcctttactgggtcaatgatgccatcgggaatgagtggccctggatctattttgtcaccctcattttgctgggatccttcttcatcctcaacctggtgctgggtgtcctgagtggggaattcaccaaggagcgggagaaggccaagtccaggggaaccttccagaagctccgggagaagcagcaactagatgaggaccttcggggctacatgagctggatcacgcagggcgaggtcatggatgttgaggacttcagagaaggaaaactgtctttggatgaaggtggctctgacacagagagcctgtatgaaattgcaggcttgaacaaaatcatccagttcatccgacattggaggcagtggaaccgcatctttcgctggaagtgccatgacatcgtgaagtccaaggtcttctattggctggtgattctcatcgttgccctcaacaccctgtctatcgcctcagagcaccacaaccagccgcactggctgacccgtttgcaagacattgccaaccgggtgctgctgtccctcttcaccactgagatgctgatgaagatgtacgggctgggcctgcgccagtacttcatgtctatcttcaaccgcttcgactgcttcgtggtgtgcagcggtatcctggagatcctgctggtggagtcgggcgccatgacacccctgggcatctccgtgctccgctgcatccgcctcctgaggatcttcaagatcaccaaatattggacgtcgctgagcaacctggtggcatccctgctcaactccatccgctccatcgcctccctgctgctgctgctcttcctcttcatcgtcatcttccgcctcctgggcatgcagctctttggggggaggtatgactttgaagacacagaagtacggcgcagcaactttgacaactttccccaagccctcatcagcgtcttccaggtactgacaggggaagactggacctcaatgatgtacaatgggatcatggcctcgagcgggccgtcctaccctggcatgcttgtgtgcatttacttcatcatccttttcgtctgtggcaactacatcctgctcaatgtcttcctggccattgccgtggacaacctggccgaggcggagagcctgacttctgcccagaaggccaaggctgaggagaaaaaacgcaggaagatgtccaagggtctcccagacaagtcagaagaggagaagtcaacgatggccaagaagctggagcagaaacccaagggtgagggcatccccaccactgccaagctgaaaatcgatgagtttgaatctaatgtcaatgaggtgaaggatccctacccctcagccgacttcccaggggatgacgaggaagatgagcctgagatcccgctgagcccccgaccacgtcccctggctgagctgcagctgaaagagaaggccgtgcccattccagaagccagctccttcttcatcttcagccccaccaataagatccgtgtcctgtgtcaccgcatcgtcaatgccacctggttcaccaacttcatcctgctcttcatcctgctcagcagcgctgcactggctgcggaagaccccatccgggctgattccatgagaaatcagatccttaaacactttgacatcgggttcacctctgtcttcactgtggagattgtcctcaagatgacgacctacggagccttcctgcacaagggttccttctgccgcaattacttcaacatgctggacctgctggtggtggccgtgtccctcatctccatgggacttgagtccagtgccatctccgtggtgaagatcctgagggtgctgagggtgctccgaccactcagagccatcaacagagccaaggggttgaagcacgtggctaggtgcatgttcgtggccatcagcaccatcgggaacatcgtgctggtcactaccctcctacagttcatgtttgcctgcatcggcgtccagctcttcaaggggaagttcttcaggtgcaccgacttgtccaagatgacagaggaggagtgcaggggctactactacgtgtacaaggacggggaccccatgcagatagagctgcgtcaccgcgagtgggtacacagcgacttccacttcgacaatgtgctctcagccatgatgtccctcttcacggtctccaccttcgagggatggcctcagctgctgtacaaggccatagactccaatgcggaggacgtgggtcccatctacaacaaccgtgtggagatggccatcttcttcatcatctacatcatcctcattgccttcttcatgatgaacatctttgtgggcttcgtcattgtcaccttccaggagcagggagagactgagtacaagaactgtgagctggacaagaaccagcgccaatgtgtacagtatgccctgaaggcccgcccactgaggtgctacattcccaaaaacccataccagtaccaggtgtggtacattgtcacctcctcctactttgaatacctgatgtttgccctcatcatgctcaacaccatctgcctcggcatgcagcactacaaccagtcggagcagatgaaccacatctcagacatcctcaatgtggccttcactatcatcttcaccctggagatgatcctcaagctcatggccttcaaggccaggggctactttggaaacccctggaatgtgtttgacttcctgattgtcattggcagcatcattgatgtcatcctcagtgagatcgacactttcctggcctccagcgggggactgtattgcctgggtggaggctgcgggaacgttgacccagatgagagtgcccgcatctccagcgccttcttccgcctgttccgtgtcatgaggctgatcaagctgctgagccgggcagaaggagtgcgaaccctcctgtggacgttcatcaagtccttccaggccctaccctacgtggctctgctcatcgtcatgctcttcttcatctacgctgtcatcggcatgcagatgtttgggaagatcgccttggtggatgggacccaaataaaccggaacaacaacttccagaccttcccacaagctgtgctactgctcttcaggtgtgcaacaggtgaggcctggcaggagatcctactggcctgcagctatgggaagctgtgtgacccagagtcggactatgccccaggggaggagtacacatgtggcaccaactttgcatactactacttcatcagcttctacatgctctgtgccttcctggtcatcaacctctttgtggctgtcatcatggacaattttgactacctcacccgggactggtccatcctgggccctcatcacctggatgagttcaaggccatctgggcagagtatgacccagaggctaaggggaggatcaaacacctggacgtggtgaccctgctgagaaggattcagccccctctgggctttgggaagttctgcccacatcgggtagcttgtaagcggctggtgggcatgaacatgcccctgaacagcgacggcacagtcaccttcaatgccacactctttgccctggtccgcacggcactcaagatcaagacggaaggtaactttgagcaggccaacgaggagctgagggccatcatcaagaagatctggaagagaaccagcatgaagctcttggaccaggtcatccctccaataggagatgatgaggtgacagtggggaagttctacgccacattcctcatccaggagcacttccggaagttcatgaaacgccaagaggagtattatggctatcggcccaagaaggacattgtacagatccaggcagggctgcggaccattgaggaagaggcagcccccgagatctgtcgcacggtctcaggagacctggctgctgaggaggagctggagagagccatggtggaggctgcgatggaggaggggatattccggaggactggaggcctgtttggccaggtggacaacttcctggaaaggaccaactccctgccccctgtcatggccaatcagagacccctccagtttgctgagatagagatggaagagatggagtcacctgtcttcttggaggacttcccacaagatccacgcaccaaccccctggctcgtgccaataccaacaatgccaacgccaatgtcgcctatgcgaacagcaaccatagcaacagccatgtgttttccagtgtccactatgaaagggagttcccagaagagacagagacgcctgctaccagaggacgagcccttggccaaccctgcaggtccctgggaccccacagcaaaccctgtgtggagatgctgaagggactgctgacccagagggcaatgcccagaggccaggcacctcctgccccctgccagtgccccagggtggagtcctccatgcctgaggacagaaagagctccacaccagggtctcttcatgaggagacaccccacagcaggagcaccagggagaatacttccaggtgctcagcaccagctacagccctgctgatccaaaaggctctggttcgagggggcctgggcaccttggcagctgatgcaaacttcatcatggcaacaggccaggccctcggagatgcctgccaaatggaaccagaggaagtggagatcatggcaacagagctactgaaaggacgagaggccccagacggcatggccagctccctgggatgcctgaacctcgggtcctccctgggcagcctcgaccaacaccagggctcccaggagacccttattcctccaaggctgtgatgcccacacagcatcagcatgggcttagagctggcatgaccaatgggggtggggaagttgctggggtggagaagggctagcccaccgcagcagcctccctccctctcagcagctagatgcatgcctgaggcagggtggtcaggaaccacctcaaaaagtgcggaggaagtagctggacaggccctgcccctcaccagcaagaggcatgattggatggagcttctaatgtcattcaaaaaggcctggtcagtgcctgtccctagggccactcccacctgcaggacattaaaatctccaggcctgtgacactggc

SEQ ID NO: 58087 - DNA, 1847 bp, Homo sapiens
gagggaaggcaggaaggaggcagccgaaggccgagctgggtggctggaccgggtgctggctgcgccgcgctgctttcggctcccacggcctctcccatgcgctgagggagcccggctgggccgggccggcggcgggaggggaggctcctctccatggtccagaagaccagcatgtcccggggcccttacccaccctcccaggagatccccatggaggtcttcgaccccagcccgcagggcaaatacagcaagaggaaagggcgattcaaacggtcagatgggagcacgtcctcggataccacatccaacagctttgtccgccagggctcagcggagtcctacaccagccgtccatcagactctgatgtatctctggaggaggaccgggaagccttaaggaaggaagcagagcgccaggcattagcgcagctcgagaaggccaagaccaagccagtggcatttgctgtgcggacaaatgttggctacaatccgtctccaggggatgaggtgcctgtgcagggagtggccatcaccttcgagcccaaagacttcctgcacatcaaggagaaatacaataatgactggtggatcgggcggctggtgaaggagggctgtgaggttggcttcattcccagccccgtcaaactggacagccttcgcctgctgcaggaacagaagctgcgccagaaccgcctcggctccagcaaatcaggcgataactccagttccagtctgggagatgtggtgactggcacccgccgccccacaccccctgccagtggtaatgaaatgactaacttagcctttgaactagaccccctagagttagaggaggaagaggctgagcttggtgagcagagtggctctgccaagactagtgttagcagtgtcaccaccccgccaccccatggcaaacgcatccccttctttaagaagacagagcatgtgcccccctatgacgtggtgccttccatgaggcccatcatcctggtgggaccgtcgctcaagggctacgaggttacagacatgatgcagaaagctttatttgacttcttgaagcatcggtttgatggcaggatctccatcactcgtgtgacggcagatatttccctggctaagcgctcagttctcaacaaccccagcaaacacatcatcattgagcgctccaacacacgctccagcctggctgaggtgcagagtgaaatcgagcgaatcttcgagctggcccggacccttcagttggtcgctctggatgctgacaccatcaatcacccagcccagctgtccaagacctcgctggcccccatcattgtttacatcaagatcacctctcccaaggtacttcaaaggctcatcaagtcccgaggaaagtctcagtccaaacacctcaatgtccaaatagcggcctcggaaaagctggcacagtgcccccctgaaatgtttgacatcatcctggatgagaaccaattggaggatgcctgcgagcatctggcggagtacttggaagcctattggaaggccacacacccgcccagcagcacgccacccaatccgctgctgaaccgcaccatggctaccgcagccctggctgccagccctgcccctgtctccaacctccaggtacaggtgctcacctcgctcaggagaaacctcggcttctggggcgggctggagtcctcacagcggggcagtgtggtgccccaggagcaggaacatgccatgtagtgggcgccctgcccgtcttccctcctgctctggggtcggaactggagtgcagggaacatggaggaggaagggaagagctttattttgtaaaaaaataagatgagcggcaaaaaaaaaaaaaa

SEQ ID NO: 58088 - DNA, 1700 bp, Homo sapiens
gagggaaggcaggaaggaggcagccgaaggccgagctgggtggctggaccgggtgctggctgcgccgcgctgctttcggctcccacggcctctcccatgcgctgagggagcccggctgggccgggccggcggcgggaggggaggctcctctccatggtccagaagaccagcatgtcccggggcccttacccaccctcccaggagatccccatggaggtcttcgaccccagcccgcagggcaaatacagcaagaggaaagggcgattcaaacggtcagatgggagcacgtcctcggataccacatccaacagctttgtccgccagggctcagcggagtcctacaccagccgtccatcagactctgatgtatctctggaggaggaccgggaagccttaaggaaggaagcagagcgccaggcattagcgcagctcgagaaggccaagaccaagccagtggcatttgctgtgcggacaaatgttggctacaatccgtctccaggggatgaggtgcctgtgcagggagtggccatcaccttcgagcccaaagacttcctgcacatcaaggagaaatacaataatgactggtggatcgggcggctggtgaaggagggctgtgaggttggcttcattcccagccccgtcaaactggacagccttcgcctgctgcaggaacagaagctgcgccagaaccgcctcggctccagcaaatcaggcgataactccagttccagtctgggagatgtggtgactggcacccgccgccccacaccccctgccagtgccaaacagaagcagaagtcgacagagcatgtgcccccctatgacgtggtgccttccatgaggcccatcatcctggtgggaccgtcgctcaagggctacgaggttacagacatgatgcagaaagctttatttgacttcttgaagcatcggtttgatggcaggatctccatcactcgtgtgacggcagatatttccctggctaagcgctcagttctcaacaaccccagcaaacacatcatcattgagcgctccaacacacgctccagcctggctgaggtgcagagtgaaatcgagcgaatcttcgagctggcccggacccttcagttggtcgctctggatgctgacaccatcaatcacccagcccagctgtccaagacctcgctggcccccatcattgtttacatcaagatcacctctcccaaggtacttcaaaggctcatcaagtcccgaggaaagtctcagtccaaacacctcaatgtccaaatagcggcctcggaaaagctggcacagtgcccccctgaaatgtttgacatcatcctggatgagaaccaattggaggatgcctgcgagcatctggcggagtacttggaagcctattggaaggccacacacccgcccagcagcacgccacccaatccgctgctgaaccgcaccatggctaccgcagccctggctgccagccctgcccctgtctccaacctccaggtacaggtgctcacctcgctcaggagaaacctcggcttctggggcgggctggagtcctcacagcggggcagtgtggtgccccaggagcaggaacatgccatgtagtgggcgccctgcccgtcttccctcctgctctggggtcggaactggagtgcagggaacatggaggaggaagggaagagctttattttgtaaaaaaataagatgagcggcaa

SEQ ID NO: 58089 - DNA, 1266 bp, Homo sapiens
cggcttgtcacctgccctaggagacgcagccgccggaccctgcccagggcacccacgcctcggcgaccaccatgtcccagaccaaaatgctgaaggtccgcgtgaccctcttctgcatcctggcaggcatcgtgctggccatgacagccgtggtaaccgaccactgggctgtgctgagcccccacatggagcaccacaacactacctgcgaggcggcccacttcggcctctggcggatttgtaccaagcgcatccccatggacgacagcaagacctgcgggcccatcaccctgcccggggagaagaactgttcctacttcaggcattttaaccccggcgagagctcggagatcttcgaattcaccactcagaaggagtacagcatctcggcagccgccatcgccatcttcagccttggcttcatcatcctgggcagcctctgtgtcctcctgtccctcgggaagaagagggactatctgctgcgacccgcgtccatgttctatgcctttgcaggtctctgcatcctcgtctcggtggaggtcatgcggcagtcggtgaagcgcatgattgacagtgaggacaccgtctggatcgagtactattactcctggtcctttgcctgcgcctgtgccgccttcatcctcctctttctcggcggtctcgccctcctgctgttctccctgcctcgaatgccccggaacccatgggagtcctgcatggatgctgagcccgagcactaaccctcctgcggccctagcgaccctcaggcttcttccccaggaagcggggtcttggcctggaaccttccagagaggaggcgggagcaattttagccccaccctgctcccatctgcccccctgcaacagtcgcaggctgcttcctctctctgagttcctctgggctgccgcaggctcccctgggaatagagcaagacgtgagtcctaacctggccacagttgggggaggcagagccagcaggtggacaggtgtttgcaggggcccaacttcccctggagctcagaggtgtccccactgtaccagcctctgataagctgcctccagttgtcctttatgaacattgcagggacaacctgtgtttgccagctgggtgttccgtgtaaatagccagcctgtctctttctcggtgataaaacacaccctctctggtgagcccagcgtcccctccttggcttccaggagccctgggaagcatttttaactgggtagaatctgactgtggcttgaaataaaaagctctcagaaaa

SEQ ID NO: 58090 - DNA, 1673 bp, Homo sapiens
ccaagtcctctgttctcaaactctgagcccaagggaaccccggccacatctcctccaaacacacacaggacctcaggtcccttcctgggtaccccaaactcttagccctagtggggtgctcagatctctcaggaaaaccagtttcccttttgttaaccccccagcggggaccccaaagcagccccttggagctgcagggagcttcagcgggcaccagttctcattcctctggagctcttggggggactccctcctgggaagccgaattctatctctaaacctcagggtgggggccttgtttttcctctgggccccgtcttctttgccaagttcttgagggcaacctagaccctcctctgaaccccagaggcttccccagccctggggatcatttttctcttctgaaccccagaagcaatctcgactttcgcatttgagattccagacaggactcggctctccctctttcatacccaggggaaactgagtccctcacccccttcaagaccccaggccgctcctcgctcccgcccctcgaggcccttcgccggctctgcctcctcccccttcccgaccccaccggccataagatgatgtggtccaacttcttcctgcaagaggagaaccggcggcggggggccgcgggccggcggcgggcgcacgggcagggcaggtcggggctgacgcccgagcgcgaggggaaggtgaagctggcgctgctgctggccgccgtgggcgccacgctggcggtgctgtccgtgggcaccgagttctgggtggagctcaacacctacaaggccaacggcagcgccgtgtgcgaagcggcccacctggggctgtggaaggcgtgcaccaagcggctgtggcaggcggacgtgcccgtggacagggacacctgcggccccgcggagctgcccggaggcctgctgctcttggtgagcctggaggtgttccggcattccgtgagggccctgctgcagagagtcagcccggagcctcccccggccccacgcctcacctacgagtactcctggtccctgggctgcggcgtgggggccggcctgatcctgctgttgggggccggctgctttctgctgctcacactgccttcctggccctgggggtccctctgtcccaagcgggggcaccgggccacctagagccacgcgtgagacttctctaagcaaccaccgagccctttgaccttctccattgtacccccaagatctttttgccccatctcctagagaaactgtgttctccctgctcgggggcccatgtttttttacacgcctgcctcctgtccccttatcctttctccctctgtaaatacgtttttctctgtggctgtatgtgggttgcttgggggtgggatgggaagaggctctttgcaaacgagggtccccagagaagactggcggggacctgatggggtagctggggtgtggggttgggggatgaggtcagggggtcttgggtgggagttgggggccccttcatttcccaggtctggatcgattcacttgccgggagagactttttacaactcatctgcagctccgggtgcggttgggggagatagcgaagggtctggcctcgctgtgatctgatttgggattaaaggtttggaaatttaaaaaaaaaaaaaaaaaaaaaaaaaaaaaaaaaaaaaa

SEQ ID NO: 58091 - DNA, 1886 bp, Homo sapiens
ccaagtcctctgttctcaaactctgagcccaagggaaccccggccacatctcctccaaacacacacaggacctcaggtcccttcctgggtaccccaaactcttagccctagtggggtgctcagatctctcaggaaaaccagtttcccttttgttaaccccccagcggggaccccaaagcagccccttggagctgcagggagcttcagcgggcaccagttctcattcctctggagctcttggggggactccctcctgggaagccgaattctatctctaaacctcagggtgggggccttgtttttcctctgggccccgtcttctttgccaagttcttgagggcaacctagaccctcctctgaaccccagaggcttccccagccctggggatcatttttctcttctgaaccccagaagcaatctcgactttcgcatttgagattccagacaggactcggctctccctctttcatacccaggggaaactgagtccctcacccccttcaagaccccaggccgctcctcgctcccgcccctcgaggcccttcgccggctctgcctcctcccccttcccgaccccaccggccataagatgatgtggtccaacttcttcctgcaagaggagaaccggcggcggggggccgcgggccggcggcgggcgcacgggcagggcaggtcggggctgacgcccgagcgcgaggggaaggtgaagctggcgctgctgctggccgccgtgggcgccacgctggcggtgctgtccgtgggcaccgagttctgggtggagctcaacacctacaaggccaacggcagcgccgtgtgcgaagcggcccacctggggctgtggaaggcgtgcaccaagcggctgtggcaggcggacgtgcccgtggacagggacacctgcggccccgcggagctgcccggagaagcaaactgcacctattttaaattcttcaccacgggggagaatgcacgcatctttcagagaaccacaaagaaagaggtgaatctggcagctgcggtgatagcagtgctgggcctggcagtcatggccttggggtgcctctgtatcatcatggtgctcagtaaaggtgcagagttcctgctccgagttggagccgtctgctttggcctctcaggcctgctgctcttggtgagcctggaggtgttccggcattccgtgagggccctgctgcagagagtcagcccggagcctcccccggccccacgcctcacctacgagtactcctggtccctgggctgcggcgtgggggccggcctgatcctgctgttgggggccggctgctttctgctgctcacactgccttcctggccctgggggtccctctgtcccaagcgggggcaccgggccacctagagccacgcgtgagacttctctaagcaaccaccgagccctttgaccttctccattgtacccccaagatctttttgccccatctcctagagaaactgtgttctccctgctcgggggcccatgtttttttacacgcctgcctcctgtccccttatcctttctccctctgtaaatacgtttttctctgtggctgtatgtgggttgcttgggggtgggatgggaagaggctctttgcaaacgagggtccccagagaagactggcggggacctgatggggtagctggggtgtggggttgggggatgaggtcagggggtcttgggtgggagttgggggccccttcatttcccaggtctggatcgattcacttgccgggagagactttttacaactcatctgcagctccgggtgcggttgggggagatagcgaagggtctggcctcgctgtgatctgatttgggattaaaggtttggaaatttaaaaaaaaaaaaaaaaaaaaaaaaaaaaaaaaaaaaaa

SEQ ID NO: 58092 - DNA, 1748 bp, Homo sapiens
ccaagtcctctgttctcaaactctgagcccaagggaaccccggccacatctcctccaaacacacacaggacctcaggtcccttcctgggtaccccaaactcttagccctagtggggtgctcagatctctcaggaaaaccagtttcccttttgttaaccccccagcggggaccccaaagcagccccttggagctgcagggagcttcagcgggcaccagttctcattcctctggagctcttggggggactccctcctgggaagccgaattctatctctaaacctcagggtgggggccttgtttttcctctgggccccgtcttctttgccaagttcttgagggcaacctagaccctcctctgaaccccagaggcttccccagccctggggatcatttttctcttctgaaccccagaagcaatctcgactttcgcatttgagattccagacaggactcggctctccctctttcatacccaggggaaactgagtccctcacccccttcaagaccccaggccgctcctcgctcccgcccctcgaggcccttcgccggctctgcctcctcccccttcccgaccccaccggccataagatgatgtggtccaacttcttcctgcaagaggagaaccggcggcggggggccgcgggccggcggcgggcgcacgggcagggcaggtcggggctgacgcccgagcgcgaggggaaggtgaagctggcgctgctgctggccgccgtgggcgccacgctggcggtgctgtccgtgggcaccgagttctgggtggagctcaacacctacaaggccaacggcagcgccgtgtgcgaagcggcccacctggggctgtggaaggcgtgcaccaagcggctgtggcaggcggacgtgcccgtggacagggacacctgcggccccgcggagctgcccggagaagcaaactgcacctattttaaattcttcaccacgggggagaatgcacgcatctttcagagaaccacaaagaaaggcctgctgctcttggtgagcctggaggtgttccggcattccgtgagggccctgctgcagagagtcagcccggagcctcccccggccccacgcctcacctacgagtactcctggtccctgggctgcggcgtgggggccggcctgatcctgctgttgggggccggctgctttctgctgctcacactgccttcctggccctgggggtccctctgtcccaagcgggggcaccgggccacctagagccacgcgtgagacttctctaagcaaccaccgagccctttgaccttctccattgtacccccaagatctttttgccccatctcctagagaaactgtgttctccctgctcgggggcccatgtttttttacacgcctgcctcctgtccccttatcctttctccctctgtaaatacgtttttctctgtggctgtatgtgggttgcttgggggtgggatgggaagaggctctttgcaaacgagggtccccagagaagactggcggggacctgatggggtagctggggtgtggggttgggggatgaggtcagggggtcttgggtgggagttgggggccccttcatttcccaggtctggatcgattcacttgccgggagagactttttacaactcatctgcagctccgggtgcggttgggggagatagcgaagggtctggcctcgctgtgatctgatttgggattaaaggtttggaaatttaaaaaaaaaaaaaaaaaaaaaaaaaaaaaaaaaaaaaa

SEQ ID NO: 58093 - DNA, 1110 bp, Homo sapiens
ggtaattagacccagacagggagggctcagtgcgggtctgaggagggaacacacgtgtgcaggcgtgtgctccacggtggcatgttgatacggaccagcctgggcaccaggccccctcgggagccagctttgctgttctgagtggaagggagatcaggtttccctgagaaaccccaaaatagcccccaactgtgcctggcttccagcgggcagcccagcccccaggccctgttttgctccctttcccccttcacccccagcccatgtcctgctgtctcctccctgaatggtggaccctcagcccctcctgtacaagatggtcaagcggtgcctcatgcatttgttcattcgacctgtcctgagagtttgtgacatgctggcacggggccaatgttgagtccaccaggatgggagggtggccaggctctgagccactgagcaccagctggccaggatgggtcttcaacaagaaatctcactgcagccctggtgtcaccaccctgcagaatcctgtcagacaaccaccgacatgacagagcgcctgtcggctgagcagatcaaggagtacaagggagtctttgagatgttcgacgaagagggcaacggggaggtgaagacgggggagctggagtggctcatgagcctgctgggtatcaaccccaccaagagtgagctggcctcaatggccaaggatgtggacagagacaacaaagggttcttcaactgcgatggtttcctggcactaatgggagtttaccatgagaaggcccagaaccaggagagcgagctgagggcggcattccgtgtctttgacaaagagggcaagggctacattgactggaacacactcaagtacgtgctaatgaacgcaggggagcccctcaacgaggtggaggcggagcagatgatgaaggaggccgacaaggatggggacaggaccatcgactatgaggagtttgtggccatgatgacgggggagtccttcaagctgatccagtaggtgcagctgccgcagccgggggaggcctgcccgggaaggctgctgcccctgccccctggcccccactcccccggctccgtgtaaaataaatgttccagcccgaaaaaaaa

SEQ ID NO: 58094 - DNA, 1886 bp, Homo sapiens
ggctctgtcggcagtttctccaggacccagcagtgccctctgtccactgctctgggccattccccaatcccccctcccacttgagcccctaactcagaatctgggacccaggggcccctccctaccccagctaacctcttctggaccaggagagccaacccagatcccactacctccatgagtgctacagacaggatggggcccagagctgtgccgggtctgcggctggcactgctgttgctgctggtgctagggacacccaagtcaggggtacaggggcaggaagggctggacttccctgagtacgatggtgtggaccgtgtgatcaatgtcaatgcaaagaactacaagaatgtgttcaagaagtatgaggtgctggcactcctctaccatgaaccccccgaggatgacaaggcctcacaaagacaatttgagatggaggagctgatcctggagttagcagcccaagtcctagaagacaagggtgttggcttcgggctggtagactctgagaaggatgcagctgtggccaagaaactaggcctaactgaagtggacagcatgtatgtattcaagggagatgaagtcattgagtacgatggcgagttttctgctgacaccatcgtggagtttctgcttgatgtcctagaggaccctgtggaattgattgaaggtgaacgagagctgcaggcgtttgagaatattgaggatgagatcaaactcattggctacttcaagagcaaagactcagagcattacaaagccttcgaggatgcagctgaggagtttcatccctacatccccttcttcgccaccttcgacagcaaggtggcaaagaagctgaccctgaagctgaatgagattgatttctacgaggccttcatggaagagcctgtgaccatcccagacaagcccaatagcgaagaggagattgtcaacttcgtggaggagcacaggagatcaaccctgaggaaactgaagccggagagtatgtatgagacctgggaggatgatatggatggaatccacattgtggccttcgcagaggaagctgatcctgatggtttcgagttcttagagactctcaaggctgtggcccaagataacactgaaaacccagatcttagcatcatctggattgaccctgatgacttccccctgctggtcccatactgggagaagacgtttgacatcgacttgtcagccccacaaataggagtcgtcaatgttactgatgcggatagcgtatggatggaaatggacgatgaggaggacctgccttctgctgaggagctggaggactggctggaggatgtcctggagggcgagatcaacacagaggacgatgacgatgatgatgatgactagttgctatggcaaccatctttcagccccactggtcttttcatgctctctcctgccttcccttgtccttccctgagttcctccagggagactaggttattctctgccatagagctaactggggtctatatgctgggtgctgagacactgatccccctcatttgatgagcaaatgagctacttttccctagacaccaggccagctctctcttatctgacttctgtttcttatcccataacttacttgtatctattatgtgtctcttccatcactctccatactctttcttgtgattctcctctagccatatatatgggccccatctctgttctgttccctccatctatgcacagctttcccccactctctctaatcctgtatctttctgactgtcctgtccttggccagaaggaagggagaatactgtgtttgggactgtatctcagcaatcacttgttaatgtatttgggtcaaatgagaggcctcaataaagacatctggggcagcatgaaaaaaaaaa

SEQ ID NO: 58095 - DNA, 1965 bp, Homo sapiens
gtgccagtgagaagcacaggccaccactctgccctggtccacacaagctccggtagcccatggagccctggcctctcctcctgctctttagcctttgctcagctggcctcgtcctgggctccgaacatgagacccgtctggtggcaaagctatttaaagactacagcagcgtggtgcggccagtggaagaccaccgccaggtcgtggaggtcaccgtgggcctgcagctgatacagctcatcaatgtggatgaagtaaatcagatcgtgacaaccaatgtgcgtctgaaacagcaatgggtggattacaacctaaaatggaatccagatgactatggcggtgtgaaaaaaattcacattccttcagaaaagatctggcgcccagaccttgttctctataacaatgcagatggtgactttgctattgtcaagttcaccaaagtgctcctgcagtacactggccacatcacgtggacacctccagccatctttaaaagctactgtgagatcatcgtcacccactttccctttgatgaacagaactgcagcatgaagctgggcacctggacctacgacggctctgtcgtggccatcaacccggaaagcgaccagccagacctgagcaacttcatggagagcggggagtgggtgatcaaggagtcccggggctggaagcactccgtgacctattcctgctgccccgacaccccctacctggacatcacctaccacttcgtcatgcagcgcctgcccctctacttcatcgtcaacgtcatcatcccctgcctgctcttctccttcttaactggcctggtattctacctgcccacagactcaggggagaagatgactctgagcatctctgtcttactgtctttgactgtgttccttctggtcatcgtggagctgatcccctccacgtccagtgctgtgcccttgattggaaaatacatgctgttcaccatggtgttcgtcattgcctccatcatcatcactgtcatcgtcatcaacacacaccaccgctcacccagcacccatgtcatgcccaactgggtgcggaaggtttttatcgacactatcccaaatatcatgtttttctccacaatgaaaagaccatccagagaaaagcaagacaaaaagatttttacagaagacattgatatctctgacatttctggaaagccagggcctccacccatgggcttccactctcccctgatcaaacaccccgaggtgaaaagtgccatcgagggcatcaagtacatcgcagagaccatgaagtcagaccaggagtctaacaatgcggcggcagagtggaagtacgttgcaatggtgatggaccacatactcctcggagtcttcatgcttgtttgcatcatcggaaccctagccgtgtttgcaggtcgactcattgaattaaatcagcaaggatgagcagaaaatgagctgagcttagctctgccctggaacctaccagagcagagaagggcaggagaggaagatttgtctacttgctccactcgcacttatcaaacgtgttatattccatacttattattgatgataagatttacctttatgtaagtttatggccttgaagtgttttcatattgcttctccctttagttctgctgtctccctgaagagtgaaccctctttagtaaatgaaactaatcactaaaaaaagtgttcatttccagtgtctggaagagtttttgccaggataaccgaggttttctgttgcattgtcattgctgttatatttatatatttacttattttgtctaaccacgagaccactagggagttgctgatgttctaaatgaagtgtattctttgcttaagagtcagttttgtacctactaagaaaaccccatctaccagtcctaaagagataaggcatttgatttggagagagaggaagcagtagaaatgaaataaactaaaatgcaaactgcatcaaaaa

SEQ ID NO: 58096 - DNA, 2040 bp, Homo sapiens
gtgccagtgagaagcacaggccaccactctgccctggtccacacaagctccggtagcccatggagccctggcctctcctcctgctctttagcctttgctcagctggcctcgtcctgggctccgaacatgagacccgtctggtggcaaagctatttaaagactacagcagcgtggtgcggccagtggaagaccaccgccaggtcgtggaggtcaccgtgggcctgcagctgatacagctcatcaatgtggatgaagtaaatcagatcgtgacaaccaatgtgcgtctgaaacagggtgacatggtagatctgccacgccccagctgcgtgactttgggagttcctttgttttctcatctgcagaatgagcaatgggtggattacaacctaaaatggaatccagatgactatggcggtgtgaaaaaaattcacattccttcagaaaagatctggcgcccagaccttgttctctataacaatgcagatggtgactttgctattgtcaagttcaccaaagtgctcctgcagtacactggccacatcacgtggacacctccagccatctttaaaagctactgtgagatcatcgtcacccactttccctttgatgaacagaactgcagcatgaagctgggcacctggacctacgacggctctgtcgtggccatcaacccggaaagcgaccagccagacctgagcaacttcatggagagcggggagtgggtgatcaaggagtcccggggctggaagcactccgtgacctattcctgctgccccgacaccccctacctggacatcacctaccacttcgtcatgcagcgcctgcccctctacttcatcgtcaacgtcatcatcccctgcctgctcttctccttcttaactggcctggtattctacctgcccacagactcaggggagaagatgactctgagcatctctgtcttactgtctttgactgtgttccttctggtcatcgtggagctgatcccctccacgtccagtgctgtgcccttgattggaaaatacatgctgttcaccatggtgttcgtcattgcctccatcatcatcactgtcatcgtcatcaacacacaccaccgctcacccagcacccatgtcatgcccaactgggtgcggaaggtttttatcgacactatcccaaatatcatgtttttctccacaatgaaaagaccatccagagaaaagcaagacaaaaagatttttacagaagacattgatatctctgacatttctggaaagccagggcctccacccatgggcttccactctcccctgatcaaacaccccgaggtgaaaagtgccatcgagggcatcaagtacatcgcagagaccatgaagtcagaccaggagtctaacaatgcggcggcagagtggaagtacgttgcaatggtgatggaccacatactcctcggagtcttcatgcttgtttgcatcatcggaaccctagccgtgtttgcaggtcgactcattgaattaaatcagcaaggatgagcagaaaatgagctgagcttagctctgccctggaacctaccagagcagagaagggcaggagaggaagatttgtctacttgctccactcgcacttatcaaacgtgttatattccatacttattattgatgataagatttacctttatgtaagtttatggccttgaagtgttttcatattgcttctccctttagttctgctgtctccctgaagagtgaaccctctttagtaaatgaaactaatcactaaaaaaagtgttcatttccagtgtctggaagagtttttgccaggataaccgaggttttctgttgcattgtcattgctgttatatttatatatttacttattttgtctaaccacgagaccactagggagttgctgatgttctaaatgaagtgtattctttgcttaagagtcagttttgtacctactaagaaaaccccatctaccagtcctaaagagataaggcatttgatttggagagagaggaagcagtagaaatgaaataaactaaaatgcaaactgcatcaaaaa

SEQ ID NO: 58097 - DNA, 3093 bp, Homo sapiens
agcaagagcagaggcttaaggagctacactgggggaaggacaggggcaagcaggccaaggcctggccggggctcggggggagggaatatggagcaatcccggtcacagcagcgtgggggtgaacaaagctggtggggtagtgacccccagtaccagtatatgccctttgaacactgcaccagctacggactgccctctgagaatgggggcctccagcacaggctccggaaggatgcaggcccccgccacaacgtccaccccacacagatttatggccatcacaaagaacaattctcagacagggagcaggacatagggatgcccaagaagacaggctccagttctaccgtggacagcaaggatgaggatcactattctaaatgtcaagattgtatccaccgcctgggacaggtggtgagaagaaaattaggggaagactggatctttctggtgcttctgggactgctgatggctctggtcagctggagcatggactacgtcagtgccaaaagccttcaggcctacaagtggtcctacgcgcagatgcagcccagccttcctctgcagttcctggtctgggtcaccttcccactagtcctcatcctcttcagcgccctcttctgccacctcatctctccccaggctgttggctctggaatccccgaaatgaagacaatacttcgtggggttgtcctgaaggaatacctcacaatgaaagcctttgtggccaaggttgtcgccctgactgcgggcctgggcagtggcatccccgtggggaaagagggccccttcgtccacattgccagcatctgtgctgctgtcctcagcaaattcatgtctgtgttctgcggggtatatgagcagccatactactactctgatatcctgacggtgggctgtgctgtgggagtcggctgttgttttgggacaccacttggaggagtgctatttagcatcgaggtcacctccacctactttgctgttcggaactactggagaggattctttgcagccacgttcagcgcctttgtgtttcgagtgctggcagtgtggaacaaggatgctgtcaccatcactgctctgttcagaaccaatttccgaatggatttcccctttgacctgaaggaactaccagcttttgctgccatcgggatttgctgtgggctcctgggagctgtatttgtgtatctgcatcgccaagtcatgctcggtgtccgaaagcacaaggccctcagccagtttcttgctaagcaccgcctgctgtatcctggaattgttacctttgtcattgcctcattcaccttcccaccaggaatgggtcaattcatggctggagagttgatgccccgcgaagccatcagtactttgtttgacaacaatacatgggtgaaacacgcgggtgatcctgagagcctgggccagtcagctgtgtggattcacccccgggtcaacgttgtcatcatcatctttctcttcttcgtcatgaagttctggatgtccatcgtggccaccactatgcccataccctgcggaggcttcatgcctgtgtttgtgctaggagctgcatttggaaggctggtaggagaaatcatggccatgctctttcctgatggtattttgtttgatgacatcatctacaagatcctacctgggggctatgcagtaattggagcagcagcgctgactggtgccgtttcccacacagtctccacagctgtgatttgcttcgaattaacgggtcagattgctcacatcctgcccatgatggtggctgttatcttggccaacatggtggcccagagcctgcagccctctctctatgacagcatcatccaggtcaagaagctaccctacttgcctgaccttggctggaaccagctcagcaaatataccatctttgttgaggacatcatggtacgtgatgtgaagtttgtttcagcttcttacacatatggggagttgcgaaccctgctccagaccaccacagtcaagactttaccactggttgactcaaaagattcaatgatcctgctgggctcggtggagcggtcggaactgcaggccctcctgcagcgccacctgtgtcctgagcgcaggctgcgcgcagcccaagagatggcgcggaagttgtcggagctgccttacgacgggaaggcgcggctggctggggaggggccccccggcgcgcctccaggccggcccgagtccttcgcctttgtggatgaggatgaggacgaagatctctctggcaagagcgagcttcctccttcccttgctctccacccctctactactgcccctctgtccccagaagagcccaatgggcctctgcctggccacaaacagcagccggaagcaccagagcctgcaggtcaaagaccctccatcttccagtccctgcttcactgcttgctgggcagagctcgccccacaaagaagaaaacaacccaggattccacagatttagtggataacatgtcacctgaagagattgaggcctgggagcaggagcagctgagccagcctgtctgttttgattcctgctgtattgaccagtctcccttccagctggtggagcagacaaccctgcacaagactcataccctgttttcactccttggcctccacctcgcttacgtgaccagcatggggaagctcaggggcgtcctggccctggaggagctacagaaggccattgaggggcacaccaagtctggggtgcagctccgccctccccttgccagcttccggaacacgacttcaactcgaaagagtaccggggcacctccatcttctgcagagaactggaacctgcctgaggacaggcctggggccactggaacaggggatgtgattgctgcctccccagagacccctgtgccatctccttccccagagccccctctctccctggccccaggcaaggtagagggcgagttggaggagctggagctggtggagagtccagggctggaagaggagctggccgacatcttgcagggccccagcctgcgatccacagacgaggaggatgaggatgaactgatcctttgaccccctcccacgacctcctcataaagaccgtggagaggc

SEQ ID NO: 58098 - DNA, 4073 bp, Homo sapiens
gcagaggcggaggctcgcgtattcctgcagtcagcacccacgtcgcccccggacgctcggtgctcaggcccttcgcgagcggggctctccgtctgcggtcccttgtgaaggctctgggcggctgcagaggccggccgtccggtttggctcacctctcccaggaaacttcacactggagagccaaaaggagtggaagagcctgtcttggagattttcctggggaaatcctgaggtcattcattatgaagtgtaccgcgcgggagtggctcagagtaaccacagtgctgttcatggctagagcaattccagccatggtggttcccaatgccactttattggagaaacttttggaaaaatacatggatgaggatggtgagtggtggatagccaaacaacgagggaaaagggccatcacagacaatgacatgcagagtattttggaccttcataataaattacgaagtcaggtgtatccaacagcctctaatatggagtatatgacatgggatgtagagctggaaagatctgcagaatcctgggctgaaagttgcttgtgggaacatggacctgcaagcttgcttccatcaattggacagaatttgggagcacactggggaagatataggcccccgacgtttcatgtacaatcgtggtatgatgaagtgaaagactttagctacccatatgaacatgaatgcaacccatattgtccattcaggtgttctggccctgtatgtacacattatacacaggtcgtgtgggcaactagtaacagaatcggttgtgccattaatttgtgtcataacatgaacatctgggggcagatatggcccaaagctgtctacctggtgtgcaattactccccaaagggaaactggtggggccatgccccttacaaacatgggcggccctgttctgcttgcccacctagttttggagggggctgtagagaaaatctgtgctacaaagaagggtcagacaggtattatccccctcgagaagaggaaacaaatgaaatagaacgacagcagtcacaagtccatgacacccatgtccggacaagatcagatgatagtagcagaaatgaagtcataagcgcacagcaaatgtcccaaattgtttcttgtgaagtaagattaagagatcagtgcaaaggaacaacctgcaataggtacgaatgtcctgctggctgtttggatagtaaagctaaagttattggcagtgtacattatgaaatgcaatccagcatctgtagagctgcaattcattatggtataatagacaatgatggtggctgggtagatatcactagacaaggaagaaagcattatttcatcaagtccaatagaaatggtattcaaacaattggcaaatatcagtctgctaattccttcacagtctctaaagtaacagttcaggctgtgacttgtgaaacaactgtggaacagctctgtccatttcataagcctgcttcacattgcccaagagtatactgtcctcgtaactgtatgcaagcaaatccacattatgctcgtgtaattggaactcgagtttattctgatctgtccagtatctgcagagcagcagtacatgctggagtggttcgaaatcacggtggttatgttgatgtaatgcctgtggacaaaagaaagacctacattgcttcttttcagaatggaatcttctcagaaagtttacagaatcctccaggaggaaaggcattcagagtgtttgctgttgtgtgaaactgaatacttggaagaggaccataaagactattccaaatgcaatatttctgaattttgtataaaactgtaacattactgtacagagtacatcaactattttcagcccaaaaaggtgccaaatgcatataaatcttgataaacaaagtctataaaataaaacatgggacattagctttgggaaaagtaatgaaaatataatggttttagaaatcctgtgttaaatattgctatattttcttagcagttatttctacagttaattacatagtcatgattgttctacgtttcatatattatatggtgctttgtatatgccactaataaaatgaatctaaacattgaatgtgaatggccctcagaaaatcatctagtgcatttaaaaataatcgactctaaaactgaaagaaaccttatcacattttccccagttcaatgctatgccattaccaactccaaataatctcaaataattttccacttaataactgtaaagtttttttctgttaatttaggcatatagaatattaaattctgatattgcacttcttattttatataaaataatcctttaatatccaaatgaatctgttaaaatgtttgattccttgggaatggccttaaaaataaatgtaataaagtcagagtggtggtatgaaaacattcctagtgatcatgtagtaaatgtagggttaagcatggacagccagagctttctatgtactgttaaaattgaggtcacatattttcttttgtatcctggcaaatactcctgcaggccaggaagtataatagcaaaaagttgaacaaagatgaactaatgtattacattaccattgccactgatttttttttaaatggtaaatgaccttgtatataaatattgccatatcatggtacctataatggtgatatatttgtttctatgaaaaatgtattgtgctttgatactaaaaatctgtaaaatgttagttttggtaattttttttctgctggtggatttacatattaaattttttctgctggtggataaacattaaaattaatcatgtttcaaagttttattttcagttccttttgcatgcctattttgatttagaaatcactttaagataaatgaacaaaattattgtaagtcttctaaacttggtttattgacgttagtataaataacatacaataccagatgtctacaaaatcgacctgattatttaggtatttgtatgtgaaagagaaacacatatttagaaacacagcaagggagattttgaataaagagagagatgaatttataaagtaggaaaaaaagaatctgaaagatacaaagtgattataaaagaattgacaggacaataaatacttcaaatactttcaggaagtaaatgagtaggagtttaggagggataaacgagataaattccatgcaatgatcaaggaaagcaagagagcagataatacaaaagaaaaagaagaaggttcacataaatagcttctggagtgcaaattataaagacatcaacatttttgatcatataataagtactggcttacagctaagtggttccaaatactggtaattaaaacgatgtatacgttaaagattgcaaaacttaaaagcagatttttatgggaactttttttgaaaggatacatgaccaccttcttaaatagtatgactttacatagactctttttctggtccttactgctcctcccacaacagggaagcccgatcagttctgtcagtataaggttttcttctatttgcccttagtttagatctccatcatcaattccacttactattgtaataccttcagctggagcctgtgtctttctccattcctttttaatacattcgtatttcccagccccagaacccttgaaattaactcttccatgagttttcattgctgaagaaaaaccaaacattcttgtaaaaacatttaagaacttccatagtcttgttcatattgtttacctatcttctacacaaggcgtgtccttgggtaagttatttaacttcaatttaccttacctgtaaaatggaacaaataatatctccttaagattgctctacgaattaattgacacattatgtgtgatgtacttaaaggaataataaatgcataatatgaggtcagtggacgccattttctgttataatcatttttgttatctaatttggggaaactattcatctgtcatatactattgatcctttggcacttaaataaatgtgaaatcctccaggaattttcctgtgattctccttgtaagaattaaatgctctctaatatgatatccctttaaaaaaaaaaaaaaaaa

SEQ ID NO: 58099 - DNA, 975 bp, Homo sapiens
atggccatgctgatgctccccctgctgctgctgggaatcagcggcctcctcttcatttaccaagaggtgtccaggctgtggtcaaagtcagctgtgcagaacaaagtggtggtgatcaccgatgccatctcaggactgggcaaggagtgtgctcgggtgttccacacaggtggggcaaggctggtgctgtgtggaaagaactgggagaggctagagaacctatatgatgccttgatcagcgtggctgaccccagcaagacattcaccccaaagctggtcctgttggacctctcagacatcagctgtgtcccagatgtggcaaaagaagtcctggattgctatggctgtgtggacatcctcatcaacaatgccagtgtgaaggtgaaggggcctgcccataagatttctctggagctcgacaaaaagatcatggatgccaattactttggccccatcacattgacgaaagccctgcttcccaacatgatctcccggagaacaggccaaatcgtgttagtgaataatatccaagggaagtttggaatcccgttccgtacgacttacgctgcctccaagcacgcagccctgggcttctttgactgcctccgagccgaagtggaggaatacgatgttgtcatcagcaccgtgagcccgactttcatccggtcgtaccacgtgtatccagagcaaggaaactgggaagcttccatttggaaattctttttcaggaagctgacctacggcgtgcacccagtagaggtggcggaggaggtgatgcgcaccgtgcggaggaagaagcaagaggtgtttatggccaaccccatccccaaggccgccgtgtacgtccgcaccttcttcccggagttctttttcgccgtggtggcctgtggggtgaaggagaagctcaatgtcccggaggaggggtaactgcaggaggccaaatgggccaccccttggaaataaaggtttttctgg

SEQ ID NO: 58100 - DNA, 975 bp, Homo sapiens; identical to SEQ ID NO: 58099

SEQ ID NO: 58101 - DNA, 663 bp, Homo sapiens
atgacatctggagaagtgaagacaagcctcaagaatgcctactcatctgccaagaggctgtcgccgaagatggaggaggaaggggaggaggaggactactgcacccctggagcctttgagctggagcggctcttctggaagggcagtccccagtacacccacgtcaacgaggtctggcccaagctctacattggcgatgaggcgacggcgctggaccgctataggctgcagaaggcggggttcacgcacgtgctgaacgcggcccacggccgctggaacgtggacactgggcccgactactaccgcgacatggacatccagtaccacggcgtggaggccgacgacctgcccaccttcgacctcagtgtcttcttctacccggcggcagccttcatcgacagagcgctaagcgacgaccacagtaagatcctggttcactgcgtcatgggccgcagccggtcagccaccctggtcctggcctacctgatgatccacaaggacatgaccctggtggacgccatccagcaagtggccaagaaccgctgcgtcctcccgaaccggggctttttgaagcagctccgggagctggacaagcagctggtgcagcagaggcgacggtcccagcgccaggacggtgaggaggaggatggcagggagctgtag

SEQ ID NO: 58102 - DNA, 797 bp, Homo sapiens
  misc_feature 766: n = A,T,C or G
ctggtcgggaccggatacattattaaccccagtgcagtagggtccccaggggcaacctgccccacagcgcccaagatgcctagcagaactgcccgctatgcccgctacagcccacggcagcggcggcggcggatgctggctgatcgcagcgtgcgtttccctaatgatgtcctgttcttggaccacatccggcagggtgacctggagcaggtggggcgcttcatccggactcggaaagtctccctggccaccatccacccctcaggcctggccgccttgcatgaagccgtgctctctggaaacctggaatgcgtgaagctgctggtcaaatacggggctgacattcaccagcgagatgaggcgggctggacacccctgcacattgcctgcagcgatgggtaccctgacatagccaggtaccttatctccctgggagcggacagggatgcaaccaacgacgatggcgacctgccctccgacctcatcgacccggactacaaggagctggtggagctcttcaaagggaccacgatggactgagccagctttgcccgcccgcccccgcgcccagggccgcctccytggaaaaaccgcgcgtygcccatgggccavcacgtgccccaccsktgggccaggggcggccggacccgtycctycacgaccccgccacccctyctaggcctkgctttgtccccaggtgaattttttactgtgacactttttactttttcaataaacgtgactcccaggtgagggggcctgggtntacacacgtgamaaaaaaaaaaaaaaaaaaa

SEQ ID NO: 58103 - DNA, 1332 bp, Homo sapiens
gctgcagccctcagaagtaagcaaggtttcctgccgggagaaaaggatttgaagcattccagccaaaatgacggacagaagccccttcgaaaccgacatgctcaccctgacccgctacgttatggaaaaggggcgtcaggccaaagggactggggagctcacccagctgctgaactcaatgctgacggccatcaaagccatctcctcggctgtgcgcaaggccggtctggcccacctgtatggaatcgcaggaagcgttaacgtgacgggagatgaggtgaagaaactggatgtgctatccaattccctggtgatcaacatggtccaatcctcctatagtacctgcgtcctggtctcagaagagaataaggacgccatcatcaccgccaaggagaagcgggggaaatacgtggtctgctttgacccactggatggatcttccaatattgactgcctggcctccatcggaaccatctttgccatctatagaaagacctcagaggatgagccttctgaaaaggatgccctgcagtgtggccgcaatattgtggccgcaggttatgcgctgtacggtagtgcaaccctggtggctctctccacagggcaaggcgtggacctcttcatgcttgacccggctcttggtgaatttgtcctggtggaaaaagatgtcaagattaagaagaaaggaaagatttacagcctgaatgagggctatgccaagtattttgatgcggccaccactgaatatgtgcagaaaaagaaattccctgaggatggcagtgctccctatggggccaggtatgtgggctccatggtggctgacgtgcaccgcaccctggtctatggaggaatcttcctgtacccagccaaccagaagagccctaagggcaagctccggctcctgtatgaatgcaatcccgtggcctacatcattgagcaggcaggaggcttggcgaccacggggacccagcctgtactggacgtgaagcccgaggcaattcaccagcgagtccccctcattctggggtcaccagaggatgtgcaggaatatctcacctgtgtgcagaaaaatcaggcaggcagctagcgagtttgaccccacatgccctcttctgtttgttttgcaccttgtctaaggaccctaaatgaacgataaacagagatggtagctatgagtatacaaaaggtaaatccacttaatcacatacagaagagcaacaacaaactgcttacgacaggtttggaagccacaggcgattctatggtcaatgtgaaggactagaaataaaaacccacatgtggaaaaaaaaaaaaaaaaaaaaaaaaaaaaaa

SEQ ID NO: 58104 - DNA, 1738 bp, Homo sapiens
ggcgggcccgcgctcacttcctcggggaggggttggggccgcgctcccactcgcccacacggtccgtctgcagtcggcagcctcgccggcagctcgctcggcccccgcttggcccggcccgcaggtaggagccgccgagggacgcggcgcccggttcccggccccgcctgcgccgcgcgctccccgctcccgccgcccgcttcgagggttctctccccttgccaccatgagcgagtcatttgactgtgcaaaatgcaacgagtccctgtatggacgcaagtacatccagacagacagcggcccctactgtgtgccctgctatgacaatacctttgccaacacctgtgctgagtgccagcagcttatcgggcatgactcgagggagctgttctatgaagaccgccatttccacgagggctgcttccgctgctgccgctgccagcgctcactagccgatgaacccttcacctgccaggacagtgagctgctctgcaatgactgctactgcagtgcgttttcctcgcagtgctccgcttgtggggagactgtcatgcctgggtcccggaagctggaatatggaggccagacatggcatgagcactgcttcctgtgcagtggctgtgaacagccactgggctcccgttcttttgtgcccgacaagggtgctcactactgcgtgccctgctatgagaacaagtttgctcctcgctgcgcccgctgcagcaagacgctgacacagggtggagtgacataccgtgatcagccgtggcatcgagaatgtctggtctgtaccggatgccagacgcccctggcagggcagcagttcacctcccgggatgaagatccctactgtgtggcctgttttggagaactctttgcacctaagtgcagcagctgcaagcgccccatcgtaggactcggtggaggcaagtatgtgtcctttgaagaccgacactggcaccacaactgcttctcctgcgcccgctgctctacctccctggtgggccagggcttcgtaccggatggagaccaagtgctctgccagggctgtagccaggcagggccctaagccagggctcctggacccaggctttcccataccacgggcccaggactgtggctccttttctaaaccacctctgggactcagctccccccgccaaaaaaaatgggtctccttctgggctccaggattgtctccccactccagcatccccaaactggtactccctgacccaggcccccaatcctgggctcttacagagcctccatgagtcaagccccctccccacacctggactccagaattcaccctctcccctgcagtctgggttcccagactgagtcctctccccaaatcagggctctagacccgagccctccaaacctggactctgggacttaggcccccttaaatctagacttctctttataggtttcaggtctcctatgggtgcctgggaagtccttgaaagtggactgttctcaggcttgacctgccccaccccatccccgcggttgaggctgtgggggcagcagatcaggagcccactgataaggggccctagggtacagggtgctgcccagcaggtcgccaccgagtgtcttctcattttatttcagctccattttgcccatagatgggcagaggggtgagattggctcatcccccttccagattctgcaataaagcggtgtgaggaaaaaaaaaaaaaaaaaaaaaaaaaaaaaaaaaaaa

SEQ ID NO: 58105 - DNA, 1919 bp, Homo sapiens
gacagcgcgtagtcgcagagtcagggaggggacctcaccacctgtctcctccctgaggtcttagaacagatacaagaaattccaggcgaaggtcccacagagtttggatcacgatgaggccagtgagtcggagatgagaaagacctcaaactcctgcatcatggaaaatgggcaccagccggggacaggtccaggcgatggaccccctgagattgcccaaaacttctcagcaccagatccccccaggcctcgtcctgtgagcctctccttgcggctgccccaccagccagtcacggccatcacccgagtctctgacaggttctctggggagacctcagctgcggctctatcacccatgtctgctgccaccctggggggcctcaacccaagccccagcgaggtcatcacgccctggactcccagtcctagcgagaagaattcctctttcacgtggtctgtgccaagctctggctacggggcagtgacagcaagcaaacacagcaatagcccaccgctggtgacaccaccccagtcgcccgtgtccccgcagccgccagccataactcaggtccatcggcagggggagcgtcgcagggagctggtgaggtcgcagacgctgccccgcacctcggaggcgcaggcccggaaagcattgtttgagaagtgggagcaggaaacggcggccggcaaggggaaaggcgaggcccgggccaggctgaagcggtcgcagagcttcggcgtggccagcgccagcagcatcaagcagatcctgctcgagtggtgccgcagcaagacgctgggctaccagcacgtggacctgcagaacttctcctccagctggagcgacggcatggccttctgcgccctggtacactccttcttccccgatgcctttgactacaactccctgagccccacgcagaggcagaagaacttcgagctggctttcaccatggccgagaatctggccaactgtgagcgcctcatcgaagtggaggacatgatggtgatgggccgcaagccggaccccatgtgtgtcttcacctacgtccagtcgctgtacaaccacctgcgtcgcttcgagtaaagcccctgagcctggattgccaaagagcagccccaggaagaggccgggggtccgcttgcgattccccagccaggatgcccccaggagccttgccgtttggtgtgagcgcgctgtttgttctgtggcatgtgacggcactccccttcgagcccagctgtgttactgattaaaagtactgctgagctgtggtccgacagcactgatcacagccaagggcttggaggaaaaggaaaaattatgagagagagagagacattggtgctaagtaatgatcttcctaaagaaatgcttgtgtttatagcttccagaatgctaatctacaattttccctctggtgaattcgatacatcggctttacagggttacagtgattaccaagtgtttttttttatcaaaatacccagagttttttacttcctcacgcgattgtaggttcctctcctccctccctctgggccactgccaggaaacagagagaccgcttaatcagcagcttgacaaagaagacctcaagtcttgggaagaaacagtttaatcactcccaagtcctgggcaacagatgaccttcaagtcacctccgctctccggggagatgggaaggctctcctctcggtcccaaagtcctcctgttcttcccaggaggcctcacaagtgtttggctaagcacaggctctcgggaatttaacacttttggggaaggaataggccctttgtgctgagagagagtttttattcacatcttttttaggggatttgctgcagatatttataaaaagtaactccctctgtaccactgacccatttatacataaaaaagatgtgttgaattttg

SEQ ID NO: 58106 - DNA, 3086 bp, Homo sapiens
atttaacccaggtggctcagtgtccaatatgtatgcaatgaatttagctagatacaaatattgtcctgatattaaggaaaaggggctgtctggttcgccaagattaatccttttcacatctgcagagtgtcattactctatgaagaaggcagcctcttttcttgggattggcactgagaatgtttgctttgtggaaacagatggaagaggtaaaatgatacctgaggaactggagaagcaagtctggcaagccagaaaagagggggcagcaccgtttcttgtctgtgccacttctggtacaactgtgttgggagcttttgaccctctggatgaaatagcagacatctgcgagaggcacagcctctggcttcatgtagatgcttcttggggtggctcagctttgatgtcgaggaagcaccgcaagcttctgcatggcatccacagggctgactctgtggcctggaacccacacaagatgctgatggctgggatccagtgctgtgctctccttgtgaaagacaaatctgatcttcttaaaaaatgctactctgccaaggcatcttacctcttccagcaggataaattctatgatgtgagctatgacacaggagacaagtctatccagtgtagcagaagaccagatgcattcaagttctggatgacctggaaggccctgggtacattaggccttgaagaaagagttaatcgtgctcttgctttatctaggtacctagtagatgaaatcaagaaaagagaaggattcaagttactgatggaacctgaatatgccaatatttgcttttggtacattccaccgagcctcagagagatggaagaaggacccgagttctgggcaaaacttaatttggtggccccagccattaaggagaggatgatgaagaagggaagcttgatgctgggctaccagccgcaccggggaaaggtcaacttcttccgccaggtggtgatcagccctcaagtgagccgggaggacatggacttcctcctggatgagatagacttactgggtaaagacatgtagctgtggctttggtcccccagaggcatagatcctatcctgggagagtttagatccagaacatcttggagatacacagtagattgcagcccttctgatgagaaatagggaatactcccagtccaggcccagcaaaaccaaaatgctaagcaatgaatattaaggactctctagctgcctgggcattactgttgctaaaagaagaaagtttaaaaaaaaaaatgattttctcaaggaatgcccctggaacacagctctgaagagagtttagtaagtaccatgtaggttctggattctaagcttacattgctctttaaagaacttataaactaacggtttaaagcagtggttctcaaagtgtggtccctggactatcagcatcaaagcatcacctgggaacttgctaaaaatgcagattctcaggctttctctagaccaactggatcagaagctctgggggtgaggcccagtattctgtgttttaacaagcccgtcagggaattctgatgcacagtaaaatccgagaaacactggtttaagaaaaaccttgtaatgatcgaatacccactctgatgttttgccagcaaagggatatctaatatttcagaagcctctgagccagtctttgaaaaaatacaactatggcatctgcagcacaaatatttaaggacatcagaagcatgtcaaagctatttttaaagagagaaactgtataagatgtttacttcatagagatttatgttttatgcaggctgaatgtttatctcaaaagttaaaattatccattctcaaaagttaaaattatatatatatatatatatatacacacacacacatatatatatatatataattcaaagcacaataattgaaagcacaataattgacagaaaaatacaggttctattaataaattaataaactgttggtcttcaaaatagaaatgcatgtaatatccatattagttttttcttggtagacaactggaaggttttcttttttttcgtctatgactaattttctttattcaagatacctgaactggggtgctttttaagaaaaatttgggaaatatatatgtttctgtgatatacatatatacatatatatgtatatatatacacacacatacatatgtgtgtgtgtagtatatatatatatacacacatatatgtttctgtgttcctcttttagcttgaggggcttgtttattatcttgctctgtgcctcatagggaataaacacaatgaagtccagggttgtacaacattccctttcctaagctttgaaatgtcagtatagattattaagtggtttatattacagaatctgggattcagcagactttcagtgtaaatgcttcctccatttctcctgagagtgggtgattttaattctatctctgaccctggtcctaggtttctaggagagttttgtttaactaagaaattgacagaattcataggtgtgggtgtagagttcaccaagataagattatgaatataattaaaggtctgcattaaaaggtgaatgattgaagagtgttaaagcattagacttagcacattcaataaccttttcgtactccattgttaaccaatgtcatttaaattttgagtactatttgcttttattgcttattttcattttagtgtgcacagtttctcggtatctctattggtcaaagaatattaaatctgtctctgaattacttcaaattctcaggtgaaacctattggtgtgtgtgtgtgtgtgtgtgtgtttattttgcatttcttgttgcctttttgttttaatgtctacataaaatatttctaaaattgatgtttgtaacaatttgggtttcatgaaacaaaaaggaacattactatacttagtgttgttgacttttcttttcctgtcatctcctctttactggattgtaccaatacattttagaagtgaactggacttggttggcattttagtttaatgactgaaaaagtaggttgaaagctctctgtattttagttaacaccttgaataaaatggaaaaagcagttatagc

SEQ ID NO: 58107 - DNA, 2017 bp, Homo sapiens
cctcccctccaaccgcgccccccctcccggatggggaaaaaaaaagatgtcagctcctccgctgtagtattgctccttaaaaacccctctctctgaaaatgacatgccctcgcaatgtaactccgaactcgtacgcggagcccttggctgcgcccggcggaggagagcgctatagccggagcgcaggcatgtatatgcagtctgggagtgacttcaattgcggggtgatgaggggctgcgggctcgcgccctcgctctccaagagggacgagggcagcagccccagcctcgccctcaacacctatccgtcctacctctcgcagctggactcctggggcgaccccaaagccgcctatcgcctggaacaacctgttggcaggccgctgtcctcctgctcctacccacctagtgtcaaggaggagaatgtctgctgcatgtacagcgcagagaagcgggcgaaaagtggccccgaggcagctctctactcccaccccttgccggagtcctgccttggggagcacgaggtacccgtgcccagctactaccgcgccagcccgagctactccgcgctggacaagacgccccactgttctggggccaacgacttcgaagcccctttcgagcagcgggccagtctcaacccgcgcgccgaacatctggaatcgcctcagctggggggcaaagtgagtttccctgagacccccaagtccgacagccagacccccagccccaatgaaatcaagacggagcagagcctggcgggccctaaagggagcccctcggagagcgaaaaggagagggccaaagctgccgactccagcccagacacctcggataacgaagcgaaagaggagataaaggcagaaaacaccacaggaaattggctgacagcaaagagcggaaggaagaagaggtgcccctatactaaacaccagacgctggaattggagaaagaatttctgttcaatatgtatttgacgcgagagcgccgcctggagattagcaagaccattaaccttacagacagacaagtcaaaatctggtttcaaaatcgcagaatgaaactcaagaaaatgaaccgagagaatcggatccgggaactgacctccaattttaatttcacctgagagcgcggcctctcctcctcccttcccgctccttcctctccccgcccctcctccctttgtgcctggtgatatatttttttttcctccctgagtataaatgcaatgcgactgcaaaaaaggcaaagacctcagactctccttccaagggacctgtggttcgtgctgcgaagatgcttccacttaaagcatgagaaatggggtgccgggatgtggggtgtggtgtgtgccctcatagatgggggtgggagtgtggctggtgtgtgtgtcaagccctcactcacccacgcactcacacacagcattctgttctccatgcaaagttaagatcgaatccatccgcttgtaggggaaaaaaaggaaaaaaattaaccagagagggtctgtaatctcgcagagcacaggcagaatcgttccttccttgctgcatttcctccttagactaatagacgttttggaaagttcggctagtgttcgtgtgtttgtcgtagcacccagagcctccaccaaaccctctccatgtctttacctcccagtcgctctaagaatctgcttgaagtctcgtatttgtactgctttctgcttttctcccacccctcctagcacccccacatcccccatctagtaacatctcagaaatttcatccagaggaacaaaaaaattaaaaatagaacatagcaaagcaaagacagaatgcccccccccccaaatattgtcctgtccctgtctgggagttgtgttatttaaagatattctgtatgttgtatcttttgcatgtagcttccttaatggagaaaaaaaaacctaataaatttccagaatcataatcctcaaaaaaaaaaaaaaaaaaaaaaaaaaaaaaaaaaaaaaaaaaaaaaaaaaaaaaaaaaaa

SEQ ID NO: 58108 - DNA, 1359 bp, Homo sapiens
gagttccacatctgatacccaggagtctccagcttccaagagaggtcgggtcacagccagcagctatgtctgacataaatcttgactgggttgacaggcgtcagttgcagcgcttggaggaaatgctgattgttgtggatgagaatgataaggttattggtgccgacaccaagaggaattgccatctgaacgaaaacattgagaaagggctgctgcaccgagccttcagcgttgtcttgtttaacaccaagaatcgaatcctgatacagcagaggtcggacacgaaagtcacgtttcctgggtattttaccgactcctgtagtagccacccattatacaacccagcagaactggaagaaaaggatgccatcggagtgaggagggcagcccagaggcgtctgcaagcagagctgggaattcctggggagcagatttctccagaggacattgtgttcatgacaatctatcaccacaaggcaaaatcagacagaatttggggagagcatgaaatttgttaccttctgcttgtgaggaaaaacgtcactctgaacccggatcccagtgaaacgaaaagcatcctctacctgtcccaggaggagctgtgggagctgctggagagggaggcgaggggtgaagtcaaagtcaccccctggctaagaaccattgccgagaggtttctgtaccggtggtggcctcacctggatgacgtgaccccgtttgtggagcttcacaaaatacacagagtgtgagaggcagggaggtcgagtcagccatgtgtaatgccctcagtgcaggcagacgcaccattgaggcaatgatacaccctctccaaaaaacagggcaaaaggggcacttgattgcccatcatgtataaatcactatttcaaccttttcatcaactttgtcatatcttcattttcccttttccttatttccatatttctcatctgcctggttgcagggaggaaatttaacatttcctttgtcccaatttccattttataagcacttgtttgattaacagcagctgatcctgaaagtcttggggagatcttgagagtcctgaagcaggcagactagcctggctggaccatgaggctgtctccccacagctttatccaagcctccaaggtcaggatgggatctctgtatcatgtttttctttttaaatcacttatttcagagtgcaacacaaggctgcatttttaaaaaaaagacacattcaatcttgcatcctaatacaagcagtacggaagatgcgtatggtctcagccaagtgactcgacgtttatccacttctgttcatttgatcgtttcagtaatatgcttacaaataaagacatacttgctttaaaacat

SEQ ID NO: 58109 - DNA, 4373 bp, Homo sapiens
tccgtgcccctgcggggagcgcgccggggctgccccccgaatgacgggcggaaggttcgacttcgacgatggcggcacctactgcggcggctgggaggagggcaaggcgcacgggcatggcatctgcacggggcccaagggccagggcgagtactcgggctcctggtcgcacggcttcgaggtggtcggaggctacacctggcccagcggcaacacctaccagggctactgggcgcagggcaagcggcacgggctgggggtggagacgaagggcaagtggatgtaccggggggagtggtcacatggtttcaaggggcgctacggggtccggcagagcctgtgcacccccgctcgctacgagggtacctggagtaacgggctgcaagacgggtacggcgtggagacctacggggacggaggtacctaccagggccagtgggccggaggcatgcggcatggctacggcgtgcgccagagcgtgccctacggcatggccacggtgatccgctcaccgctgcgtacctcgctggcctcgctgcgcagcgagcagagcaatggcagcgtgctccacgacgccgcagccgccgccgacagcccggccggcacccgcggcggtttcgtgctcaacttccacgcagacgctgagctagcgggcaagaagaagggcggcctcttccggaggggctcccttcttggaagcatgaaacttcgcaagtccgaatccaagtcttccatctcgagcaagcgcagctctgtccgcagcgacgcggccatgagcagaattagttccagcgatgccaactccacgatcagctttggcgatgtagattgtgatttttgcccggtggaagaccacgtggacgccaccaccacggaaacctacatgggcgagtggaagaacgacaagcgcaacggcttcggcgttagcgagcgctccaatggcatgaagtatgaaggggagtgggcaaataacaagaggcatggatatggctgtaccgtgtttcctgacggctccaaagaagagggaaaatacaaaaataatattctggtccgtgggataaggaagcagcttataccaataagacatacaaaaactagggagaaggtggacagagcaattgaaggcgcccaaagggcagctgccatggccagaaccaaagtggaaatagcaaattcaaggactgcacatgccagagcgaaggccgatgccgccgaccaggccgcgctggccgctcgccaggagtgcgacatcgcgagagctgtggccagggagctgtcacctgatttctaccaaccaggccctgattacgtcaaacagagatttcaggaaggtgtagatgctaaagaaaatccagaagaaaaggtaccagaaaagccacctacaccaaaggagtctcctcatttttatcgcaaaggcacgacacccccaagatctcctgaggcaagtcccaaacacagccactctcctgcttcctccccaaagcccctgaagaagcaaaaccccagctcaggggcgagactcaaccaagacaaaaggagtgtggctgatgagcaggtgacggccattgtcaataagcccttgatgtcaaaggctcccacgaaggaggcaggagcggttgtgccccagtccaagtactctggccgccaccacatccccaaccccagtaacggggagctgcattctcagtatcacggctactacgtgaagctgaacgccccccagcaccctccagtagacgtggaggacggcgatggatccagccagtcttcctcagcactggtgcacaagccatccgctaacaagtggagtccctccaaatctgtgacaaaaccagttgccaaagaaagcaaagctgagccaaaagctaagaagtctgaacttgctataccaaagaatccagcaagcaacgattcatgccctgctttggaaaaagaagccaattcaggccctaattcaatcatgattgtccttgtcatgctgttgaatatcgggttggccattctttttgttcactttctaacttgattggaattaggaaagtgaagtcctgacaactagtggtgtgttagcccacagttctctgcagtggtgccgtcagccctttaaatggcccaccccaggcagactcagacacagggaaggaggcttggaattaggatgggatcgcgagagagatgaaacttggaaaattcagccagaggacctgttcggttcccctgggagtgctttgtggctttggggtcctctgggagctgaagcacacggccatgttggagagcaaaacttaataataattcttttttaaaatctgctgaagcagccccatccggcgaagttcttggcattggctactccatctgtcctagcagagtgtgactaaactggaaatgtatggagctgcattttttttttttttttgatggaagtcaacagctgccttactattttaccatctgacgtttttagtagggagctggggaaacgactgcccgaggaatgcggtcggaggattgtgttgctgtggacgtggttccaacattcactcctatctcattagaagaaataggtagcagcatcactcaccagtcttatgccatgacctgctgctttaacatctcctggaatgttctgggagagaacgtttcgtttgcttgtgcacgactctgttcatttttgctgtttatttaaatctgacgtatagtcatctaccacctgcggtcctggccggacgaaacacacgtgttgcatctcaaggaaaagaaacaacaaaatgctagtgaaaatgtgcttattttgatagcaatataccatcttttatgtcatttattcttcctatacttgtaaaaggttatttatctttaaaatttagcaatttgaagacactatgccttcctaagaactaatttaattctaaatatttttaacattactgaggtgaattatttatgcacttaggaagtgctaaattttaaaagctgaaacacaacagaattctaagaaatatagtccaaacgttgcatggattgcagtaatcagtgtttaaaggattcagtttctttgctgacgtactttacaaccaaataaaatcttgtcggtggctgtgttaattcccatgaaagttaagcaagatgctattaataaactgctctgctctttcttgttttctttttccaacttaaatttctgttgaatacattcaggtagaacataaagccttgttcaatcactgcctctcagttttctgcctttcctgtttttcaaagtccttttgtaatttcatttcacattttaaaggcttagacatttttattttaaatatgtgtcttttacagtcttttgtcattctgacatttctggatttttgctgttttataatttaccctttgttattcagaagcatgcttacttatagaaactaaatggtctttataaaagtaattacttaaaaagaaatcaggggaagaaagatatctatctaatctattaaatctttataaaacattacattgcagagggggagctactcctaaatattttcatgatttgcatggtttaatcagatttttttttttttttacaccatattagctaccttttcaatggagaagagacagttcacacaattccctggttagcacagatgtggactgagtgctttgtcacctgcagggtagtaacccagtgatgtttcttacagaagcacaatatgttgaaaatcctgggtgtgaccaatatggaataaagaagaaggcagaaagagagcaaatgaaaaatttcaacttgtatattcattttttacattttgctttgacttttaaatttaggaagtccgtttttacctgagaacaaatgtttaaagttcctgcgtcactctcagtactctcactgcccctcccaaaccctatagctccttacgctgggaaagctggttttttaaaaaaataataataaaatatttaatcttattaagtgttcatttaaaatgcgtaatgctttggaaataatgggtaacagatagcgagaggatatgtttataaagtgagcatgttggtcccatttataaatatatgtatgatttataagcttttttaaaacaaagctcaaattgttggtatttttctaaaatgtgcacagctgtattttacatgaaggctctttctaatgggttgttatactgtactcaacattttggacagcacatgaagtctgccaatgtacttaataaaacatgactttgtttatttaaagtttcttgctgtgaaaaagaactccctacctgtgagttcctttatttataattcttgaaaccaaaatgtataatgtacagttttcacaactgtatctgctctaataaaaaaaagttggttattaa

SEQ ID NO: 58110 - DNA, 2472 bp, Homo sapiens
ctttttacagctagacctgtgtgctgcaaggagctaaggccttcagtgtccccttccttacccaggtttctcacagaatggattcccagcgggaacttgcagaggaactgcggctttaccaatccacccttcttcaggatggtctaaaagatctcctggatgagaaaaaattcatcgattgcaccctaaaagcaggtgacaaaagtcttccttgccacagattgattttgtcagcttgtagtccttacttccgtgagtactttttatctgaaattgatgaggcgaaaaaaaaggaggtagtgctagacaatgtggatcctgctatacttgatttaatcatcaaatacctgtactctgccagtattgatctcaatgacggaaatgtgcaagatatttttgcattggccagccgctttcagatcccctcagtgtttactgtctgcgtttcttatcttcagaaaagacttgctcctggtaactgtctagccatcctaagattaggacttcttcttgactgcccgagactcgccatttctgcccgtgaatttgtgtctgatcgctttgtacagatttgtaaggaagaggactttatgcaactgtctccacaggaactgatctcagtcatttcaaatgacagcctaaatgtagaaaaagaagaagcagtatttgaggcagtgatgaaatgggtgcgaacagacaaggaaaacagggttaaaaaccttagtgaagtgtttgattgtatccgttttcgccttatgacagaaaaatattttaaggatcatgttgagaaagatgatataattaaaagcaacccagacctccagaaaaaaatcaaagttctaaaagatgctttcgcaggcaaactcccagaacctagcaaaaatgccgcgaagactggggctggtgaggtgaatggtgatgttggtgatgaagatttacttcctggttacctgaatgacattcccaggcatggaatgtttgtaaaagacctcatcctcttggttaatgacacagcagcagtggcttatgaccccacggaaaatgaatgctaccttactgcactggctgagcagattcccagaaatcattccagcattgttacccagcaaaatcagatatatgtggtaggaggactatatgtggatgaagaaaataaggatcaacctctacagtcatacttcttccagctcgatagcatagcatctgaatgggttggacttccacctctgccttcagccaggtgtctcttcggtctgggagaggtggatgataaaatctatgtagttgcaggcaaagaccttcaaacagaggcttcgctggattcagtattatgctatgatcctgtggctgcaaaatggaacgaagtaaaaaaactccctatcaaagtctatggccataatgtgatttcacataaagggatgatatattgtctaggaggaaagacagatgacaaaaaatgtacaaacagggtgtttatcttcaaccccaaaaaaggagattggaaagatctggctccaatgaaaattcctcgttccatgtttggagtagcagtccataaaggcaaaattgtgattgcaggaggtgtcactgaagatggtctttcagcttcagttgaagcttttgaccttacaacaaataaatgggatgtaatgaccgaatttccccaagaaagaagctccatcagtttggtcagcctggctggatctctgtatgcaattggtggttttgctatgattcaactggagtctaaagaatttgcacccactgaagtcaatgacatatggaagtatgaagatgataaaaaagaatgggctgggatgttgaaggaaatacgttatgcttcaggagctagttgcctagcaacacgtttaaatctcttcaaactgtctaaactgtgaacaaggtgacaaaacataatagattgggaggtggtttgtttggtgaatggggctttaatttattctgttttttaaaagcttgtacagacactcatgtagaaattattcaagaagttattgtctaagagatgagcagtaggtaagaaaacctcagtcattgactcttcaatgtaatgatcagagtttaaaaccattttctaataataaattaaatcttcagttgaacaaattattttgtgaatctgtttcactcaatggattgtaaagaaggctcctaaatttgagttgtttgctaatcatttcatttgcatcattagggtatccttaaactgattttctattacaattggaagtggagaatatgtgcatctacactaaaaaaatgtttaagatatcaaaaacctctcctcgtgcttcaaaatgacaggaatcctgtgcattatactaagaattacatgccataagatgacttcagaaatcctacttcagaagtgtaataaatggatggggaaatcgtttgatggggaaaagtctcttgtaagtaaaagtagtcaaattcaaatggcaaaaaaaa

SEQ ID NO: 58111 - DNA, 2423 bp, Homo sapiens
cctcgaagacagctgctcagtctaagcaaaccccagcaggaaagcaggggtacagagaggagcccccttggcaccgccaccgcaccctaggccacccaccatggcgctgggcttggagcaggcggaggagcagcggttgtaccagcagacgctcctgcaagacgggctcaaagacatgctggaccatggcaagttcctcgactgtgtggtgcgggcgggcgagcgcgagttcccgtgccatcgcctggtgctggccgcctgcagcccctacttccgggcgcgctttctagccgagccggagcgcgcgggcgagctgcacctggaggaggtgtccccggacgtggtggcccaggtgctgcactacctgtacacatcagagatcgcgctggatgaggcgagcgtgcaggatttgttcgccgcggcacaccgcttccagatcccttccatcttcaccatctgcgtgtccttcctgcagaagcgcctgtgcctctccaactgcttggccgtcttccgtctcggcctcctgctcgactgcgcgcgtctcgccgtggctgcccgcgacttcatctgcgctcacttcacgctggtggcgcgcgacgctgacttcctcggactctcggccgacgagctcatcgccatcatctccagcgacggccttaacgtggagaaggaggaggcagtgttcgaggcggtgatgcggtgggcgggtagcggcgacgccgaggcgcaggctgagcgccagcgcgcgctgcccaccgtcttcgagagcgtgcgctgccgcttgctgccgcgcgcctttctggaaagccgcgtggagcgccaccctctcgtgcgtgcccagcccgagttgctgcgcaaggtgcagatggtgaaggatgcacacgagggccgcatcaccacgctgcggaagaaaaagaaggggaaggatggagccggggccaaggaggctgataagggcacaagcaaagccaaagcagaggaggatgaggaggccgaacgtatccttcctgggatcctcaatgacaccctgcgcttcggcatgttcctgcaggatctcatcttcatgatcagtgaggagggcgctgtggcctacgatccagcagccaacgagtgctactgtgcttccctctccaaccaggtccccaagaaccacgtcagcctggttaccaaggagaaccaggtcttcgtggctggaggcctcttctacaacgaagacaacaaagaggaccccatgagcgcatacttcctgcagtttgaccatctggactcagagtggctggggatgccaccgctgccctcgccccgctgcctctttggcctgggagaagctctcaactccatctacgtggtcggtggcagagagatcaaggacggcgagcgctgcctggactcggtcatgtgctacgacaggctgtcattcaaatggggtgaatcggacccgctgccttacgtggtgtatggccacacagtgctctcccacatggaccttgtctacgtaattggcggcaaaggcagtgacaggaagtgcctgaacaagatgtgcgtctatgaccccaagaagtttgagtggaaggagctggcacccatgcagaccgcccgctcactctttggggccactgtccatgatggccgcattatcgtggcagctggggtcaccgacacagggctgaccagttctgccgaagtgtacagcatcacagacaacaagtgggcacccttcgaggccttcccacaggagcgtagctcactcagcctggtcagcctggtgggtaccctctatgccattggtggctttgccacactggagacggagtctggagagctggttcccacagagctcaatgacatctggaggtataacgaggaggagaagaaatgggagggtgtcctgcgggagatcgcctatgcagcaggtgccaccttcctaccagtgcggctcaatgtgctgtgcctgactaagatgtgaccagctcaggcagactgaactaagcacccctcccatcctgcgaccctcactggcctggccttgtgggggctccagaaaagaggctaggagaggccagagtctacctggatccagttatggtgcctcaggggctgcgtcagccaaggaaagggaagtgctgcttagtcctggacttttgggcaagggtgagaaactagaggcttctccagtgttgccatatccccctaggttgtcttgatccatgaaccagaaccacagggcggtatcccaggccgtgtgctggccctgccccagcctagctgagtgtgctggcaaagttccccacaggactcagccttctcgtctgtccgatgggagcatccccatcaagtgcagtgtacagtgcagatatgtctccttctttaggaagaataaagtgccttctgagcaagcagctcagggtctgcatcagtgaaaa

SEQ ID NO: 58112 - DNA, 4121 bp, Homo sapiens
agtgtgtgtcaaaaatatatgatggaccacatggatgcctccaactgtttaggtatctattattttgcaaagcagattggagctgaagatttatctgatcgatcaaagaaatatttatatcagcactttgccgaggtatcatgatagaggaaaccagttttgggaaaagttatgcacagctgaatttcgagaactctatgctctggatggatcttcctgatgaagaacctgatcgattaagcaacaaactgttgcagtatgaccccagccaagatcaatggagtgtgcgggcacccatgaagtactctaagtaccgattcagtacagctgtagtcaacagtgagatttatgttttgggtggcattggctgtgtaggtcaagacaagggccaggttcgaaaatgccttgacgtggtggagatctacaacccagatggggacttttggcgagagggccctcccatgccaagtcccctcctctcactccgcaccaattccaccaatgcaggggcagtggatgggaaactctatgtctgcgggggattccatggagcagatcgccatgaggttatctccaaagaaatattggaactggacccatgggaaaaccagtggaatgttgtagccatcaacgtcctcatgcatgacagctatgatgtctgcctagtagccaggatgaatccccgagacctcatccccccgccttcagatttggtggaagaaggcaatgagcactaaggtgaccttgctggaggacctcctgctgttctgcaaacaaggccttcagaacggagagggcccacagcatctctgtcatgccagtcatgtgcactgcatgcgtagtggcctgtgtgtgaagaagcagtgtgtgctgggcactgggtggggagcatggggagtctcccttcagggacttcccagcctgatagggtaaataagacactacaaagaagaggtgatgacggccacaggaggggcacagggccacaggagagcagcagagggagggtctcactctgctggggacccatgaacagcactgccaaggagcagaccttttattgggtccccaaaaggatgaggaggaagtggtcccatgggtgcagtcaatgatgagttcatggaaacagccaagcatgggcccagagacagaaagctcgtgcctgtctgcagtatcctggctgggccagattgcctggggcacagggtttgtggtcaaggctggaaaagtaggttgtagctagatgaccaacgcctgaaagaatgaggagttggacctggtctgtaagccagggaattgtctcaaaatcgtgcattaagggagacttctctctgtgctctgttccagcttcagtcttataaacactgaccattctccttcagaatccccttctactgaagcaacgccacccagcagcagggctagctgtactaccagcccctaacaaccaaggcactcaagccagaccacagtggccaagaatcctgccctgggctgactctgtccgggacagggatgtggggttctgcagcctggtccactccggggctggcagggagtgtcctggagtgggctgacccaggctgcctttgcccacctctcagacacatacaaccatctgcagggtagtcctggctgaacaggactcgcccaagccacccaagccagggacagagaaggctctggctgaggacaggggaagaagcatctcctccagctgctgccaaccccatggcccggcctttgcaataaagatggagccacccacttcagcccacaattgagcataatcagaagacagtcactcccaaaatatatgttagaaataacatttaaatgacacatgggaagtccgtctatcttacttcccgtctctaattctggaagcacagtggattcaatgagggcatcttcatagctcttcttcagcaacttctccaaagagtttcacattgcacaaggctcttttggaagcaggagtggtcagtaaattcagagggagacaaaccctaagtagagacagctttctttggtgctgagctgtgtgattgtgatgaccgctagcctgtgcccctaggttccagctgcccaccaggcaggacaggcaggtcttgccaaaactggagcctgttggaaacctatttctgccaccaaggagagggaccaggagacccagcgtaggttggccccaagtaggctcaactcgggagggtgggggtcccgcctttctcttcgcacttgtgccccaagtgcactcacagtacctggcatgtgggtgacctcttgggtggccggcatggggcagtgtttctcaatcagagggcctgggccccgagcacgtccaggaatctgagttaaagtgagcttactctttccccagtggatgatcatgatctgtgcattctttttcttgctacaaagatgttcctcctagctgctgtgttggctgtcggcggccagggttgaggacggcctccacagggcctccacttccctccattcctcttcacatagtcactccacctgctccacctgcttgaaaagtccagaaagctgccgcgtctccctggctcaaggaggccttgttggcatgtcatggcacatctcctagatgttttgggttcaagatctgggttccagcccccgctctgctacttagctaaccatgtgaacttgggcaagatgacctttctaaagcctcatttccctcatatgcagagtgggaaggaaaatattaatacatactttatagggttggtatgaggattaagtgctgagcaaagtgcctgtgaaatcctgaaataataagcatgttttagctgccattattatcatcactgtcattatcattgcagtcagcacttcccaaagcaaggtgcccaaaacagactcagtgctttagggaagtggggcagatgtgcatatggcttgtgacggttctttctttttttttttttttttgagacggagtctctctctctcgccaggctggagtgcagtgcagtggcacgatctcagcccactgcaacctccgcctcccaggttcaagtgattctcctgcctcagcctcccaagtagctgggattacaggcgcccaccaccacacccagctaatttttgtatttttagtagagacggggtttcaccatgttggccaggatggtctcaatctcttgacctcgtgatctgcccgcctcggcctcccaaagtgctgggattacaggcatgagcccctgcacctggctgagatggttcttaatttcccataccctgttgcttggctcctccagttggcggctgagagttaagcaagggtttactcggatctgaggcccccgatgccctcaatggacacattcaggaccctgtggcagctcagcagaggcacctgagggtcacgctaggtgagaccatcgcccgcctgtgggaggcaagataagtgggtaaacatcattcctgtctaatgcgaggtctgggcagtgtcccagtggaactttccagagagtgccaagggaggaccgagaaggggcatgacctctgctggagccaggagggcagtgaccaggagctggcttagcactgaagggaagcaggcatcaagggcaggatttctcaaacttcttctgaggaatccccgaggtcgaaaccggtgcttcacagatttcagatgtctgatcttgatttttctttgattccatacaacagattgcttgcctgggttagtgcttattttaagttcttggtgcttcttgtctgacttctgtatttgcaattaaaaacaacatgaccctccccacctgcagccagatatcgttagaaattcaacttcgaaatatattcctatcactcctgttttcactttaatagaaggctgttgcagtactgcatgatgggctcttataaaacttctactatctgctaattcttatctttgtgacaggattgtttgacactgagcaaggaaacacaataaggaagtaatttggatgctaggctggcagaagcctgcagctgtcaaccacagcctgccccagtgtgttcaacacggtggcattgttctccctgacttcataatgagcaaatgtttcacatttgaacttaaggaataaatttttactaat

SEQ ID NO: 58113 - DNA, 1301 bp, Homo sapiens
atggattcagaagctcaagaagacaccagagaagcctatgatgacaagcaggtggtcacagagatcatggcaagatgttttattccaactctgataacaactacttcctgggaaagttttcattttattggtcatgagattcgaattactgaggccatggattgttatggtgctgttgtttggccatcggcccttgttctatgctatttcctggaaacaaatgcaaagcagtataatatggttgacaaaaacgtgattgaaattggagctggaacagggctagtctccattgtggcaagtttacttggtgctcacgtgacggccacagatttacccgaattacttggaaacctgcaatataatatttcccgaaacaccaaaatgaaaagcaagcatttgcctcaggttaaagaactctcctggggagtagctttagatacaaacttccccaggtcttctaataattttgactatattttggcagcggatgtggtctacgctcatcctttcttggaagagctcctcattacctttgaccatctgtgcaaagaaaccaccatcatcctgtgggccatgaaattcaggttggagaaggaaaataaatttgtagatagatttaaggagttgtttgacctggaggaaatttccagtttccctagcctgaatattaagttgtataaagctgtgaagaaaaaccggaggagcgtatgacatcctcgatgaggatgtggaaatgctaaggcaatttttagcaaataatcactttaaagaaaaccctgaataactttatgtgccactgagtttcccaaggggaaatacacacacagatgcgcgcgcacacacacacacacacacacacacacacacacacacacacaaaaccccctactacaagaatagaagatagtttcccaaatttgcctcaccccaggcagtaatttttccagatactgcatgtgagtctaggattggggtaacttgttcctagtttgtctctatcagcacccaggccctgggcctgccttctactcatgcggtaatagaagctcttggcaaagtcacactgcactgttgttgtctgttctcctttttccttatatcatcatttattattattttaataatggtgcaattattatttttaatgtataatcacaaaatgatagtttttaataatatctcttcagtgaaacttgttattcttttaaacataagtgtagatgattctctctttagaaataatgaaattgactacagtgggatctgcaaataaatctgaacagacagatacataatgtaat

SEQ ID NO: 58114 - DNA, 1301 bp, Homo sapiens
atggattcagaagctcaagaagacaccagagaagcctatgatgacaagcaggtggtcacagagatcatggcaagatgttttattccaactctgataacaactacttcctgggaaagttttcattttattggtcatgagattcgaattactgaggccatggattgttatggtgctgttgtttggccatcggcccttgttctatgctatttcctggaaacaaatgcaaagcagtataatatggttgacaaaaacgtgattgaaattggagctggaacagggctagtctccattgtggcaagtttacttggtgctcacgtgacggccacagatttacccgaattacttggaaacctgcaatataatatttcccgaaacaccaaaatgaaaagcaagcatttgcctcaggttaaagaactctcctggggagtagctttagatacaaacttccccaggtcttctaataattttgactatattttggcagcggacgtggtctacgctcatcctttcttggaagagctcctcattacctttgaccatctgtgcaaagaaaccaccatcatcctgtgggccatgaaattcaggttggagaaggaaaataaatttgtagatagatttaaggagttgtttgacctggaggaaatttccagtttccctagcctgaatattaagttgtataaagctgtgaagaaaaaccggaggagcgtatgacatcctcgatgaggatgtggaaatgctaaggcaatttttagcaaataatcactttaaagaaaaccctgaataactttatgtgccactgagtttcccaaggggaaatacacacacagatgcgcgcgcacacacacacacacacacacacacacacacacacacacacaaaaccccctactacaagaatagaagatagtttcccaaatttgcctcaccccaggcagtaatttttccagatactgcatgtgagtctaggattggggtaacttgttcctagtttgtctctatcagcacccaggccctgggcctgccttctactcatgcggtaatagaagctcttggcaaagtcacactgcactgttgttgtctgttctcctttttccttatatcatcatttattattattttaataatggtgcaattattatttttaatgtataatcacaaaatgatagtttttaataatatctcttcagtgaaacttgttattcttttaaacataagtgtagatgattctctctttagaaataatgaaattgactacagtgggatctgcaaataaatctgaacagacagatacataatgtaat

SEQ ID NO: 58115 - DNA, 1471 bp, Homo sapiens
aacttgctggagtcgccttctgtgctgtggaagttttgttgttttgcttgtttgcaataaccgttgctgctgcttactgtttgggtccgcactgcctttatgagctgtaacgctcaccgtgaaggtctgcagcttcgttcttaaagccagccacatcacggacccaccgggagaaacgaataactccaaacacgccaccttaagagccgtagcactcatgatgaaggtccgtagcttcactcctgaagtcagcgagatcacgaatctgccagaaggaagaaactccgaacacatgcgagcatcagaagaaacaaacttgggacacgctgcctttaaaaactgtaacactcaccgccagggtccgcggcttcgttcttgaagtcagtgagaccaagaatccgccgattctggacacaccatgacggaactagatccttggcctttcggggcccagaacgctacggacgccgggcggccaggaggggttgggctcccgctccaccccggtccccggcgagcacgcggccaggcagagaaggtgcccggagctcagagcgcgcagagcccggccgctgggccgctgcctgagccagggaggcgcagcgcgagctcccacttcgtcttcatggattcccagcccagctgcgtggtggtgactggagctctccaagctgggcctggggaatgaaacagtggtgcagctgcggactctggagctgcctgtagattacagggaggctaagcggagggtcaccggaatctgggaagatcatcagccgcaactcgtcgtgcatgtgggcatggacaccgccgccaaggcgatcattctggaacagtctggcaagaaccaaggctaccgggacgccgacatccgcagcttctggcccgagggcggcgtgtgcctacctggcagcccagacgtgctggagtcaggggtctgcatgaaggcagtctgcaagcgcgtagctgtggagggtgtcgacgtgatcttttcccgagatgcaggcagatacgtctgtgattatacctattacctgtctctgcatcatggaaagggctgcgcggcactcatccatgtccctccactatcgcgcgggctcccggccagcctgctgggaagagccttgagagtcatcatccaggaaatgctggaagaggtgggaaagcccaagcacagagcccagttcgaagaaaactcaaccatggtccttccagccaaagggaactgaccgggggattgctcctctagagaaaattgaatgtttcaatcctgtatgtagcactcaactgtgcattgagaaactttttcaaaaattgcttgtaagacaaagagggtggaaaactctgaattagcccaacaaaatcacaaagggttattttattgtcaggagaaagaacactctgaaaggtggacatttcacaggggatgaactagcttcagttatggttttcatgacaataaaatgaaatc

SEQ ID NO: 58116 - DNA, 983 bp, Homo sapiens
agagaaggtgcccggagctcagagcgcgcagagcccggccgctgggccgctgcctgagccagggaggcgcagcgcgagctcccacttcgtcttcatggattcccagcccagctgcgtggtggtgactgcatgttttcaaggttgagccacgtggtagtgtgtccagaattggtgggttgttggtctcactgacttcaagaatgaagccgcggactctcgtggagctctccaagctgggcctggggaatgaaacagtggtgcagctgcggactctggagctgcctgtagattacagggaggctaagcggagggtcaccggaatctgggaagatcatcagccgcaactcgtcgtgcatgtgggcatggacaccgccgccaaggcgatcattctggaacagtctggcaagaaccaaggctaccgggacgccgacatccgcagcttctggcccgagggcggcgtgtgcctacctggcagcccagacgtgctggagtcaggggtctgcatgaaggcagtctgcaagcgcgtagctgtggagggtgtcgacgtgatcttttcccgagatgcaggcagatacgtctgtgattatacctattacctgtctctgcatcatggaaagggctgcgcggcactcatccatgtccctccactatcgcgcgggctcccggccagcctgctgggaagagccttgagagtcatcatccaggaaatgctggaagaggtgggaaagcccaagcacagagcccagttcgaagaaaactcaaccatggtccttccagccaaagggaactgaccgggggattgctcctctagagaaaattgaatgtttcaatcctgtatgtagcactcaactgtgcattgagaaactttttcaaaaattgcttgtaagacaaagagggtggaaaactctgaattagcccaacaaaatcacaaagggttattttattgtcaggagaaagaacactctgaaaggtggacatttcac

SEQ ID NO: 58117 - DNA, 983 bp, Homo sapiens
agacaaggtgcccggagctcagagcgcgcagagcccggccgctgggccgctgcctgagccagggaggcgcagcgcgagctcccacttcgtcttcatggattcccagcccagctgcgtggtggtgactgcatgttttcaaggttgagccacgtggtagtgtgtccagaattggtgggttgttggtctcactgacttcaagaatgaagctgcggactctcgtggagctctccaagctgggcctggggaatgaaacagtggtgcagctgcggactctggagctgcctgtagattacagggaggctaagcggagggtcaccggaatctgggaagatcatcagccgcaactcgtcgtgcatgtgggcatggacaccgccgccaaggcgatcattctggaacagtctggcaagaaccaaggctaccgggacgccgacatccgcagcttctggcccgagggcggcgtgtgcctacctggcagcccagacgtgctggagtcaggggtctgcatgaaggcagtctgcaagcgcgtagctgtggagggtgtcgacgtgatcttttcccgagatgcaggcagatacgtctgtgattatacctattacctgtctctgcatcatggaaagggctgcgcggcactcatccatgtccctccactatcgcgcgggctcccggccagcctgctgggaagagccttgagagtcatcatccaggaaatgctggaagaggtgggaaagcccaagcacagagcccagttcgaagaaaactcaaccatggtccttccagccaaagggaactgaccgggggattgctcctctagagaaaattgaatgtttcaatcctgtatgtagcactcaactgtgcattgagaaactttttcaaaaattgcttgtaagacaaagagggtggaaaactctgaattagcccaacaaaatcacaaagggttattttattgtcaggagaaagaacactctgaaaggtggacatttcac

SEQ ID NO: 58118 - DNA, 1471 bp, Homo sapiens
aacctgctggagtcgccttcagtgctgtggaagttttgttgttttgcttgtttgcaataaccgttgctgctgcttactgtttgggtccacactgcctttatgagctgtaacactcaccgtgaaggtctgcagcttcattcttaaagccagccacatcacggacccaccgggagaaacgaataactccaaacacgccaccttaagagccgtagcactcatggtgaaggtccgtagcttcactcctgaagtcagcgagatcacgaatctgccagaaggaagaaactccgaacacatgcgagcatcagaagaaacaaatttgggacacgctgcctttaaaaactgtaacactcaccgccagggtccgcggcttcgttcttgaagtcagtgagaccaagaatccgccgattccggacacaccatgacggaactagatccttggcctttcggggcccagaacgctacggaagccgggcggccaggaggggttgggctcccgctccaccccggtccccggcgagcacgcggccaggcagacaaggtgcccggagctcagagcgcgcagagcccggccgctgggccgctgcctgagccagggaggcgcagcgcgagctcccacttcgtcttcatggattcccagcccagctgcgtggtggtgactggagctctccaagctgggcctggggaatgaaacagtggtgcagctgcggactctggagctgcctgtagattacagggaggctaagcggagggtcaccggaatctgggaagatcatcagccgcaactcgtcgtgcatgtgggcatggacaccgccgccaaggcgatcattctggaacagtctggcaagaaccaaggctaccgggacgccgacatccgcagcttctggcccgagggcggcgtgtgcctacctggcagcccagacgtgctggagtcaggggtctgcatgaaggcagtctgcaagcgcgtagctgtggagggtgtcgacgtgatcttttcccgagatgcaggcagatacgtctgtgattatacctattacctgtctctgcatcatggaaagggctgcgcggcactcatccatgtccctccactatcgcgcgggctcccggccagcctgctgggaagagccttgagagtcatcatccaggaaatgctggaagaggtgggaaagcccaagcacagagcccagttcgaagaaaactcaaccatggtccttccagccaaagggaactgaccgggggattgctcctctagagaaaattgaatgtttcaatcctgtatgtagcactcaactgtgcattgagaaactttttcaaaaattgcttgtaagacaaagagggtggaaaactctgaattagcccaacaaaatcacaaagggttattttattgtcaggagaaagaacactctgaaaggtggacatttcacaggggatgaactagcttcagttatggttttcatgacaataaaatgaaatc

SEQ ID NO: 58119 - DNA, 3030 bp, Homo sapiens
atgccagtcccaagtacagctgtccctttgtatccttgggggatgggatccagtacctccaaaacaccagaatccacaaggccagagtccctgatacaaaatggcatgttatttgcatataaccccctcctctggacttaaatcacctcttgattacttataacacctgaaccctgtgaaccccaggcaatgacagcaggatcctgaagcccatgcaggctctgaaccacgcggccatccagaaggggctgcaggcacctgccactaccgcagaggactgaggggccttggcccagcagggaccccagggccttgggggactgtgtgagctggaaacgtggctggccagatgggcagcaccatggagccccctgggggtgcgtacctgcacctgggcgccgtgacatcccctgtgggcacagcccgcgtgctgcagctggcctttggctgcactaccttcagcctggtggcccaccggggtggctttgcgggcgtccagggcaccttctgcatggccgcctggggcttctgcttcgccgtctctgcgctggtggtggcctgtgagttcacacggctccacggctgcctgcggctctcctggggcaacttcaccgccgccttcgccatgctggccaccctgctatgcgcgacggctgcggtcctgtatccgctgtactttgcccggcgggagtgttcccccgagcccgccggctgtgctgccagggacttccgcctggcagccagtgtcttcgccgggctcctcttcctggcctacgctgtggaggtggccctgacgcgggcccggcccggccaggtgagcagctatatggccacggtgtcggggctcctcaagatcgtccaggccttcgtggcctgcatcatcttcggggcgctggtccatgacagccgctacgggcgctacgtggccacccagtggtgcgtggccgtctacagcctgtgcttcctggccacagtggccgtggtggccctgagtgtgatgggccacacagggggcctgggctgcccctttgactggctggtggtggtgtacaccttcctggctgtgctcctgtacctcagcgccgccgtgatctggccagtcttctgtttcgatcccaagtacggtgagcccaaacggccccccaactgtgctcggggcagctgtccctgggacagccagctggtggtggccatcttcacctacgtcaacctgctcctgtacgtcgttgacctcgcctactcccagaggattcgcttcgtgcccagcctgtagcccacagtggcagcccacccacctctgctctctggccaccagctccaggctctgcgagggaaactcaggtgaaccaaagtgtcaagtagcgagcaggagggaagccgcgggctcaggggagatgaagtacaacgggagaggtcgctccccgacttccagactgggctcagagggacaagggcaggacagtagggcagaggccctgagcagacgcaggggagagcctcacctaggccaatccccaactcactctctctcaccatttcccagcgctcctggggctcagtgctggtcactggaacatcataagggaaaactttaaagcagctgctgttgtgacccattttgcagctggggacatggaggctagaagcatttgcgaggcacccagtacctccattagtgtctggagaccacagtcaggctgggtaaggcaagctgaaagaggaatgacttccagaggagacgaacccaggagagtagctgggccaggcaaggggagggaggggcgtggggagccggaaccactcctggttcagagaggcagctcccagaaccctgggaagagagccctgcctggggagctgtgccagctcacagagaaggagccagaaatctggaccagcctctcccacccacgtccgggaagcctctgggctggtagccacagtgtttggaagcaggcttcctccggagtctccgcaggctggaggtggcgcgggtggcctggaagagcctgcagagcccggcggcaccgagtgcacagtggacggggaggacctggttccgccatagccacggagccccacctggacactcaccattggctgtgacgaagcagcttcagcagtgcccggcgggcatctgtgcactgtgggcatctgtggcactgggagggagcccggctgagggcggccgctggacacagaatctgggtactgcttgcctctgctcaagggtccagttgccgaaactcctgacgccggggccatcatcctccaggctccagccagcttctcctgcacagaagcccagcctggtccagccaggagctgacccactggccacccctgagtccaagccgggtgggcagtggcacaacagcccctcagcccattgactgggccccattgacgtccttgagcaggaaataaatgctgacatttatacgtaccctgcctctggaccagcagtctcttctgaggggactgtgggcacttgcccctcctggcggcccctcctagcgtgctctgggggaaggctgaggaaggaagtggcctgggatcacagtcagggcaggctgggctcctgagggtctgagcagcctcctggggaaggggcaggcagcgtcttctgcctcacaggggtgacaggccagcctggctccgacgggcctgtggctcatgcccgtccctcccagaggcccgcagcactcacctcctcccccacgcccatctgggggtctcgagaggccctggacacagcgatggacagacgcactgttgctccttttagacggcggtccccacagccaggcctgtgctgctgccatgaagaatgtgaggaaggggcctcactggccgctgaggaggggtctcgctcacgttagccaacaaacagggtccggccgacatcctttactcagagggggtgggtgttttggggtcaatggcagatcccagatgagggcagtcagctgttcagggcctgccgctggctgagggcgatacagagggggcatagggatcacctgcttc

SEQ ID NO: 58120 - DNA, 633 bp, Homo sapiens
atggctgggatcgccaccatggaggaagtgaagtgcaagatccaggttctgcagcagcaggcagatgatgcagaggagagagctgagcgcctccagtttgaagaggagctggaccatgctcaggagcgcctgaccactgccctgcaaaagctggaagaagaggagaaagctgctgatgagagtgaaagagatatgaagatggaactccaggaaatccaactcaaagaagctaagcatattgcagaagaggcagataggaaatatgaagaggtgcctcgtaagttggtgatcattgaaggagacttggaatgcacagaggaacgagctgagctggcagagtcccgctgccaagagacagatgagcagatcagactgatggaccagaacctgaagtgtctaagtgatgctgaagaaaaatactctcaaaaagaagacatatatgaggaagagatcaagattctcactgacaaactcaaggaggcagagacccgtgctgagtttactgagagattggtagccaagctggaaaagacaactgatgacttggaatataaactgaaatgcaacaaagaggagaacctctgtacacaaaggatgctgtaccagactctgcttgacctgaatgagatgtag

SEQ ID NO: 58121 - DNA, 633 bp, Homo sapiens; identical to SEQ ID NO: 58120

SEQ ID NO: 58122 - DNA, 633 bp, Homo sapiens; identical to SEQ ID NO: 58120

SEQ ID NO: 58123 - DNA, 1867 bp, Homo sapiens
agccctgagtgagggtgtgcagcctccttgggcaagaggatgcgggctctgggaggctgcgtcgcacatctccagtccccactgcagggcctctcaccggctggggcagtgacccctggtcggaagcacctcagtgctgctcatgattgcagaggtggcctcaccagatagagggtcctggagggcgtgggggcttggtctctgactgccagcaaaagaagccgacatagaggcagcaggcgacaaacactgaggcaactgacttgcccgaatttaaccctcaggttttttaaataaaatgcaagtgcaggggcttgggctcgggactcctggagccccgtggggctgagcgtggatggtgctcggtgtccagctacactcccaaaccgcatcccgagcgtttgcggggcggaggggccccagggcgacggttccagaacagacccaggcggctccggtcagcagcagccccgctgctttccaacagcgcggggacccccatccccgccagccccatctcactgtccctctcaggtcagaggagaccgtagaggaccgcgtggcaccaggagctgccaggaaccagggcgacctagaagaaaccgggaacctggcgtcccgcggggacgcagccccaggaaaggggctgccgccgccagcaagtgagctcagctcagcccgggcgtcccctccgcaacgaggcccggatccctgcttggctcccggagcccggactgtgccttccgcaaaacggctgcgctctagaaagtggcctccacagtgcacttcccggcagcatggagtcggcagtggcagcgtttctatccggctctgcggggctgggtgtgaacgggactctcccatcccgctgtcctccaggagccggacctctcaccccgaagactttgccgaagacgcggccccctggtcaggggcagaaaacagatccaggccgccccgctcctgctgggtggtggagaaggtggagggcgggcaggtgctaagtgctactgtgaaaataaaaatcatcataataaagaacgaatgggtttcgaatttgagctcagaggtgttgagcagcctgtgcgaggccacggagctcacaggaggaaggacccccatagagacagggacatctgacgagggagcgccctcctctggctggagggtggggcagcagcagcagcagccaggcttcagggaatggggtgaaatgagggccccgggggctccccaggtggaagaagcacaggtctggatgcaagttctggattcgcacaagggtgaggaaccagtgacccacccgaccacccctctgaaatgggtcaaggggaaccctggggcaggacaccctgctcagaagaagaggagcaagagtccaacgccgacacgtgtccacaaaggtcccctggtccaccaagagggagaaacttgtcaccaggcaacggtggcatacactgacacgcgagccaaggctcaccgctcgcgacaggtgtcccgcgactggcgcatgcgaatccgcgaggcaggtgctggggccaggctgtcagggctgtcagggctggcatcctcgggccgtctcattagtcgggtcccgctggaggaaaaggcgattcgagaatgtgaggtgggcgctgggaacttctctttggactccattcccgaaagagtctgtgtgcaagaatccggtcccagggagaagggaatacagtctggtgagttgttgagggatctccgggtgatggaatcatacctgagaccccagaggagggtgtcagtggaagactgtgaggcctttgagctcactgcctccgttcatccagggccccccagggagtcctgcttctcagcgcggctgtctgggtaa

SEQ ID NO: 58124 - DNA, 1867 bp, Homo sapiens; identical to SEQ ID NO: 58123

SEQ ID NO: 58125 - DNA, 1867 bp, Homo sapiens
agccctgagtgagggtgtgcagcctccttgggcaagaggatgcgggctctgggaggctgcgtcgcacatctccagtccccactgcagggcctctcaccggctggggcagtgacccctggtcggaagcacctcagtgctgctcatgattgcagaggtggcctcaccagatagagggtcctggagggcgtgggggcttggtctctgactgccagcaaaagaagccgacatagaggcagcaggcgacaaacactgaggcaactgacttgcccgaatttaaccctcaggttttttaaataaaatgcaagtgcaggggcttgggctcgggactcctggagccccgtggggctgagcgtggatggtgctcggtgtccagctacactcccaaaccgcatcccgagcgtttgcggggcggaggggccccagggcgacggttccagaacagacccaggcggctccggtcagcagcagccccgctgctttccaacagcgcggggacccccatccccgccagccccatctcactgtccctctcaggtcagaggagaccgtagaggaccgcgtggcaccaggagctgccaggaaccagggcgacctagaagaatccgggaacctggcgtcccgcggggacgcagccccaggaaaggggctgccgccgccagcaagtgagctcagctcagcccgggcgtcccctccgcaacgaggcccggatccctgcttggctcccggagcccggactgtgccttccgcaaaacggctgcgctctagaaagtggcctccacagtgcacttcccggcagcatggagtcggcagtggcagcgtttctatccggctctgcggggctgggtgtgaacgggactctcccatcccgctgtcctccaggagcgggacctctcaccccgaagactttgccgaagacgcggccccctggtcaggggcagaaaacagatccaggccgccccgctcctgctgggtggtggagaaggtggagggcgggcaggtgctaagtgctactgtgaaaataaaaatcatcataataaagaacgaatgggtttcgaatttgagctcagaggtgttgagcagcctgtgcgaggccacggagctcacaggaggaaggacccccatagagacagggacatctgacgagggagcgccctcctctggctggagggtggggcagcagcagcagcagccaggcttcagggaatggggtgaaatgagggccccgggggctccccaggtggaagaagcacaggtctggatgcaagttctggattcgcacaagggtgaggaaccagtgacccacccgaccacccctctgaaatgggtcaaggggaaccctggggcaggacaccctgctcagaagaagaggagcaagagtccaacgccgacacatgtccacaaaggtcccctggtccaccaagagggagaaacttgtcaccaggcaacggtggcatacactgacacgcgagccaaggctcaccgctcgcgacaggtgtcccgcgactggcgcatgcgaatccgcgaggcaggtgctggggccaggctgtcagggctgtcagggctggcatcctcgggccgtctcattagtcgggtcccgctggaggaaaaggcgattcgagaatgtgaggtgggcgctgggaacttctctttggactccattcccgaaagagtctgtgtgcaagaatccggtcccagggagaagggaatacagtctggtgagttgttgagggatctccgggtgatggaatcatacctgagaccccagaggagggtgtcagtggaagactgtgaggcctttgagctcactgcctccgttcatccagggccccccagggagtcctgcttctcagcgcggctgtctgggtaa

SEQ ID NO: 58126 - DNA, 1734 bp, Homo sapiens
gcctccctgcctgcttctggctgccttgaatgcctggtccttcaagctccttctgggtctgacaaagcagggaccatgtctacctttggctaccgaagaggactcagtaaatacgaatccatcgacgaggatgaactcctcgcctccctgtcagccgaggagctgaaggagctagagagagagttggaagacattgaacctgaccgcaaccttcccgtggggctaaggcaaaagagcctgacagagaaaacccccacagggacattcagcagagaggcactgatggcctattgggaaaaggagtcccaaaaactcttggagaaggagaggctgggggaatgtggaaaggttgcagaagacaaagaggaaagtgaagaagagcttatctttactgaaagtaacagtgaggtttctgaggaagtgtatacagaggaggaggaggaggagtcccaggaggaagaggaggaagaagacagtgacgaagaggaaagaacaattgaaactgcaaaagggattaatggaactgtaaattatgatagtgtcaattctgacaactctaagccaaagatatttaaaagtcaaatagagaacataaatttgaccaatggcagcaatgggaggaacacagagtccccagctgccattcacccttgtggaaatcctacagtgattgaggacgctttggacaagattaaaagcaatgaccctgacaccacagaagtcaatttgaacaacattgagaacatcacaacacagacccttacccgctttgctgaagccctcaaggacaacactgtggtgaagacgttcagtctggccaacacgcatgccgacgacagtgcagccatggccattgcagagatgctcaaagtcaatgagcacatcaccaacgtaaacgtcgagtccaacttcataacgggaaaggggatcctggccatcatgagagctctccagcacaacacggtgctcacggagctgcgtttccataaccagaggcacatcatgggcagccaggtggaaatggagattgtcaagctgctgaaggagaacacgacgctgctgaggctgggataccattttgaactcccaggaccaagaatgagcatgacgagcattttgacaagaaatatggataaacagaggcaaaaacgtttgcaggagcaaaaacagcaggagggatacgatggaggacccaatcttaggaccaaagtctggcaaagaggaacacctagctcttcaccttatgtatctcccaggcactcaccctggtcatccccaaaactccccaaaaaagtccagactgtgaggagccgtcctctgtctcctgtggccacacctcctcctcctccccctcctcctcctcctccccctccttcttcccaaaggctgccaccacctcctcctcctccccctcctccactcccagagaaaaagctcattaccagaaacattgcagaagtcatcaaacaacaggagagtgcccaacgggcattacaaaatggacaaaaaaagaaaaaagggaaaaaggtcaagaaacagccaaacagtattctaaaggaaataaaaaattctctgaggtcagtgcaagagaagaaaatggaagacagttcccgaccttctaccccacagagatcagctcatgagaatctcatggaagcaattcggggaagcagcataaaacagctaaagcgggtaagtaaccagagaacagacataggggcacagataaagtaa

SEQ ID NO: 58127 - DNA, 1734 bp, Homo sapiens; identical to SEQ ID NO: 58126

SEQ ID NO: 58128 - DNA, 4629 bp, Homo sapiens
aatggcaaagcttcgagaaatgctgcaccaaagccagcttggacaacttcacagctcagagggtacttctccagctcagcaacaggtagctctgcttgatcttcagagtgctttattctgcagccaacttgaaatacagaagctccagagggtggtacgacagaaagagcgccaactggctgatgccaaacaatgtgtgcaatttgtagaggctgcagcacacgagagtgaacagcagaaagaggcttcttggaaacataaccaggaattgcgaaaagccttgcagcagctacaagaagaattgcagaataagagccaacagcttcgtgcctgggaggctgaaaaatacaatgagattcgaacccaggaacaaaacatccagcacctaaaccatagtctgagtcacaaggagcagttgcttcaggaatttcgggagctcctacagtatcgagataactcagacaaaacccttgaagcaaatgaaatgttgcttgagaaacttcgccagcgaatacatgataaagctgttgctctggagcgggctatagatgaaaaattctctgctctagaagagaaagaaaaagaactgcgccagcttcgtcttgctgtgagagagcgagatcatgacttagagagactgcgcgatgtcctctcctccaatgaagctactatgcaaagtatggagagtctcctgagggccaaaggcctggaagtggaacagttatctactacctgtcaaaacctccagtggctgaaagaagaaatggaaaccaaatttagccgttggcagaaggaacaagagagtatcattcagcagttacagacgtctcttcatgataggaacaaagaagtggaggatcttagtgcaacactgctctgcaaacttggaccagggcagagtgagatagcagaggagctgtgccagcgtctacagcgaaaggaaaggatgctgcaggaccttctaagtgatcgaaataaacaagtgctggaacatgaaatggagattcaaggcctgcttcagtctgtgagcaccagggagcaggaaagccaacctggagaaaccgccacgagcagaatcccggaggccaataaagaccccaactttgcaagtcaggggcgcgagtggtctcgcttctcaggtccccagaggcaaccgatttctggcctcgagggtggggtgcggggtcagggtcctccacaggatacacgaggacgtgcccccgaagctgctcgtccctccaccccctgggatgccacagaacacccgccagcgagtttcttccccagcgcccaagagatgagggctgcgggcggcagcggcaagcgaggaatcgaacgcatggaacttaagccccggcggggccggaacacacgccctcccaaccccccaccccgcctcgccctccgtcgctcgcaacaaagcttgcgacagccgcagctcgacccagctgtgtacccgcgggtcccggactcaccgcccgcccggcctggcgcggcgccttcacctcggaaacgctgggtggacttcgctgtaaaccgtaacttcccatccagacggcagccgcgccgccgcgcctcggcccgctcctggcgccacaggtcgcccgtcccgcgttcccaaaagcaccgcgttcactcagaagctcacgctgcctcgcgacgctcacctacccctcccaatatcgccgctgtctcaaccgccgcccagcccatagcctgcggccagctggatcctcagggtcccgctcggcgccaccagcccttgaccctacaaatcgctgatttcccgggccacttgaactgcccctgccaggttaaaggggcagaagacacaccccctcgggggcccggagcgaccccgcgcttaggactgcaggcctggtgctgcagcaccgcccccgagtctgacttccaggcccgggcatggggtgcagacgcgcagacgtgggaaggcaacccccagctcccccgagagccctgctggctagggagaatttctgccccatgtatatggagaaaggaagaaatcagagtcagcgggcaaaaagagtataatttaacctgctgtctggaagccatctgtgaagggaatcacttttcttttctggacttgtttccaggtgcagctgcaggggatgacaccgaagatacaagcactgagttcactgacagtattgaggaggaggctgcacaccatagtcaccagcaagaaaatggtcccttaaaggtagattttgagcttctccttgttatgtccttggaaggtaaatttttgcctgacaccaagttcccttcctactccaagcattcatatgcttttcctaacagacacatcccaccttgtctttcttccaagttggatgctttgaatcgggaagtgatatatcgccttgcttttcgctggagaaggaagcgccagcctttaaactacttggcccaaacggaaaaggcaaggaggaacacagcgggaaagcctatggcgttccctggtggctaccccggggactgcactcatagatccgcgtgttccgagaagcctctgccatcccgaccccggagccgtgcagaaacccgcggctccaaagaaaaccggctagaacgcacaggaagcccagccagtgttcaggacactgcgagtggaagcccttacagcctggatgcctgtcaccaaatccctttgagcagtgacctgagccacctggtggcagaggtacgagctctgagagggcagctggagcagagcattcaggggaacaattgtctgcgactgcagctgcaacagcagctggagagcggtgctggcaaagccagcctcagcccctcctccattaaccagaacttcccagccagcactgaccctggaaacaagcagctgctcctccaagattcagctgtgtcccctccagtccgggatgttggtatgaattccccagctctggtcttccccagctctgcttcctctactcctggctcagaaacgcccataatcaacagagcaaatggcttgggtttggatacttctccagtaatgaagacccctcccaagctagagggtgatgctactgatggctcctttgccaataagcatggccgccatgtcattggccacattgatgactacagtgccctaagacagcagattgcggagggcaagctgctggtcaaaaagatagtgtctcttgtgagatcagcgtgcagcttccctggccttgaagcccaaggcacagaggtgctaggcagcaaaggtattcatgagcttcggagcagcaccagtgccctgcaccatgccctagaggagtcagcttccctcctcaccatgttctggagagcggccctgccaagcacccacatccctgtgctgcctggcaaagtgggagaatcaacagaaagggaacttctggaactgagaaccaaagtatccaaacaggagcgactccttcagagcacaactgagcatctgaagaacgccaaccagcagaaggagagcatggaacagttcatcgtcagccagctaaccagaacacatgatgttttaaagaaggcaaggactaacttagaggtgaaatccctaagggctctgccatgtactccagccttgtgacccttgccttccaggaaccatgcaagaagcgcagccaccagaagtccttaaaacagcaggaaaggtgggcctgtcccccttttgtgcagctacctatctgctgaggagcatctgggcctcattcctccaagtccacgggagggtccagaagagggagtcagagatgtatcctggtggagctgggagaaaggcagaaagcctttctgacggctatggaatacgattagccaaggtccacttggcccagcactaagaaaaagatgcgtagtttgcacagaaggttttgtgatcctgcctctcaacagccccagcagcttgggaactagcaagagcacatttcttgcctcatcagctgtcctgagatggaaaactcagtgaatataggaccctgattccgatgaaaggggcacgtggtcccaatgctggagctcctctggcaggttctaaaagcacactactgagcagcggtgccctgccggacactgctggcgggggctcagtgagcactactcacagatccacacctgaccctgttgggtcgagtcaggctgggccttggtctgcactgtagcacctgtgttctttgagttcacatcatgaatgtggtgacttcccagataccatctcaggcttaacctagcacatcctatttcttttcttctatgatatccaaattggactgacctcacttcaaagttgctgtcccattttgtcaccctatcttatctcggggaaattgcagactgatggccagaccaactctgttgaaattcttgcatagagcaaacctgtgctcatttttaagtggcatgggagaggccccaagcctagtaaagcctagtctgtgtcttcacagtgctggtagaatgtgtttgtgtgtataaatatatgatatagatttatatatgttgctatcgccatatattgaaggccaacataactggtggacagggtgggtgacagaaaatgaaagcctttttggtgattgttaaagcaagatgtgtataaagaaataaatagtttttctt

SEQ ID NO: 58129 - DNA, 729 bp, Homo sapiens
gccgatcggaggaggcaggaaccggagctctagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaagaatggaactccaggaaatccaactcagagaagctaagcacattgcagaagaggcagataggaagtatgaagaggtggctcgtaagttggtgatcattgaaggagacttggaacgcacagaggaacgagctgagctggcagaatccctttgccgagagatggatgagcagattagactgatggaccagaacctgaagtgtctgagtgctgctgaagaaaagtactctcaaaaagaagacaaatatgaggaagagatcaagattcttactgataaaataaaggaggcggagacccatgctgagtttgctgagagatcggtagccaagctggaaaagacaattgatgacttggaagataaactgaaatgcaccaaaggggagcacctctgtacacaaaggatgctggaccagactctgcttgacctgaatgagatgtagaacgcctcagtctcaccctgctgctgctcctccctctgaaccagactccgcctgaggccagcctgcccgaagctgacctttaattgagggctgatctttaactggaaggctgctttctcctttcg

SEQ ID NO: 58130 - DNA, 2134 bp, Homo sapiens
aggcggaagtaagggtgagaggaggctgcaacgccgatcggaggaggcaggaaccggagctctagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggtgggcccgggaacaggctgaggctgaggtggcctccttgaacgtgggatccagctggttgaagaggagctggaccgtgctcaggagcacctggctactgccctgcaaaagctggaagaagcggaaaaagctgctgatgagagtgagagaggtaagaaggttattgaaaaccgggccttaaaagatgaagaaaagatggaactccaggaaatccaactcagagaagctaagcacattgcagaagaggcagataggaagtatgaagaggtggctcgtaagttggtgatcattgaaggagacttggaacgcacagaggaacgagctgagctggcagaatccctttgccgagagatggatgagcagattagactgatggaccagaacctgaagtgtctgagtgctgctgaagaaaagtactctcaaaaagaagacaaatatgaggaagagatcaagattcttactgataaaataaaggaggcggagacccatgctgagtttgctgagagatcggtagccaagctggaaaagacaattgatgacttggaagataaactgaaatgcaccaaaggggagcacctctgtacacaaaggatgctggaccagactctgcttgacctgaatgagatgtagaacgcctcagtctcaccctgctgctgctcctccctctgaaccagactccgcctgaggccagcctgcccgaagctgacctttaattgagggctgatctttaactggaaggctgctttctcctttcgccgccccctccttccgccgcccgctccttccctgtgtctttttcaccaaactgtccgcctcttcccggagattccagctgggctagaggctgagcacctttggaaacaacatttaagggaatgtgagcacaatgcataatgtctttaaaaagtatgttgtgatgtacacattttgtaattacctcttttgttgttttgtagcaaccttttgtaaaacattccatataataccacagccctgaagcagcgatcgaatccctttctcacttttggaaggtgatttttcaccttaatgcatattcctctctccatggaggagaggaaaaggtataggcctgccttgctgagagccaaacagagcccagggagactccactatgggaagcctcattgctctgtacaaagtactagctaagccagaaaggtggttccaggaggagttagccaaacaacaacaacaaaaaatgtgctgttcaagttttcagctttaagatacctttggataatgttatttctattttttatttttttcattagaagtgaccaaattaagatggcaagacctctgagaccaaaattttgttccatctctaccccctcccaactgcttacagaatggatcatgttccccttatgttgaggtgagcacttaattgcttttcttgcctccttgaaagaaagaaagaaagaaagaagattgtgtttttgccactgatttagccatgtgaaactcatctcattacccttttctgagtttgaagctgctgtctctacaagtgccatctcattgtgctttgtatcagtcagtgctggagaaatcttgaatagcttatgtacaaaactttttaaattttatattattttgaaactttgcttctttgggtttgtggcaccctggccaccccatctggctgtgacagcccctgcagtccgtgggctggcagtttgttgatcttttaaagtttctttccctaccctgtccccattttctggtaaggtttctaggaggtctgttaggtgtacatcctacagcttattggcttaatatgtactctcctttgatgtggtctacttggggccgattgggagaaagagaaatcaatagtgcaactgttttgataatgaatattgacaagtgtctttttgaaataaagaaccagtccttcaaaaaaaaaagac

SEQ ID NO: 58131 - DNA, 1413 bp, Homo sapiens
actgggggtggaagaggaatgaacaagtccaccccagcgtaaaaataagatgaaaatataaaagaatgtcagtgttgaaggttactccttttgattttgccaatatcccggaaccatgtgagcacatgaacattccaaagaagaagatacctccaggttcttcagatgagtctcactctgttgcccaggctggaatacactggcaccgtctcagctcactgcaacctccgactccctggttcaagcgattctcctgcctcagcctcccaagtagctgggattacagtttctctaaggcaatcagactgcagaacctagtcctcttgtgtgcccagaaagaaaatgaaaaggacttcaagaaccactcaggattgtccctgctacaggaaataaggagaggctttctggaagaggaagaaattaatcaagcctagaaagattaagatttatcaggattagcaatcaactgagcagtggaattttatgaaatgcctgaagataagaatatggaatgctcactccacaacattgtttgtgaaaatcttcagatttattttattgaacaaggctataaaagtatttacagaggagagggaaagagagcacagtggagagatgccttgggagagagctgttactggccatggtgtcattcttcttccacagggagaagcagatccaaactgagaagggagaagatgtgatagttgatatcacaacaagcttgagttttgattaatatcttggacaggacattctatgttccaaatagagattgtgtgttacaaagtgactgcaggaccaaaaatgagtagcaaattcatgaacctcttagatttttttaatttaggacatgatgagattactgccagtgactcaacttttaaaatacaaggaataactaaataaataaagtaaaattgcacttttaattgtattttgaagacatcatgagctgtgattcattcacttcatctcatagaacttctgctggtgataattatatttaatattgttacaatcaccccttcctctcaacttgttgtgatgtatgtccccccagcctccttctgaaaggtgagttaacacagcttattagggtgttacattagaatcactgttttggaaaagccaagcatggtgtgggcttctggtgtcagatgtgaatgtgagagatgaacagccaagctctgcaaatgaaacacagcctcactcatcccccttccctcacatgcaccaccgccccatcttcaaagtcagggctgcctcagcatgtcacaggaggcaggtaatgtcatcttgtaaacaccagcgatgagcatgagccgagacccccagcagcagaggatataaaccgtcctcctgaagcaggatttaattacattctccgtcaggaaaggaagttggatttgc

SEQ ID NO: 58132 - DNA, 1413 bp, Homo sapiens; identical to SEQ ID NO: 58131

SEQ ID NO: 58133 - DNA, 2519 bp, Homo sapiens
atggctttgcagagcactctgggggcggtgtggctagggcttctcctcaactctctctggaaggttgcagaaagcaaggaccaagtgtttcagccttccacagtggcatcttcagagggagctgtggtggaaatcttctgtaatcactctgtgtccaatgcttacaacttcttctggtaccttcacttcccgggatgtgcaccaagactccttgttaaaggctcaaagccttctcagcagggacgatacaacatgacctatgaacggttctcttcatcgctgctcatcctccaggtgcgggaggcagatgctgctgtttactactgtgctgtggaggacacagaggcagggaacccatgaagagctgaacagaaacagagatcacagcctttgcaggaggcaaaacagagatgagcaataactttttcctccttaattcagtattacccaagctttttcatttggtactgctattaggaaaaaaaattgagtccagacatactatatattaacaaatgtctataaaaatatgcttttaatttttttttgagacacagtcttgctctgtcatacaagttggagtgcggtggcatgagcatagctcattgtaacctcaaactccagggctcaagggtagctgggactcagccttctgactaggtgagactataggcatgtaccaccatgcctagtgaattttcctcctttttgtagacacgagttctctctgtgtcatccagactggtctcaaactcctggcttcaagtgattctcctgctttggcctccaaaagtgttgggattacagatgtgagccaatgcacctggaccagaaaatatgtttttaaagggtgattatttcaaatagtcttcctgatatctgaaacacttttgactcattttcttgagatctgattagattatttttgtttttccctcataaaatggctgatgatgaacttgtgatagtatgcagtggcatgatcatagctcactgcggccttgaacttctggcctccagtgatcctcctgccttgacctcccaaagcactgggattataggtgtgagccaccaaggccagtcaactctttcattttcttattgctgtctgtgcttaccttttaaatactatctgctaacttcagtctttttgcagcaatattttcaaaacatgtcaatttgtaaaggatggtttagttaacattgggtaatgtaataagaagtgagaaaggaaggaataaatgagtggctgatacctacagccctgcatttgaaatctcaatccgtgcctcagtatactttgcttataatctagcatacagtcctgttgagggtgccagtcaatgagtatatgaaatattagtcaaactgaatctccttcataatatttaaactaaaaacaaatgcaaatggaagtatttgtactcattgcaatgcattcttcccacactcctgttaattagcttggtcctcccaccccagatgtgtccctcccactttagagaccaatgccttagggtagcccagtggttcttaatatattttatcctcctagatcggaagttttgtgaaaattggatttgttttcttggggggccatattctagataaactcaatcagagtttgcaggggtgggacccagaagtctatattttccataaagctctgctggtgattgttttgctcagccagggttgatctgtgaatttcagattttggaccccaggtgtattactccattctcacgctgcaataaagaaatacccaagactgggtaatttataaagaaaagaggtttaattgacttacagttctgcatggctgggaaggtctcaggatacttacaatcatgatggaaggcaaaggggaagaaaggcaccttcttcacagggcagcaggaaggagaagtgccagcaggggaagtgccagacacgtataaaaccatcagatctcgcaagaactcattcactatcatgagaacagcatgggggatgccatctccatgattcaattacctcccaccgggtccctcccacaacatgtggggattattacaattcaaggtgagatgtggatggggacacacagccaaaccatattaccaggtcttgaggctttaaccactattctctacttccttttaggtagaattttagtaacagagaagggcttcaggaagtgaactgtacagtgctattgcttgcttacacagtagactttcagcaaatgctgacatttggaataaaaagtgaagggcaagatgggcacgatgggttatacctgtaatcccaacatttgggaggcggaggtgagaggatcccttgagcccaggagttcgagaccagcctagtcaacatagtgagaccctgtctttacaaaaaataggaaaaattagcctggtgtgttggcatgtgcctgtagtctcagctacttgggaggctaaggtgggaggattgattgagccagggaggttaaggctgcagtgagccatgagggcaccattgcactccagcctggg

SEQ ID NO: 58134 - DNA, 729 bp, Homo sapiens; identical to SEQ ID NO: 58129

SEQ ID NO: 58135 - DNA, 972 bp, Homo sapiens
aggcggaagtaagggtgagaggaggctgcaacgccgatcggaggaggcaggaaccggagctctagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggtgggcccgggaacaggctgaggctgaggtggcctccttgaacgtgggatccagctggttgaagaggagctggaccgtgctcaggagcacctggctactgccctgcaaaagctggaagaagcggaaaaagctgctgatgagagtgagagaggtaagaaggttattgaaaaccgggccttaaaagatgaagaaaagatggaactccaggaaatccaactcagagaagctaagcacattgcagaagaggcagataggaagtatgaagaggtggctcgtaagttggtgatcattgaaggagacttggaacgcacagaggaacgagctgagctggcagaatccctttgccgagagatggatgagcagattagactgatggaccagaacctgaagtgtctgagtgctgctgaagaaaagtactctcaaaaagaagacaaatatgaggaagagatcaagattcttactgataaaataaaggaggcggagacccatgctgagtttgctgagagatcggtagccaagctggaaaagacaattgatgacttggaagataaactgaaatgcaccaaaggggagcacctctgtacacaaaggatgctggaccagactctgcttgacctgaatgagatgtagaacgcctcagtctcaccctgctgctgctcctccctctgaaccagactccgcctgaggccagcctgcccgaagctgacctttaattgagggctgatctttaactggaaggctgctttctcctttcgccgccccctccttccgc

SEQ ID NO: 58136 - DNA, 3030 bp, Homo sapiens
atgccagtcccaagtacagctgtccctttgtatccttgggggatgggatccagtacctccaaaacaccagaatccacaaggccagagtccctgatacaaaatggcatgttatttgcatataaccccctcctctggacttaaatcacctcttgattacttataacacctgaaccctgtgaaccccaggcaatgacagcaggatcctgaagcccatgcaggctctgaaccacgcggccatccagaaggggctgcaggcacctgccactactgcagaggactgaggggccttggcccagcagggaccccagggccttgggggactgtgtgagctggaaacgtggctggccagatgggcagcaccatggagccccctgggggtgcgtacctgcacctgggcgccgtgacatcccctgtgggcacagcccgcgtgctgcagctggcctttggctgcactaccttcagcctggtggcccaccggggtggctttgcgggcgtccagggcaccttctgcatggccgcctggggcttctgcttcgccgtctctgcgctggtggtggcctgtgagttcacacggctccacggctgcctgcggctctcctggggcaacttcaccgccgccttcgccatgctggccaccctgctatgcgcgacggctgcggtcctgtatccgctgtactttgcccggcgggagtgttcccccgagcccgccggctgtgctgccagggacttccgcctggcagccagtgtcttcgccgggctcctcttcctggcctacgctgtggaggtggccctgacgcgggcccggcccggccaggtgagcagctatatggccacggtgtcggggctcctcaagatcgtccaggccttcgtggcctgcatcatcttcggggcgctggtccatgacagccgctacgggcgctacgtggccacccagtggtgcgtggccgtctacagcctgtgcttcctggccacagtggccgtggtggccctgagtgtgatgggccacacagggggcctgggctgcccctttgaccggctggtggtggtgtacaccttcctggctgtgctcctgtacctcagcgccgccgtgatctggccagtcttctgtttcgatcccaagtacggtgagcccaaacggccccccaactgtgctcggggcagctgtccctgggacagccagctggtggtggccatcttcacctacgtcaacctgctcctgtacgtcgttgacctcgcctactcccagaggattcgcttcgtgcccagcctgtagcccacagtggcagcccacccacctctgctctctggccaccagctccaggctctgcgagggaaactcaggtgaaccaaagtgtcaagtagcgagcaggagggaagccgcgggctcaggggagatgaagtacaacgggagaggtcgctccccgacttccagactgggctcagagggacaagggcaggacagtagggcagaggccctgagcagacgcaggggagagcctcacctaggccaatccccaactcactctctctcaccatttcccagcgctcctggggctcagtgctggtcactggaacatcataagggaaaactttaaagcagctgctgttgtgacccattttgcagctggggacgtggaggctagaagcatttgcgaggcacccagtacctccattagtgtctggagaccacagtcaggctgggtaaggcaagctgaaagaggaatgacttccagaggagacgaacccaggagagtagctgggccaggcaaggggagggaggggcgtggggagccggaaccactcctggttcagagaggcagctcccagaaccctgggaagagagccctgcctggggagctgtgccagctcacagagaaggagccagaaatctggaccagcctctcccacccacgtccgggaagcctctgggctggtagccacagtgtttggaagcaggcttcctccggagtctccgcaggctggaggtggcgcgggtggcctggaagagcctgcagagcccggcggcaccgagtgcacagtggacggggaggacctggttccgccatagccacggagccccacctggacactcaccattggctgtgacgaagcagcttcagcagtgcccggcgggcatctgtgcactgtgggcatctgtggcactgggagggagcccggctgagggcggccgctggacacagaatctgggtactgcttgcctctgctcaagggtccagttgccgaaactcctgacgccggggccatcatcctccaggctccagccagcttctcctgcacagaagcccagcctggtccagccaggagctgacccactggccacccctgagtccaagccgggtgggcagtggcacaacagcccctcagcccattgactgggccccattgacgtccttgagcaggaaataaatgctgacatttatacgtaccctgcctctggaccagcagtctcttctgaggggactgtgggcacttgcccctcctggcggcccctcctagcgtgctctgggggaaggctgaggaaggaagtggcctgggatcacagtcagggcaggctgggctcctgagggtctgagcagcctcctggggaaggggcaggcagcgtcttctgcctcacaggggtgacaggccagcctggctccgacgggcctgtggctcatgcccgtccctcccagaggcccgcagcactcacctcctcccccacgcccatctgggggtctcgagaggccctggacacagcgatggacagacgcactgttgctccttttagacggcggtccccacagccaggcctgtgctgctgccatgaagaatgtgaggaaggggcctcactggccgctgaggaggggtctcgctcacgttagccaacaaacagggtccggccgacatcctttactcagagggggtgggtgttttggggtcaatggcagatcccagatgagggcagtcagctgttcagggcctgccgctggctgagggcgatacagagggggcatagggatcacctgcttc

SEQ ID NO: 58137 - DNA, 1020 bp, Homo sapiens
cccagatgatcttcaagctccgggccctggacctcacccagtggctcatggtcctcaagatctcactgccagtcattgggctcgacgaaatcctcaagttcgttgctcggaactacctagagggataactgttccccctcctccatctctgagcccgtgtcacagatccagaagatgaaagaaggaagtgaacatccttttgctctgtcctccccaccccgatagtgacacatcttcaggcagagctgtggcacagacccccgtcctgtcccccacacccgtgtcatgtgtctgtttataaacatgtccccttccctttccttccccctcggccacccgcctccctctcaaccttgtaaattccccttcccaaccccgaggggcttgcagggacaaggcgaccgactgcgctgagctgcttatttattgaaaataaacgacggaaaagtctggccttgcctctgtgcaagcttggaggcctgggtcgccgctgtggacaagcgtcttagtgtcatgcagaccagaaggcagctgcctgtcccagggccggggcccacctcactgcctctgatggggactcccagcccccatggctccgctgtgccctgggcaggggacgggctgggggcaggggagggctggagcccaggaggcagcacagcagccagaaagccgcaggcctgagcctgcacctttggttccgggaggggcttgggcccctcacccaggtgtgatccctgagaacaggaggcccagccaccctgggaggaggcgctggagggcggggcggtggtggcccccgtcagtcccctcaaccccagtctcagggacggtggaaaagccatccaagaccccagagcgaggcctcatggttcaggagtggggaaaggcgtctttcccagggtgggggtggggatatcctgacccctcaggtgtccttgatgtccctgacgtccgtgagtggcgcctcatccatgatgctgcgcacttgctccagggtctcagcctggcggatccgct

SEQ ID NO: 58138 - DNA, 1131 bp, Homo sapiens
atgctggaccctccgcgcaaggaggtcacgggctccatccagctgtgccgtgacgccgggatccgggtgatcatgatcactggggacaacaagggcacagccattgccatctgccggcgaattggcatctttggggagaacgaggaggtggccgatcgcgcctacacgggccgagagttcgacgacctgcccctggctgaacagcgggaagcctgccgacgtgcctgctgcttcgcccgtgtggagccctcgcacaagtccaagattgtggagtacctgcagtcctacgatgagatcacagccatgacaggtgatggcgtcaatgacgcccctgccctgaagaaggctgagattggcattgccatgggatctggcactgccgtggccaagactgcctctgagatggtgctggctgacgacaacttctccaccatcgtagctgctgtggaggagggccgcgccatctacaacaacatgaagcagttcatccgctacctcatttcctccaacgtgggcgaggtggtctgtatcttcctgaccgctgccctggggctgcctgaggccctgatcccggtgcagctgctatgggtgaacttggtgaccgacgggctcccagccacagccctgggcttcaacccaccagacctggacatcatggaccgccccccccggagccccaaggagcccctcatcagtggctggctcttcttccgctacatggcaatcgggggctatgtgggtgcagccaccgtgggagcagctgcctggtggttcctgtacgctgaggatgggcctcatgtcaactacagccagctgactcacttcatgcagtgcaccgaggacaacacccactttgagggcatagactgtgaggtcttcgaggcccccgagcccatgaccatggccctgtccgtgctggtgaccatcgagatgtgcaatgcactgaacagcctgtccgagaaccagtccctgctgcggatgccaccctgggtgaacatctggctgctgggctccatctgcctctccatgtccctgcacttcctcatcctctatgttgaccccctgccggtgaggtttcttccgcccagggccgcccaccccagcactggggagcccacggcgggcccatga

SEQ ID NO: 58139 - DNA, 2436 bp, Homo sapiens
gggaccagactgggtgcagggccttgggagctgccagcctccttcccactgggcttccgcagaactgggactctcacttcaggggccaccacatccctcctctctgcttctccccccagatcaaagggtaccctcccacggttggcagggcctggctgagtgcctctagcaccctttgtgccaccacaggcggtcccaggaagggcagcaaggtcagaccattcctcattgaaaaccgtggctagggcacagggctctgatctgaaggagtgacaggtgcgtcacaacactgcctaaggctctccctctcaatgctgggaccctcgccccactcccagtggcagccaaaccagcaatatccaacagacataggccccctacgggacagtgtgggcccccagatataagatggataccccccgcacctgcagtaaagcatcccaaagccaaatgctcaattgcatcctgtctgcagctgggactttggagggtaatggctgggcagacagtaaagttgatcatctgttttctcggggtggcagacgcagccatgtcttggtatcaccacccatgtgacagctactcctgcacaactgggacaaatgtcagggccagagccatgaaggtgtggtaccccttgatcagcttctccacgtcctggccccaggtcttggcggggagggggtcacatgagtacagaggtcaaatatctaccaccctccagccctgagcaccagaagctctgcaaccaacgtccccaggaatggccttccccttgctgctcaggtcatacttctggaggaagagaaagctcattccatattttccccaccactctactccgaaagcaacacagttctggcccagtatcaaactagggttaggtccaagagagcagtcaagcgggtcgggggtgggggggagggcggagggcagcaggcattttcccccaaggaaaccatgaaagtccccagggcctgcagtcaagtttctatcaccttccccgtgagaaggaccttagttccatggagatgaagtgggtgaggttcaggtagaagccacaggggcaggcatccagaatgaggccccctgaggaaccctgagtgctgaccagtgccggcagaaatcagttccaccctgtggccctgacactatatgtcagggtgacaccaactgcagcaggcaggagccacaggaaggaagacgtcatccgatggagcctgacatccccaggttcccgccctggtgagcaaggtcttcatttggctttggtacatatgaccctatacagggaacctagtgtgtatcactcaccagcctctttctgtatctggggaaaccaaggcagtgaggtgactgcactcacctagcaataaagtaggcctttggtgcacttgcaggcatgtcctcctctggggcagagagcaggttccttgctgaagggcagatggtggcaaacatctccctcaactgtttccctgggccagtctttagggagcctagggacaagggcccaccctcccccttccacgtgtgccaaatcagcacctgaagtgaggcatttccagcaagcaactccacagacccgagaaaggaagggctctagtggaagagctagcatctcaccaccccaggtcccctggcctggtccagggcagccagctgcatgtgaccattctgttgccagctccccacacatccctcctgtcacccaggctccaagacattcgaccaactagactgaaaatgcaggcatccagctttgggagaccctgtgtgtgccacaccagggctaagctctcccagtgccctagcaaggtctttttttttttttctctccttattctactctacagtcttttgacagtattcccaaacgaggttgacacagctccagtccacaccagcataccaggcttccttcccagggcagtttagaggaagctccttctgggcaaggtcaggcggtcctccttccctctctccttcccctttgtcccagcctcaactgactctggctgtgggaggtgtggagggtccttaggcttccctccccaacctggcctccaccaacacccctaacaggaggcccgtggaaggctcagcctctcctccgcatccctcctccttcctgcctatcggagggagccagggtcccctaggctgaccctgaatcctcttcctcccttcatgggaggggggcaggaatccagaggaggatgaagccagcgggaccacatggcttggtggcttggacaaacaagctcagggaggaaatgaggaggcggcggctgcagaggaatgcaaccctgttgggcacagaccatgcaatctggggctggccctggggccagctgggtcctgtcctccacctgctcaaccgtgcttccaccaaccagaggaaacccatttactagtttttctaataaatcaata

SEQ ID NO: 58140 - DNA, 2436 bp, Homo sapiens
gggaccagactgggtgcagggccttgggagctgccagcctccttcccactgggcttccgcagaactgggactctcacttcaggggccaccacatccctcctctctgcttctccccccagatcaaagggtaccctcccacggttggcagggcctggctgagtgcctctagcaccctttgtgccaccacaggcggtcccaggaagggcagcaaggtcagaccattcctcattgaaaaccgtggctagggcacagggctctgatctgaaggagtgacaggtatgtcacaacactgcctaaggctctccctctcaatgctgggaccctcgccccactcccagtggcagccaaaccagcaatatccaacagacataggccccctacgggacagtgtgggcccccagatataagatggataccccccgcacctgcagtaaagcatcccaaagccaaatgctcaattgcatcctgtctgcagctgggactttggagggtaatggctgggcagacagtaaagttgatcatctgttttctcggggtggcagacgcagccatgtcttggtatcaccacccatgtgacagctactcctgcacaactgggacaaatgtcagggccagagccatgaaggtgtggtaccccttgatcagcttctccacgtcctggccccaggtcttggcggggagggggtcacatgagtacagaggtcaaatatctaccaccctccagccctgagcaccagaagctctgcaaccaacgtccccaggaatggccttccccttgctgctcaggtcatacttctggaggaagagaaagctcattccatattttccccaccactctactccgaaagcaacacagttctggcccagtatcaaactagggttaggtccaagagagcagtcaagcgggtcgggggtgggggggagggcggagggcagcaggcattttcccccaaggaaaccatgaaagtccccagggcctgcagtcaagtttctatcaccttccccgtgagaaggaccttagttccatggagatgaagtgggtgaggttcaggtagaagccacaggggcaggcatccagaatgaggccccctgaggaaccctgagtgctgaccagtgccggcagaaatcagttccaccctgtggccctgacactatatgtcagggtgacaccaactgcagcaggcaggagccacaggaaggaagacgtcatccgatggagcctgacatccccaggttcccgccctggtgagcaaggtcttcatttggctttggtacatatgaccctatacagggaacctagtgtgtatcactcaccagcctctttctgtatctggggaaaccaaggcagtgaggtgactgcactcacctagcaataaagtaggcctttggtgcacttgcaggcatgtcctcctctggggcagagagcaggttccttgctgaagggcagatggtggcaaacatctccctcaactgtttccctgggccagtctttagggagcctagggacaagggcccaccctcccccttccacgtgtgccaaatcagcacctgaagtgaggcatttccagcaagcaactccacagacccgagaaaggaagggctctagtggaagagctagcatctcaccaccccaggtcccctggcctggtccagggcagccagctgcatgtgaccattctgttgccagctccccacacatccctcctgtcacccaggctccaagacattcgaccaactagactgaaaatgcaggcatccagctttgggagaccctgtgtgtgccacaccagggctaagctctcccagtgccctagcaaggtctttttttttttttctctccttattctactctacagtcttttgacagtattcccaaacgaggttgacacagctccagtccacaccagcataccaggcttccttcccagggcagtttagaggaagctccttctgggcaaggtcaggcggtcctccttccctctctccttcccctttgtcccagcctcaactgactctggctgtgggaggtgtggagggtccttaggcttccctccccaacctggcctccaccaacacccctaacaggaggcccgtggaaggctcagcctctcctccgcatccctcctccttcctgcctatcggagggagccagggtcccctaggctgaccctgaatcctcttcctcccttcatgggaggggggcaggaatccagaggaggatgaagccagcgggaccacatggcttggtggcttggacaaacaagctcagggaggaaatgaggaggcggcggctgcagaggaatgcaaccctgttgggcacagaccatgcaatctggggctggccctggggccagctgggtcctgtcctccacctgctcaaccgtgcttccaccaaccagaggaaacccatttactagtttttctaataaatcaata

SEQ ID NO: 58141 - DNA, 2925 bp, Homo sapiens
tcggaactcgcctggggcgccgccggcggcggagggagcgtgactgcgctgcgcagggcgctaggaggcattgtcgccgctcaggcccttttgtgagaagcagaccagcctgggggctggcggcaggacacctgtgtctgcatgctgaagaagatgggtgaggccgtggccagagtagcaaggaaggtcaacgagacggtggagagcggctctgacactctggacctggccgagtgcaagctggtctcctttcccattggcatctacaaggtcctgcggaatgtctctggccagatccacctcatcaccctggctaacaacgagcttaagtccctcaccagcaagttcatgaccacattcagtcagctccgagatgtgcccgtggagaagctggccgccatgccagccttgcgcagcatcaacctccgcttcaacccactcaacgccgaggtgcgcgtgatcgccccgccgctcatcaagtttgacatgctcatgtctccggaaggcgcaagagcccccctaccttaggccaccctcctcatgcccacccagcaaggggcagaggccacaggcctggaaccctggaagggagggaggcccatgggaggccaagcctgggggctgggggcgggtgggccgagcagcacgtggtgggtggggtgcagctggtctggatagatagcttacagcagtagtgggctctggaatgcccaagggaagaggcaaggtggggcctgcagcctggactcggcactcacagctgctgtgcaaactcaggcagatctcctgccctctctgagccttgtcacttgaaaaaaacaggaccctttccctcctttgggctccctggaggtttttaagcagtacgtgcctccaagttacctccagatcagcaggcacaggtgggcattgccaggtattttctgagcccctgcgggtttgaggccttgtttttagtgctgagagccagttgctgccctgagaagagaagacaacctccatctatttattgcttcctgagaactgacctggatgcggccctctgcagggcccagtcttcagtcctgtggtccctggactggtgggaacctgaactaggagtcctgggagagctgtggtgggaatatgggctggcactgctgcagggcaagaacattcatgtaggagcccgaggaccagcaggctgggaatggggagcaagtcacgtcagctctgtcattccccacagttaacaaattggcggggtgggaagtcctgagtgctccgtccctctagcatcactcctgagctgcgggagaggtggcccagagaacagcagagtcagttacacctgcagctcttgtctaaagtgattagatggccaccctcaccactgtccagtccagcagcagcctggctgccttgtcatggcctcctgggggcagaaggcgatgtggaccacgggatttgtagccagccagctcccaggccaacgcccaaagccctgatgacctggttcttctgaggccctcaacctggcatcttagggtatggtcaggcaacagggtgaccagctgtcctggtttcccaggacatggaactttcaatgctaaaactgggacagtacccagcaagtggggatggttggtcccctaccaggagagggcctggggctcttgcttcccgagaacgcctgtggcttgaagaaccttgactgcttggtcctcaggtatctacctcccaccttctcctcatctgtggagcaagccaactcagtgccccagaccccacctgatctgcatctttgtttgcatctccagagacacctgaggccccagagcttgaggcaaagccaggccgtccaaatcctgtgtgccgtggacgagtggccactttactactcctaaggctaagatgttgagagctcagaccactgctcagagcagtaatccctgctcagaatgctcccagttccctcgtccctgcccaggtctcttgtctcttgggaaggaactgataggtcgggccattgttgggccatcactgagcgctcagtatctcaagagactctgttcattctgctcgtatcccaaggcctggttggtcaaactctgggcaaagggttttcaggatgaggaggtcaagacaggatctccagagctaccgagttcatctgtgggtgttgggggcaagtgggggctgaagtcctgtgcaggctgcgctggccccacctgccttgtgccctggagtggggtttctccttgttgaagaagaggcatccttctctgatgtgcacaaacacaatgtatgaccagagccttgcaactcaaagtgtggtctgtggaccagcagcggcagtgacacctgggagcttgttaggaatgcagagtctaggcctcaccctatacctcccgactcagaccctgcattttagcaagacccccagctgattcctataagcactttagagtttgagaagcaaggacctaggctggggatgtcctccgagcagagggtgaagtttctctcagttctctccctgccacttccagggatctgagcctgtgctcagcctcctccctaacccaccctgggagacacttggcctgttagattgttccagagtctgcatggcactcctgaagaagggagtgtgacctgcagtcaccaggagatgagggttaggtgtgcccagccctccagacccggcctttctggttaacccctgcatgccaagctgcctgctgccccaggtcctcacctcaggcctttgaaggggcagcttctggaagttgttttctcctctgcttggagagtttgcccttgtctgtcttggaaagtgtgggcagccacagatgcccccaaatcagagctcacagtgagtgagcccctaagcttcagtctgcaataaagaatgcattggtttcatcaaaaaaaaaaaaaaaa

SEQ ID NO: 58142 - DNA, 2945 bp, Homo sapiens
tcggaactcgcctggggcgccgccggcggcggagggagcgtgactgcgctgcgcagggcgctaggaggcattgtcgccgctcaggcccttttgtgagaagcagaccagcctgggggctggcggcaggacacctgtgtctgcatgctgaagaagatgggtgaggccgtggccagagtagcaaggaaggtcaacgagacggtggagagcggctctgacactctggagctccacctggaggggaacttcctacaccgcctccccagcgaggtcagtgccctgcagcacctcaaggccattgacctgtcccggaaccagttccaggacttccctgagcagcttaccgccctgccggcgctggagaccatcaacctggaggagaacgagatcgtagatgtgcccgtggagaagctggccgccatgccagccttgcgcagcatcaacctccgcttcaacccactcaacgccgaggtgcgcgtgatcgccccgccgctcatcaagtttgacatgctcatgtctccggaaggcgcaagagcccccctaccttaggccaccctcctcatgcccacccagcaaggggcagaggccacaggcctggaaccctggaagggagggaggcccatgggaggccaagcctgggggctgggggcgggtgggccgagcagcacgtggtgggtggggtgcagctggtctggatagatagcttacagcagtagtgggctctggaatgcccaagggaagaggcaaggtggggcctgcagcctggactcggcactcacagctgctgtgcaaactcaggcagatctcctgccctctctgagccttgtcacttgaaaaaaacaggaccctttccctcctttgggctccctggaggtttttaagcagtacgtgcctccaagttacctccagatcagcaggcacaggtgggcattgccaggtattttctgagcccctgcgggtttgaggccttgtttttagtgctgagagccagttgctgccctgagaagagaagacaacctccatctatttattgcttcctgagaactgacctggatgcggccctctgcagggcccagtcttcagtcctgtggtccctggactggtgggaacctgaactaggagtcctgggagagctgtggtgggaatatgggctggcactgctgcagggcaagaacattcatgtaggagcccgaggaccagcaggctgggaatggggagcaagtcacgtcagctctgtcattccccacagttaacaaattggcggggtgggaagtcctgagtgctccgtccctctagcatcactcctgagctgcgggagaggtggcccagagaacagcagagtcagttacacctgcagctcttgtctaaagtgattagatggccaccctcaccactgtccagtccagcagcagcctggctgccttgtcatggcctcctgggggcagaaggcgatgtggaccacgggatttgtagccagccagctcccaggccaacgcccaaagccctgatgacctggttcttctgaggccctcaacctggcatcttagggtatggtcaggcaacagggtgaccagctgtcctggtttcccaggacatggaactttcaatgctaaaactgggacagtacccagcaagtggggatggttggtcccctaccaggagagggcctggggctcttgcttcccgagaacgcctgtggcttgaagaaccttgactgcttggtcctcaggtatctacctcccaccttctcctcatctgtggagcaagccaactcagtgccccagaccccacctgatctgcatctttgtttgcatctccagagacacctgaggccccagagcttgaggcaaagccaggccgtccaaatcctgtgtgccgtggacgagtggccactttactactcctaaggctaagatgttgagagctcagaccactgctcagagcagtaatccctgctcagaatgctcccagttccctcgtccctgcccaggtctcttgtctcttgggaaggaactgataggtcgggccattgttgggccatcactgagcgctcagtatctcaagagactctgttcattctgctcgtatcccaaggcctggttggtcaaactctgggcaaagggttttcaggatgaggaggtcaagacaggatctccagagctaccgagttcatctgtgggtgttgggggcaagtgggggctgaagtcctgtgcaggctgcgctggccccacctgccttgtgccctggagtggggtttctccttgttgaagaagaggcatccttctctgatgtgcacaaacacaatgtatgaccagagccttgcaactcaaagtgtggtctgtggaccagcagcggcagtgacacctgggagcttgttaggaatgcagagtctaggcctcaccctatacctcccgactcagaccctgcattttagcaagacccccagctgattcctataagcactttagagtttgagaagcaaggacctaggctggggatgtcctccgagcagagggtgaagtttctctcagttctctccctgccacttccagggatctgagcctgtgctcagcctcctccctaacccaccctgggagacacttggcctgttagattgttccagagtctgcatggcactcctgaagaagggagtgtgacctgcagtcaccaggagatgagggttaggtgtgcccagccctccagacccggcctttctggttaacccctgcatgccaagctgcctgctgccccaggtcctcacctcaggcctttgaaggggcagcttctggaagttgttttctcctctgcttggagagtttgcccttgtctgtcttggaaagtgtgggcagccacagatgcccccaaatcagagctcacagtgagtgagcccctaagcttcagtctgcaataaagaatgcattggtttcatcaaaaaaaaaaaaaaaaaa

SEQ ID NO: 58143 - DNA, 3176 bp, Homo sapiens
gcttgcacacatggctccggaggctccggttgcccatccgagcccctgccaggctctaacgttcccaactgacaacaccagtaactaaatataggagcagatggtggggacgggctgtcgcagcggctcctttgcagaggtctccggactgcagataaggctcaggcccttttgtgagaagcagaccagcctgggggctggcggcaggacacctgtgtctgcatgctgaagaagatgggtgaggccgtggccagagtagcaaggaaggtcaacgagacggtggagagcggctctgacactctggacctggccgagtgcaagctggtctcctttcccattggcatctacaaggtcctgcggaatgtctctggccagatccacctcatcaccctggctaacaacgagcttaagtccctcaccagcaagttcatgaccacattcagtcagctccgagagctccacctggaggggaacttcctacaccgcctccccagcgaggtcagtgccctgcagcacctcaaggccattgacctgtcccggaaccagttccaggacttccctgagcagcttaccgccctgccggcgctggagaccatcaacctggaggagaacgagatcgtagatgtgcccgtggagaagctggccgccatgccagccttgcgcagcatcaacctccgcttcaacccactcaacgccgaggtgcgcgtgatcgccccgccgctcatcaagtttgacatgctcatgtctccggaaggcgcaagagcccccctaccttaggccaccctcctcatgcccacccagcaaggggcagaggccacaggcctggaaccctggaagggagggaggcccatgggaggccaagcctgggggctgggggcgggtgggccgagcagcacgtggtgggtggggtgcagctggtctggatagatagcttacagcagtagtgggctctggaatgcccaagggaagaggcaaggtggggcctgcagcctggactcggcactcacagctgctgtgcaaactcaggcagatctcctgccctctctgagccttgtcacttgaaaaaaacaggaccctttccctcctttgggctccctggaggtttttaagcagtacgtgcctccaagttacctccagatcagcaggcacaggtgggcattgccaggtattttctgagcccctgcgggtttgaggccttgtttttagtgctgagagccagttgctgccctgagaagagaagacaacctccatctatttattgcttcctgagaactgacctggatgcggccctctgcagggcccagtcttcagtcctgtggtccctggactggtgggaacctgaactaggagtcctgggagagctgtggtgggaatatgggctggcactgctgcagggcaagaacattcatgtaggagcccgaggaccagcaggctgggaatggggagcaagtcacgtcagctctgtcattccccacagttaacaaattggcggggtgggaagtcctgagtgctccgtccctctagcatcactcctgagctgcgggagaggtggcccagagaacagcagagtcagttacacctgcagctcttgtctaaagtgattagatggccaccctcaccactgtccagtccagcagcagcctggctgccttgtcatggcctcctgggggcagaaggcgatgtggaccacgggatttgtagccagccagctcccaggccaacgcccaaagccctgatgacctggttcttctgaggccctcaacctggcatcttagggtatggtcaggcaacagggtgaccagctgtcctggtttcccaggacatggaactttcaatgctaaaactgggacagtacccagcaagtggggatggttggtcccctaccaggagagggcctggggctcttgcttcccgagaacgcctgtggcttgaagaaccttgactgcttggtcctcaggtatctacctcccaccttctcctcatctgtggagcaagccaactcagtgccccagaccccacctgatctgcatctttgtttgcatctccagagacacctgaggccccagagcttgaggcaaagccaggccgtccaaatcctgtgtgccgtggacgagtggccactttactactcctaaggctaagatgttgagagctcagaccactgctcagagcagtaatccctgctcagaatgctcccagttccctcgtccctgcccaggtctcttgtctcttgggaaggaactgataggtcgggccattgttgggccatcactgagcgctcagtatctcaagagactctgttcattctgctcgtatcccaaggcctggttggtcaaactctgggcaaagggttttcaggatgaggaggtcaagacaggatctccagagctaccgagttcatctgtgggtgttgggggcaagtgggggctgaagtcctgtgcaggctgcgctggccccacctgccttgtgccctggagtggggtttctccttgttgaagaagaggcatccttctctgatgtgcacaaacacaatgtatgaccagagccttgcaactcaaagtgtggtctgtggaccagcagcggcagtgacacctgggagcttgttaggaatgcagagtctaggcctcaccctatacctcccgactcagaccctgcattttagcaagacccccagctgattcctataagcactttagagtttgagaagcaaggacctaggctggggatgtcctccgagcagagggtgaagtttctctcagttctctccctgccacttccagggatctgagcctgtgctcagcctcctccctaacccaccctgggagacacttggcctgttagattgttccagagtctgcatggcactcctgaagaagggagtgtgacctgcagtcaccaggagatgagggttaggtgtgcccagccctccagacccggcctttctggttaacccctgcatgccaagctgcctgctgccccaggtcctcacctcaggcctttgaaggggcagcttctggaagttgttttctcctctgcttggagagtttgcccttgtctgtcttggaaagtgtgggcagccacagatgcccccaaatcagagctcacagtgagtgagcccctaagcttcagtctgcaataaagaatgcattggtttcatcaaaaaaaaaaaaaaaaaa

SEQ ID NO: 58144 - DNA, 2347 bp, Homo sapiens
atggagctgctgttgcagccagttaacgggctggtgacaaagtcgcaattgtgtctgtggagcagggagcctgttccatcgaggcaggctgccccaagtaaaaggctagagagtgtctcctttcctggggcccatgagatgtcctcacgctccctggccaggccagtcagtccgtccgcgccgcgctccatcgcccccgcacgcccgggcgcacgccctccccgcccgggccgccctctggctccccgcgcccggcagccagtgcctcaccgcgccgtcccgcgccagggctcgctccgagagccgcttccttctcgccgcggccggcgcgggccccccggccatgcgcccccgagccccagcctgcgccgccgcggcgctcgggctctgcagccttctgctgctgctcgcgcccgggcacgcgtgccccgcgggctgcgcctgcaccgacccgcacaccgtggactgccgcgaccgcgggctgcccagcgtgccagaccctttccccctggacgtgcgcaagctgctggtggccggcaaccgcatccagcggatccccgaggacttcttcatcttctacggcgacctggtctacctggacttcaggaacaactcgctgcgctcgctggaggagggcacgttcagcggctcggccaagctcgtgttcctcgacctcagctacaacaacttgacccagctgggcgccggcgccttccgctcggccgggaggctggtgaagcttagcctggctaacaacaacctggtgggcgtgcacgaggacgccttcgagaccctggagtcgctgcaggtgctggagctcaacgacaacaacctgcgcagcctcagcgtggccgccctggccgcgctgcccgcgctgcgctccctgcgtctggacgggaacccctggctgtgcgactgtgacttcgcccacctcttctcctggatccaggagaacgcatccaaactgcccaaaggccttgatgaaatccagtgctccctgcccatggagagcaggaggatatccctgcgtgagctgtcggaggccagcttcagcgagtgtaggttcagcctgtcactcacagacctctgcatcatcattttctccggtgtggccgtgtccattgcggccatcatctccagcttcttcctggccactgtggtgcagtgcctccagaggtgcgcacccaacaaagatgcggaggatgaagacgaggacaaggatgactgagccacctcctccctcctgcctcttactctccagcaccgaaccagaagctctctccaagacgagagggaaatgctgaaaatggaaaagcactggccaccatctgtgaactgaacagagcctgttccgtgtcttggcccctgggtacacctgctgggaccactgatctcagagtttagaatcagcagagcacagaagcccaggaaggatggagggaattattcctggagcataacctgcctctcagatcgaggtgtgtgttgggggagaagatgaccgagtcaggcttcatagctgatgactaaaagcctcccccaggaaatgtgaagactggcagctttcaatggcaaagatgattttacgccattctttttctgacctgtactgggagatcatgaaacatctgccttcctcccaagaaacagcagctcaaacagtggagattcaaattcggatcattcaccacaagaacgagaactttgatccttatataataggcctcagcaaccttgggatgttatactgggaactaataaactcgtgtgcaatagactcaatgtttatgttcccccagattttatatgttgaaacctaatccccaatgtgatggtatttggaggtggggcttttgggaggtgattaggtttagatcatatcatgaggatggggcccaaatgatgggattagtgccctcatgaaaggtggccccagagagctccttcaccccttcaatgcttgaggatgcagcaagaaatcagctgcccatgaaccgagaagcaggccctcaccagaacccagccatgctggcacccagatctcagacttccagcctccagaactgggagaaataaataaatgtctgttgtttgtaagccactcaatctctggtattctgttatagtggtcgaaatggacccatgaagaagctaacaactggtcagagggtgtctgttgttaattttggtaagctggttgggaaaactttgacttgacataactcaaaccctgatctttatcctaagcggtagcgacttgtagaggaaggattagttgctttgtacagttgtgatggtctctctgctcagcatcatttttccttctgaaggacagacaggttgttcc

SEQ ID NO: 58145 - DNA, 2347 bp, Homo sapiens; identical to SEQ ID NO: 58144

SEQ ID NO: 58146 - DNA, 5298 bp, Homo sapiens
atacagagcagcgagcactgaaggcttccctctttccttaaacctgtcgggttgtgggctctctcttttcccctcttgctcctttcttttctttttttctgtttttttaaaccttccaaggcaagttcatggatactaagctgatgtgtttgttgttctttttctccctgcctccgctcctagtgagtaaccacactggccgcatcaaggtggtctttactccgagcatctgtaaagtgacctgcaccaagggcagctgtcagaacagctgtgagaaggggaacaccaccactctcattagtgagaatggtcatgctgccgacaccctgacggccacgaacttccgagtggtaatttgccatcttccatgtatgaatggtggccagtgcagttcaagggacaaatgtcagtgccctccaaatttcacaggaaaactttgtcagatcccagtccatggtgccagcgtgcctaaactttatcagcattcccagcagccaggcaaggcgttggggacgcatgtcatccattcaacacataccttgcctctgaccgtgactagccagcaaggagtcaaagtgaaatttcctcctaacatagtcaatatccatgtgaaacatcctcctgaagcttccgtccagatacatcaggtttcaagaattgatggcccaacaggccagaagacaaaagaagctcaaccaggccaatcccaagtctcgtaccaagggcttcctgtccagaagacccagaccatacattccacatactcccaccagcaggtcattcctcacgtctaccccgtggctgctaagacacagcttggccggtgcttccaggaaaccattgggtcacagtgtggcaaagcgctccctggcctttcaaagcaagaggactgctgtggaactgtgggtacctcctggggctttaacaaatgccagaaatgccccaagaaaccatcttatcatggatacaaccaaatgatggaatgcctaccgggttataagcgggttaacaacaccttttgccaagatattaatgaatgtcagctacaaggtgtatgccctaatggtgagtgtttgaataccatgggcagctatcgatgtacctgcaaaataggatttgggccggatcctaccttttcaagttgtgttcctgatccccctgtgatctcggaagagaaagggccctgttaccgacttgtcagttctggaagacagtgtatgcaccctctgtctgttcacctcaccaagcagctctgctgttgtagtgtgggcaaggcctggggcccacactgtgagaaatgtccccttccaggcacagctgcttttaaggaaatctgtcctggtggaatgggttatacggtttctggcgttcatagacgcaggccaatccatcaccatgtaggtaaaggacctgtatttgtcaagccaaagaacactcaacctgttgctaaaagtactcatcctccacctctcccagccaaggaagagccagtggaggccctgaccttctcccgggaacacgggccaggagtggcggagccagaagtggcaactgcaccccctgaaaaggaaataccttcattggatcaagagaaaaccaaacttgagcctggtcaaccccagctgtctccaggcatttccactattcatctgcatccacagtttccaggtatagtgattgaaaaaacatcacctcctgtgcctgttgaagtagctcctgaagcttctacgtctagtgccagccaagtgattgctcctactcaagtgacagaaatcaatgaatgtactgtgaaccctgatatctgtggagcaggacactgcattaacctaccagtgagatatacctgtatatgctacgagggctacaggttcagtgaacaacagaggaaatgtgtggatattgatgagtgtactcaggtccaacacctctgctcccagggccgctgtgaaaacaccgagggaagtttcttgtgcatttgcccagcaggatttatggccagtgaggagggtactaactgcatagatgttgacgaatgcctgaggccggacgtctgtggggaggggcactgtgtcaatactgtgggggccttccggtgtgaatactgtgacagcgggtaccgcatgactcagagaggccgttgtgaggatattgatgaatgtttgaatccaagcacttgtccagatgagcagtgtgtgaattctcctggatcttaccagtgcgttccctgcacagaaggattccgaggctggaatggacagtgccttgatgtggacgagtgcctggaaccaaacgtctgcgcaaatggtgattgttccaaccttgaaggctcctacatgtgttcatgccacaaaggctatacccggactccggaccacaagcactgtagagatattgatgaatgtcagcaagggaatctatgtgtaaacgggcagtgcaaaaataccgagggctccttcaggtgcacctgtggacaggggtaccagctgtcggcagctaaagaccagtgtgaagacattgatgaatgccagcaccgtcatctctgtgctcatgggcagtgcaggaacactgagggctcttttcaatgtgtgtgtgaccagggttacagagcatctgggcttggagaccactgtgaagatatcaatgaatgcttggaggacaagagtgtttgccagagaggagactgcattaatactgcagggtcctatgattgtacttgtccggatggatttcagctagatgacaataaaacatgtcaagatattaatgaatgtgaacatccagggctctgtggtccgcaaggggagtgcctaaacacagagggttctttccattgtgtctgccagcagggtttctcaatctctgcagatggccgtacgtgtgaagatattgatgaatgtgtaaacaacactgtttgtgacagtcacgggttttgtgacaatacagctggctccttccgctgcctctgttatcagggctttcaagccccacaggatgggcaagggtgtgtggatgtgaatgaatgtgaactgctcagtggggtgtgtggtgaagccttctgtgaaaacgtggaagggtccttcctgtgcgtgtgtgctgatgaaaaccaagagtacagccccatgactgggcagtgccgctcccggacctccacagatttagatgtagatgtagatcaacccaaagaagaaaagaaagaatgctactataatctcaatgacgccagtctctgtgataatgtgttggcccccaatgtcacgaaacaagaatgctgctgtacatcaggcgcgggatggggagataactgcgaaatcttcccctgcccggtcttgggaactgctgagttcactgaaatgtgtcccaaagggaaaggttttgtgcctgctggagaatcatcttctgaagctggtggtgagaactataaagatgcagatgaatgcctactttttggacaagaaatctgcaaaaatggtttctgtttgaacactcggcctgggtatgaatgctactgtaagcaagggacgtactatgatcctgtgaaactgcagtgctttgatatggatgaatgtcaagaccccagtagttgtattgatggccagtgtgttaatacagagggctcttacaactgcttctgtactcaccccatggtcctggatgcgtcagaaaaaagatgtatacgaccggctgagtcaaacgaacaaatagaagaaactgatgtctaccaagatttgtgctgggaacatctgagtgatgaatacgtgtgtagccggcctcttgtgggcaagcagacaacgtacactgagtgctgctgtctgtatggagaggcctggggcatgcagtgtgccctctgccccctgaaggattcagatgactatgctcagctgtgtaacatccccgtgacgggacgccggcagccatatggacgggacgccttggttgacttcagtgaacagtatactccagaagccgatccctacttcatccaagaccgttttctaaatagctttgaggagttacaggctgaggaatgcggcatcctcaatggatgtgaaaatggtcgctgtgtgagggtccaggaaggttacacctgcgattgctttgatgggtatcacttggatacggccaagatgacctgtgtcgatgtaaatgaatgcgatgagttgaacaaccggatgtctctctgcaagaatgccaagtgcattaacaccgatggttcctacaagtgtttgtgtctgccaggctacgtgccttctgacaagccaaactactgcactccgttgaataccgccttgaatttagagaaagacagtgacctggagtgaaacagaatctacataacctaagcccatatactctgcactgtgtaaaggaaaagggagaaatgtattatacttgagacattgcacctaccccggaaggctggaaatacagaaacagcatggagttgcaagtcctctgaagacaatgagaggatttaggatgagcccgataggtgtggcagaccaaatggacatttctctaaaaaaccagtatatatagtctgttcatatgtaaaattcaatggaagagaggtggaacagtgctgttattttaaacagaaggttgtattattatgttgttttgtttttttactattgcttgattaaatttggcatttaaatagtggtggaaatattttatataattttcattttttggttgtgcagttccttggctactgtttttcttttacttcagttttttaaaaatctcaaatgaaaaagtcttcgatacaatattgttaagctgtattataagtattgttacacagggttatgcaattcccggcctggagcatttttgaaattcaaattgtctgtcctgtggagcaggcagtgattttgttccaaaactttgtatacacatttggagaaaagtactttatattttcagtgttttgtctgattttaatgtccgttcttagccaagctgctagcaggtgttaattggatccctttccttcactgaaatggaagagtttataagcttacgttagtattgtaatatgtaaagtaagcccaacaaaaatttttaaaaatttgatgatccccaatatatctaccattgtatgttaaataaatcaccatttttgtagaaaaaattctacctgagagtaattgtcaatgagtacatgtgtataagttgtatcccactctccccacttttatcttttccagtggtcttctgttaatgtagtgtcttttacaagttaatcattaaatttgttagatcttgttatgggctaaaaaaaaaaaaaaaaaa

SEQ ID NO: 58147 - DNA, 6148 bp, Homo sapiens
atggcgggggcctggctcaggtgggggctcctgctctgggcagggctcctcgcgtcctcggcgcacggccggctgcggaggatcacctacgtggtgcacccgggccccggcctggcagccggcgccttgcccctgagcgggcccccgcgttcgcggacattcaacgtcgcgctcaacgccaggtacagccgcagctcggcggctgccggcgcccccagccgtgcctcccccggggtcccctcggagaggacccggcgcacgagcaagccgggcggcgcggccctgcaggggctcagaccgccgccgccgccgccgccggagcctgcgcgtcccgcggtccccggcgggcagctccaccccaatcccggcggccacccggcagccgccccgttcaccaaacaaggcaggcaagttgtgcgctccaaggtgccgcaggagacccagagcggcggaggctctaggctgcaggttcaccagaagcagcagctgcagggggtcaatgtctgtggagggcggtgctgtcatggctggagtaaggcccctggctcccagaggtgcaccaaacctagctgtgttccgccatgtcagaatggagggatgtgtctccggccacaactctgtgtgtgtaaaccagggaccaagggcaaagcctgtgaaacaatagctgcccaggacacctcgtcaccagtctttggagggcagagtcctggggctgcttcctcgtggggccctcctgagcaagcagcaaagcatacttcatctaagaaggcagacactctaccaagagtcagccctgtggcccagatgaccttaaccctcaagccgaagccttcagtgggactcccccagcagatacattctcaagtgactcctctttcttcccagagtgtggtgattcaccatggccagacccaggaatacgtgctcaagcccaagtactttccagcccagaaggggatttcaggagagcagtccactgaaggttctttccctttaagatatgtgcaggatcaagttgcggcaccttttcagctgagtaaccacactggccgcatcaaggtggtctttactccgagcatctgtaaagtgacctgcaccaagggcagctgtcagaacagctgtgagaaggggaacaccaccactctcattagtgagaatggtcatgctgccgacaccctgacggccacgaacttccgagtggtaatttgccatcttccatgtatgaatggtggccagtgcagttcaagggacaaatgtcagtgccctccaaatttcacaggaaaactttgtcagatcccagtccatggtgccagcgtgcctaaactttatcagcattcccagcagccaggcaaggcgttggggacgcatgtcatccattcaacacataccttgcctctgaccgtgactagccagcaaggagtcaaagtgaaatttcctcctaacatagtcaatatccatgtgaaacatcctcctgaagcttccgtccagatacatcaggtttcaagaattgatggcccaacaggccagaagacaaaagaagctcaaccaggccaatcccaagtctcgtaccaagggcttcctgtccagaagacccagaccatacattccacatactcccaccagcaggtcattcctcacgtctaccccgtggctgctaagacacagcttggccggtgcttccaggaaaccattgggtcacagtgtggcaaagcgctccctggcctttcaaagcaagaggactgctgtggaactgtgggtacctcctggggctttaacaaatgccagaaatgccccaagaaaccatcttatcatggatacaaccaaatgatggaatgcctaccgggttataagcgggttaacaacaccttttgccaagatattaatgaatgtcagctacaaggtgtatgccctaatggtgagtgtttgaataccatgggcagctatcgatgtacctgcaaaataggatttgggccggatcctaccttttcaagttgtgttcctgatccccctgtgatctcggaagagaaagggccctgttaccgacttgtcagttctggaagacagtgtatgcaccctctgtctgttcacctcaccaagcagctctgctgttgtagtgtgggcaaggcctggggcccacactgtgagaaatgtccccttccaggcacagctgcttttaaggaaatctgtcctggtggaatgggttatacggtttctggcgttcatagacgcaggccaatccatcaccatgtaggtaaaggacctgtatttgtcaagccaaagaacactcaacctgttgctaaaagtactcatcctccacctctcccagccaaggaagagccagtggaggccctgaccttctcccgggaacacgggccaggagtggcggagccagaagtggcaactgcaccccctgaaaaggaaataccttcattggatcaagagaaaaccaaacttgagcctggtcaaccccagctgtctccaggcatttccactattcatctgcatccacagtttccaggtatagtgattgaaaaaacatcacctcctgtgcctgttgaagtagctcctgaagcttctacgtctagtgccagccaagtgattgctcctactcaagtgacagaaatcaatgaatgtactgtgaaccctgatatctgtggagcaggacactgcattaacctaccagtgagatatacctgtatatgctacgagggctacaggttcagtgaacaacagaggaaatgtgtggatattgatgagtgtactcaggtccaacacctctgctcccagggccgctgtgaaaacaccgagggaagtttcttgtgcatttgcccagcaggatttatggccagtgaggagggtactaactgcatagatgttgacgaatgcctgaggccggacgtctgtggggaggggcactgtgtcaatactgtgggggccttccggtgtgaatactgtgacagcgggtaccgcatgactcagagaggccgttgtgaggatattgatgaatgtttgaatccaagcacttgtccagatgagcagtgtgtgaattctcctggatcttaccagtgcgttccctgcacagaaggattccgaggctggaatggacagtgccttgatgtggacgagtgcctggaaccaaacgtctgcgcaaatggtgattgttccaaccttgaaggctcctacatgtgttcatgccacaaaggctatacccggactccggaccacaagcactgtagagatattgatgaatgtcagcaagggaatctatgtgtaaacgggcagtgcaaaaataccgagggctccttcaggtgcacctgtggacaggggtaccagctgtcggcagctaaagaccagtgtgaagacattgatgaatgccagcaccgtcatctctgtgctcatgggcagtgcaggaacactgagggctcttttcaatgtgtgtgtgaccagggttacagagcatctgggcttggagaccactgtgaagatatcaatgaatgcttggaggacaagagtgtttgccagagaggagactgcattaatactgcagggtcctatgattgtacttgtccggatggatttcagctagatgacaataaaacatgtcaagatattaatgaatgtgaacatccagggctctgtggtccgcaaggggagtgcctaaacacagagggttctttccattgtgtctgccagcagggtttctcaatctctgcagatggccgtacgtgtgaagatattgatgaatgtgtaaacaacactgtttgtgacagtcacgggttttgtgacaatacagctggctccttccgctgcctctgttatcagggctttcaagccccacaggatgggcaagggtgtgtggatgtgaatgaatgtgaactgctcagtggggtgtgtggtgaagccttctgtgaaaacgtggaagggtccttcctgtgcgtgtgtgctgatgaaaaccaagagtacagccccatgactgggcagtgccgctcccggacctccacagatttagatgtagatgtagatcaacccaaagaagaaaagaaagaatgctactataatctcaatgacgccagtctctgtgataatgtgttggcccccaatgtcacgaaacaagaatgctgctgtacatcaggcgcgggatggggagataactgcgaaatcttcccctgcccggtcttgggaactgctgagttcactgaaatgtgtcccaaagggaaaggttttgtgcctgctggagaatcatcttctgaagctggtggtgagaactataaagatgcagatgaatgcctactttttggacaagaaatctgcaaaaatggtttctgtttgaacactcggcctgggtatgaatgctactgtaagcaagggacgtactatgatcctgtgaaactgcagtgctttgatatggatgaatgtcaagaccccagtagttgtattgatggccagtgtgttaatacagagggctcttacaactgcttctgtactcaccccatggtcctggatgcgtcagaaaaaagatgtatacgaccggctgagtcaaacgaacaaatagaagaaactgatgtctaccaagatttgtgctgggaacatctgagtgatgaatacgtgtgtagccggcctcttgtgggcaagcagacaacgtacactgagtgctgctgtctgtatggagaggcctggggcatgcagtgtgccctctgccccctgaaggattcagatgactatgctcagctgtgtaacatccccgtgacgggacgccggcagccatatggacgggacgccttggttgacttcagtgaacagtatactccagaagccgatccctacttcatccaagaccgttttctaaatagctttgaggagttacaggctgaggaatgcggcatcctcaatggatgtgaaaatggtcgctgtgtgagggtccaggaaggttacacctgcgattgctttgatgggtatcacttggatacggccaagatgacctgtgtcgatgtaaatgaatgcgatgagttgaacaaccggatgtctctctgcaagaatgccaagtgcattaacaccgatggttcctacaagtgtttgtgtctgccaggctacgtgccttctgacaagccaaactactgcactccgttgaataccgccttgaatttagagaaagacagtgacctggagtgaaacagaatctacataacctaagcccatatactctgcactgtgtaaaggaaaagggagaaatgtattatacttgagacattgcacctaccccggaaggctggaaatacagaaacagcatggagttgcaagtcctctgaagacaatgagaggatttaggatgagcccgataggtgtggcagaccaaatggacatttctctaaaaaaccagtatatatagtctgttcatatgtaaaattcaatggaagagaggtggaacagtgctgttattttaaacagaaggttgtattattatgttgttttgtttttttactattgcttgattaaatttggcatttaaatagtggtggaaatattttatataattttcattttttggttgtgcagttccttggctactgtttttcttttacttcagttttttaaaaatctcaaatgaaaaagtcttcgatacaatattgttaagctgtattataagtattgttacacagggttatgcaattcccggcctggagcatttttgaaattcaaattgtctgtcctgtggagcaggcagtgattttgttccaaaactttgtatacacatttggagaaaagtactttatattttcagtgttttgtctgattttaatgtccgttcttagccaagctgctagcaggtgttaattggatccctttccttcactgaaatggaagagtttataagcttacgttagtattgtaatatgtaaagtaagcccaacaaaaatttttaaaaatttgatgatccccaatatatctaccattgtatgttaaataaatcaccatttttgtagaaaaaattctacctgagagtaattgtcaatgagtacatgtgtataagttgtatcccactctccccacttttatcttttccagtggtcttctgttaatgtagtgtcttttacaagttaatcattaaatttgttagatcttgttatgggctaaaaaaaaaaaaaaaaaa

SEQ ID NO: 58148 - DNA, 4917 bp, Homo sapiens
agaagatgtcttcgcggacggtgctggccccgggcaacgatcggaactcggacacgcatggcaccttgggcagtggccgctcctcggacaaaggcccgtcctggtccagccgctcactgggtgcccgttgccggaactccatcgcctcctgtcccgaggagcagccccacgtgggcaactaccgcctgctgaggaccattgggaagggcaactttgccaaagtcaagctggctcggcacatcctcactggtcgggaggttgccatcaagattatcgacaaaacccagctgaatcccagcagcctgcagaagctgttccgagaagtccgcatcatgaagggcctaaaccaccccaacatcgtgaagctctttgaggtgattgagactgagaagacgctgtacctggtgatggagtacgcaagtgctggagaagtgtttgactacctcgtgtcgcatggccgcatgaaggagaaggaagctcgagccaagttccgacagattgtttcggctgtgcactattgtcaccagaaaaatattgtacacagggacctgaaggctgagaacctcttgctggatgccgaggccaacatcaagattgctgactttggcttcagcaacgagttcacgctgggatcgaagctggacacgttctgcgggagccccccatatgccgccccggagctgtttcagggcaagaagtacgacgggccggaggtggacatctggagcctgggagtcatcctgtacaccctcgtcagcggctccctgcccttcgacgggcacaacctcaaggagctgcgggagcgagtactcagagggaagtaccgggtccctttctacatgtcaacagactgtgagagcatcctgcggagatttttggtgctgaacccagctaaacgctgtactctcgagcaaatcatgaaagacaaatggatcaacatcggctatgagggtgaggagttgaagccatacacagagcccgaggaggacttcggggacaccaagagaattgaggtgatggtgggtatgggctacacacgggaagaaatcaaagagtccttgaccagccagaagtacaacgaagtgaccgccacctacctcctgctgggcaggaagactgaggagggtggggaccggggcgccccagggctggccctggcacgggtgcgggcgcccagcgacaccaccaacggaacaagttccagcaaaggcaccagccacagcaaagggcagcggagttcctcttccacctaccaccgccagcgcaggcatagcgatttctgtggcccatcccctgcacccctgcaccccaaacgcagcccgacgagcacgggggaggcggagctgaaggaggagcggctgccaggccggaaggcgagctgcagcaccgcggggagtgggagtcgagggctgcccccctccagccccatggtcagcagcgcccacaaccccaacaaggcagagatcccagagcggcggaaggacagcacgagcacccccaacaacctccctcctagcatgatgacccgcagaaacacctacgtttgcacagaacgcccgggggctgagcgcccgtcactgttgccaaatgggaaagaaaacagctcaggcaccccacgggtgccccctgcctccccctccagtcacagcctggcacccccatcaggggagcggagccgcctggcacgcggttccaccatccgcagcaccttccatggtggccaggtccgggaccggcgggcagggggtgggggtggtgggggtgtgcagaatgggccccctgcctctcccacactggcccatgaggctgcacccctgcccgccgggcggccccgccccaccaccaacctcttcaccaagctgacctccaaactgacccgaagggttaccctcgatccctctaaacggcagaactctaaccgctgtgtttcgggcgcctctctgccccagggatccaagatcaggtcgcagacgaacctgagagaatcgggggacctgaggtcacaagttgccatctaccttgggatcaaacggaaaccgccccccggctgctccgattcccctggagtgtgaagctgaccagctcgcgccctcctgaggccctgatggcagctctgcgccaggccacagcagccgcccgctgccgctgccgccagccacagccgttcctgctggcctgcctgcacgggggtgcgggcgggcccgagcccctgtcccacttcgaagtggaggtctgccagctgccccggccaggcttgcggggagttctcttccgccgtgtggcgggcaccgccctggccttccgcaccctcgtcacccgcatctccaacgacctcgagctctgagccaccacggtcccagggcccttactcttcctctcccttgtcgccttcacttctacaggaggggaaggggccagggaggggattctccctttatcatcacctcagtttccctgaattatatttgggggcaaagattgtcccctctgctgttctctggggccgctcagcacagaagaaggatgagggggctcagcggggggagctggcaccttcctggagcctccagccagtcctgtcctccctcgccctaccaagagggcacctgaggagactttggggacagggcaggggcagggagggaaactgaggaaatcttccattcctcccaacagctcaaaattaggccttgggcaggggcagggagagctgctgagcctaaagactggagaatctgggggactgggagtgggggtcagagaggcagattccttcccctcccgtcccctcacgctcaaacccccacttcctgccccaggctggcgcggggcactttgtacaaatccttgtaaataccccacaccctcccctctgcaaaggtctcttgaggagctgccgctgtcacctacggtttttaagttattacaccccgaccctcctcctgtcagccccctcacctgcagcctgttgcccaataaatttaagagagtccccccctccccaatgctgaccctaggattttccttccctgccctcacctgcaaatgagttaaagaagaggcgtgggaatccaggcagtggtttttcctttcggagcctcggttttctcatctgcagaatgggagcggtgggggtgggaaggtaaggatggtcgtggaagaaggcaggatggaactcggcctcatccccgaggccccagttcctatatcgggccccccattcatccactcacactcccagccaccatgttacactggactctaagccacttcttactccagtagtaaatttattcaataaacaatcattgacccatgcctactccatgccaggcccagtgctggacacagagacatgaagctctgtctgtgggagacagggattctgacacagacaccggacaaaccattgtcttggggagcccagaagagaaagtgggcagggtggggtcattggggaagatgctctagaggaattaatgctggaatggggtgttgaaggatgagtaggagttagttaggcattgagtttgccctgggcaaaagcccagaagtgggagtatgtggtatatcttcagagaactgggtaatttcagtgtggctgctgtgttgggcatggatggagaatcagcaagagaaatgctgtattaggactaataatccatctacgctgcttaagcaaaaaggtatttgttggtttatgttacttaatagtccaggggcacctggcttcaggtaggtttgatccaggcatcaggccattgcatctattttttcagtgtaagttgaattctagtaatttttatcaagtaagggctcctttcctggtggcacagatgacttcagcagttagaagtttctatccctccagctttctgcagcagaaagaccctcattgtcagtttcccagcaaaagtcccagggcagactctcattggcccaaatgggccatgtgattttctctaaaccaatcactgtgactctagagtggccagactcagagctgcacttagtaggggttcctcaaaggaaggtcaagtgtcatgagcaggagaaaaggcatgggagctggacagattatagtggttgaagtctgtgcagtacagaagggcggagcttattcacacagcacctttggggccaaaatgaataagctggactttctccccatggcactggggaaccatggaagttcagggaacttcagggaagaggcttggtcaattcctgagagcatcctctgtgctggggacacagtggtaatcaagacagccccaacactgccctcatagagctcacagtccaatggaggaggcagatgtgtcctcaggcagcgactgggcagggctggtataggggagtccagaggtgatgcctgcctcagccagggagggcttcctggaggagaaggagccagctagacatggataggagtgcgttttaggcacagcaaatggcacatacaagggccagggagcaagagagaggacaggtcctcaacaaatggcatgtgactttgtaagtgtagaattgctgtgaggtatggggctaggggcgtcagtagggccttgaaggttatggacaggggcctgggctttcttccaagggcactgggggagccatggcaaggttgtaggtagggtagagatgggcgggtttgtgctatgtgcagggtggaagggagggaagttgacaggtcagaagatcaggaaagaggtcggggctggacagatggggagagcgcagatagatttaagagagtcctgtgaggcaaagtgggcaggacctggtaacaggtgtctggactgtggctttggctggctcagaaggtccccactggcgtgtgtggtctatgtagcctctgggtgtggagctgggatcttcaactggggacagtacagtaaagaacatcacagc

SEQ ID NO: 58149 - DNA, 3572 bp, Homo sapiens
caggaggaggtcccccgacatgcctgaggcaaaaccagcggccaaaaaggcccccaaaggcaaagatgcccccaaaggagcccccaaggaggctccccctaaggaggctcctgcagaggcccccaaagaagccccacccgaggaccagtccccgactgcagaggagcccaccggcgttttcctgaagaagccggactccgtctcagtggagactgggaaggacgcagtggtcgtggccaaggtgaacgggaaggagctcccagacaaaccgaccatcaagtggttcaaggggaagtggctggagctgggcagcaagagtggcgcccgcttctccttcaaggagtcccacaactccgccagcaatgtgtacaccgtggagctgcacattgggaaggtggtactgggggaccgtgggtattaccgcctcgaggtcaaagccaaggacacctgtgacagctgtggcttcaacatcgatgtggaggcaccccgtcaggatgcctctgggcagagtctagaaagcttcaagcgtacgagtgaaaagaagtcggatactgcaggtgagctggatttcagtggcctgttgaagaagagggaggtggtggaggaggagaagaagaagaaaaagaaagatgacgatgacctaggcatccccccggagatttgggagctcctgaaaggggcaaagaagagcgagtacgagaaaatcgccttccagtatggcatcaccgacctccggggcatgctgaagcggctgaaaaaggctaaggtcgaggtcaagaagagtgcagcattcacaaagaagctggatccagcctaccaagtggacagaggcaacaagatcaagttgatggtagagatcagcgacccagacctgaccctcaagtggttcaagaacggccaggagatcaaaccaagcagcaagtacgtgtttgagaacgttggtaagaagcgaattcttaccatcaacaagtgcacgctggcggatgacgctgcctatgaagtagctgtcaaggatgagaagtgtttcaccgagctcttcgtcaaagaacctccagtcctaattgtcacacctcttgaggaccagcaggtgtttgtgggtgaccgggtggaaatggcagtggaggtgtcagaagagggtgcccaggtgatgtggatgaaagatggtgtggaactgactcgggaggattccttcaaggcccggtaccgcttcaagaaggacgggaagcgccacatcctcatcttctcagacgtggtccaggaggacaggggtcgctatcaggtcataaccaatggcggccagtgtgaggccgagctgattgtggaagagaaacagctggaggtcctgcaggacatcgcggatctgacggtgaaggcctcagaacaagctgtgttcaagtgcgaggtgtctgatgagaaagtgacgggcaagtggtataagaatggggtcgaggtgcggcccagcaagaggatcaccatttcccatgtaggcaggttccacaagctggtgatcgatgacgtccgccccgaggatgagggagactacacgtttgtgcctgacggctacgccctgtcgctctcggccaagctcaacttcctggaaatcaaggtggagtacgttcccaagcaagagccaccaaagatccacttggattgctcggggaagacctcagagaatgcgattgtggttgtggctggaaacaagctgaggcttgacgtgtccatcacaggggagccccctcccgtcgctacctggctgaagggagatgaggtattcacgaccaccgagggcaggacccgcatcgagaagcgggtggactgcagcagctttgtgattgagagtgcgcagcgggaagacgagggccgctacaccatcaaggtcaccaaccccgtcggcgaggacgtggcttccatcttcctgcaagttgtagatgtcccagaccccccggaggctgtgcgcatcacctcggttggagaggattgggccatccttgtctgggagccaccaatgtacgatggggggaagccagtcaccgggtacctcgtagagcggaagaagaagggctctcagcgctggatgaagctgaactttgaggtcttcacagagaccacctatgagtccaccaagatgatcgagggcatcctctatgagatgcgtgtcttcgccgtcaatgctataggggtctcccagcccagcatgaacaccaagccttttatgcctattgcacccacgagtgaacccctgcacctgatagtggaggatgtgacagacaccaccaccacactcaagtggaggcctccgaacaggatcggggcaggtggcatcgatgggtacctggtggagtactgcctggaaggctccgaggaatgggtccctgccaacaccgagcccgtggagcgctgtggcttcaccgtcaagaatctcccgaccggagccagaatcctcttccgagtagttggggtcaacatcgcggggcgcacggagccggccaccctggcccagccggtcaccatcagggagattgcggagccacccaagatccggcttccccgccatctccgccagacctacatccgcaaagtgggcgagcagctcaaccttgtcgtccccttccagggaaagccccggccccaggtggtgtggaccaagggcggggccccgctggacacctcccgcgtgcacgtgcggaccagcgacttcgacaccgtgttcttcgtgcgccaggcggcccgctccgactccggggagtacgagctgagcgtgcagatcgagaacatgaaggacaccgccaccatccgcatccgcgttgtggaaaaggctgggccccccataaacgtgatggtgaaggaggtgtggggcacgaacgcgctggtggagtggcaggcccccaaagatgatgggaacagtgagatcatggggtatttcgtccagaaagcagacaaaaaaaccatggagtggttcaacgtctatgaacgtaacaggcacactagctgtactgtgtccgaccttatcgtgggcaatgaatactatttccgagtttacaccgagaacatctgtgggctcagtgactcacctggtgtctccaagaacacggcccgcatcctcaagacaggaatcaccttcaaaccgttcgagtataaggagcatgacttccggatggctcccaagttcctgacacctctcatagaccgcgtggtcgtggctgggtactcggcagccctcaactgtgctgtcagaggccacccgaagccgaaggtggtctggatgaagaacaagatggaaatccgtgaagatcccaagttcctgataaccaattaccaaggagtcctgacgctgaacatccgtcgcccctcgcccttcgacgctgggacttacacctgccgggccgtcaacgagctgggcgaggcgctggctgagtgcaagctggaggtccgagtgccgcagtgagacctgtcccctacctgccaagacaattggtggtggagtcctgaccccaatccccaacctcccaggactgtgttctttctggagttttcgctgagaacaaaacagtgttgtctggaaaaaaaaaaaa

SEQ ID NO: 58150 - DNA, 1427 bp, Homo sapiens
cctctcgctgccgtccaggtgcaccgcctgcctctcagcaggatggacgtgatggatggctgccagttctcaccttctgagtacttctacgacggctcctgcataccgtcccccgagggtgaatttggggacgagtttgtgccgcgagtggctgccttcggagcgcacaaagcagagctgcagggctcagatgaggacgagcacgtgcgagcgcctaccggccaccaccaggctggtcactgcctcatgtgggcctgcaaagcctgcaagaggaagtccaccaccatggatcggcggaaggcagccactatgcgcgagcggaggcgcctgaagaaggtcaaccaggctttcgaaaccctcaagaggtgtaccacgaccaaccccaaccagaggctgcccaaggtggagatcctcaggaatgccatccgctacatcgagagcctgcaggagttgctgagagagcaggtggagaactactatagcctgccgggacagagctgctcggagcccaccagccccacctccaactgctctgatggcatgcccgaatgtaacagtcctgtctggtccagaaagagcagtacttttgacagcatctactgtcctgatgtatcaaatgtatatgccacagataaaaactccttatccagcttggattgcttatccaacatagtggaccggatcacctcctcagagcaacctgggttgcctctccaggatctggcttctctctctccagttgccagcaccgattcacagcctcgaactccaggggcttctagttccaggcttatctatcatgtgctatgaactaattttctggtctatatgacttcttccaggagggcctaatacacaggacgaagaaggcttcaaaaagtcccaaaccaagacaacatgtacataaagatttcttttcagttgtaaatttgtaaagattaccttgccactttataagaaagtgtatttaactaaaaagtcatcattgcaaataatactttcttcttctttattattctttgcttagatattaatacatagttccagtaatactatttctgatagggggccattgattgagggtagcttgttcgaatgcttaacttatatatacatatatatatattataaatattgctcatcaaaatgtctctggtgtttagagctttatttttttctttaaaacattaaaacagctgagaatcagttaaatggaattttaaatatatttaactatttcttttctctttaatcctttagttatattgtattaaataaaaatataatactgcctaatgtatatattttgatcttttcttgtaagaaatgtatcttttaaatgtaagcacaaaatagtactttgtggatcatttcaagatataagaaattttggaaattccaccataaataaaattttttactacaag

SEQ ID NO: 58151 - DNA, 1294 bp, Homo sapiens
gtttttgagtccatcacccagttcagatcgagtcagaggccaaggaggagaacatgatgatggacctttttgaaactggctcctatttcttctacttggatggggaaaatgttactctgcagccattagaagtggcagaaggctctcctttgtatccagggagtgatggtaccttgtccccctgccaggaccaaatgcccccggaagcggggagcgacagcagcggagaggaacatgtcctggcgcccccgggcctgcagcctccacactgccccggccagtgtctgatctgggcttgcaagacctgcaagagaaaatctgcccccactgaccggcgaaaagccgccaccctgcgcgaaaggaggaggctaaagaaaatcaacgaggccttcgaggcactgaagcggcgaactgtggccaaccccaaccagaggctgcccaaggtggagattctgcggagcgccatcagctatattgagcggctgcaggacctgctgcaccggctggatcagcaggagaagatgcaggagctgggggtggaccccttcagctacagacccaaacaagaaaatcttgagggtgcggatttcctgcgcacctgcagctcccagtggccaagtgtttccgatcattccagggggctcgtgataacggctaaggaaggaggagcaagtattgattcgtcagcctcgagtagccttcgatgcctttcttccatcgtggacagtatttcctcggaggaacgcaaactcccctgcgtggaggaagtggtggagaagtaactgagcctgcgcttgagaccttctccacgcagcaggaagatcccaccgacccttcctggcctaatcctttagattaggtcacattacattaacatttaggaacccagaccgaaaagttgctgaaagggaaggagacacattcacaaagaaaagttgcgaaaattgcgaaatctgttgtgcacgctcaaatgaaaacgcctttcggctttgggcttttatttttttggaactgcgagtggcttaggtctagcctcattttgtttttgtttggttggttttatactatattaacttttattacggtgatccttttgtgccatgttcaaaagaagttcattcctgtctgaagtgggaaagttgcatttaatgttaggggtatttaatgtatttttgtaaatagtttagcactttctttttttacgtaaacctgaaatatattttaaatgtggaatgatgtatataaaatgtgcgaggatcctggtattgtaatattaaaaagaagtttctatatg

SEQ ID NO: 58152 - DNA, 1045 bp, Homo sapiens
acactctgggtccatcttcaagacactgggctgtggatcaacccaaccaccatcctcttccaagaatcattttgacaggttcttttggaggaactccttctctttttaacccacccttttaaaaaaaaaaatggcaccaaagaaagacgtgaagaaacctgtggctgcggctgcggctgccccagccccggcaccggcacctgcacctgcccctgccccagccaaacccaaagaagaaaaaattgacctctctgccattaagatcgagttctctaaggaacagcaggatgaattcaaggaggcatttctcctgtttgacagaacaggtgattccaagatcaccttaagccaggtcggtgatgtccttcgagctctgggcacaaatcccaccaatgcagaggtcaggaaagttctgggaaaccccagcaatgaagagctgaatgccaagaaaattgagtttgaacaatttctgcctatgatgcaagccatttccaacaacaaggaccaggccacctatgaagactttgttgagggtctgcgtgtctttgacaaggaaggcaatggcacagtcatgggtgctgaactccgccatgttctagccaccctgggtgaaaagatgaaagaggaagaagtggaagccctgatggcaggtcaagaagactccaatggctgcatcaactacgaagcttttgtcaagcacatcatgtctatctgaatggagctctcaagaacaagcattgtttaggaagactggctggaaacttattttaatcacacccatgacaaactctccagatctgtttaccatcattcaggaaaacaaagcaatctggacggttcaagactgagcaactccctgaatttttatacatcttcagtttttctctgaattgaattcataccacacaaacaaagtgtctgctgctctagatgagaagaataaaatattgacaatctcaaatccaagcaccattctttattatctaccatgaatcaacgaaacattcttaaaacaataaatcaataaacaattttggtcagtctg

SEQ ID NO: 58153 - DNA, 853 bp, Homo sapiens
actcagggaccggagcagccctcaactcactcttcagcttccctgctgtgttgctgcccagccgctccatcatgtccttcagtgctgaccagattgctgaattcaaggaggcatttctcctgtttgacagaacaggtgattccaagatcaccttaagccaggtcggtgatgtccttcgagctctgggcacaaatcccaccaatgcagaggtcaggaaagttctgggaaaccccagcaatgaagagctgaatgccaagaaaattgagtttgaacaatttctgcctatgatgcaagccatttccaacaacaaggaccaggccacctatgaagactttgttgagggtctgcgtgtctttgacaaggaaggcaatggcacagtcatgggtgctgaactccgccatgttctagccaccctgggtgaaaagatgaaagaggaagaagtggaagccctgatggcaggtcaagaagactccaatggctgcatcaactacgaagcttttgtcaagcacatcatgtctatctgaatggagctctcaagaacaagcattgtttaggaagactggctggaaacttattttaatcacacccatgacaaactctccagatctgtttaccatcattcaggaaaacaaagcaatctggacggttcaagactgagcaactccctgaatttttatacatcttcagtttttctctgaattgaattcataccacacaaacaaatgtctgctgctctagatgagaagaataaaatattgacaatctcaaatccaagcagccttctttattatctaccatgaatcaacgaaacattcttaaaacaataaatcaataaacaattttggtcagtctg

SEQ ID NO: 58154 - DNA, 2683 bp, Homo sapiens
atggcgacagaaaatggagcagttgagctgggaattcagaacccatcaacagacaaggcacctaaaggtcccacaggtgaaagacccctggctgcagggaaagaccctggccccccagacccaaagaaagctccggatccacccaccctgaagaaagatgccaaagcccctgcctcagagaaaggggatggtaccctggcccaaccctcaactagcagccaaggccccaaaggagagggtgacaggggcggggggcccgcggagggcagtgctgggcccccggcagccctgccccagcagactgcgacacctgagaccagcgtcaagaagcccaaggctgagcagggagcctcaggcagccaggatcctggaaagcccagggtgggcaagaaggcagcagagggccaagcagcagccaggaggggctcacctgcctttctgcatagccccagctgtcctgccatcatctccagttctgagaagctgctggccaagaagcccccaagcgaggcatcagagctcacctttgaaggggtgcccatgacccacagccccacggatcccaggccagccaaggcagaagaaggaaagaacatcctggcagagagccagaaggaagtgggagagaaaaccccaggccaggctggccaggctaagatgcaaggggacacctcgagggggattgagttccaggctgttccctcagagaaatccgaggtggggcaggccctctgtctcacagccagggaggaggactgcttccagattttggatgattgcccgccacctccggcccccttccctcaccgcatggtggagctgaggaccgggaatgtcagcagtgaattcagtatgaactccaaggaggcgctcggaggtggcaagtttggggcagtctgtacctgcatggagaaagccacaggcctcaagctggcagccaaggtcatcaagaaacagactcccaaagacaaggaaatggtgttgctggagattgaggtcatgaaccagctgaaccaccgcaatctgatccagctgtatgcagccatcgagactccgcatgagatcgtcctgttcatggagtacatcgagggcggagagctcttcgagaggattgtggatgaggactaccatctgaccgaggtggacaccatggtgtttgtcaggcagatctgtgacgggatcctcttcatgcacaagatgagggttttgcacctggacctcaagccagagaacatcctgtgtgtcaacaccaccgggcatttggtgaagatcattgactttggcctggcacggaggtataaccccaacgagaagctgaaggtgaactttgggaccccagagttcctgtcacctgaggtggtgaattatgaccaaatctccgataagacagacatgtggagtatgggggtgatcacctacatgctgctgagcggcctctcccccttcctgggagatgatgacacagagaccctaaacaacgttctatctggcaactggtactttgatgaagagacctttgaggccgtatcagacgaggccaaagactttgtctccaacctcatcgtcaaggaccagagggcccggatgaacgctgcccagtgtctcgcccatccctggctcaacaacctggcggagaaagccaaacgctgtaaccgacgccttaagtcccagatcttgcttaagaaatacctcatgaagaggcgctggaagaaaaacttcattgctgtcagcgctgccaaccgcttcaagaagatcagcagctcgggggcactgatggctctgggggtctgagccctgggcgcagctgaagcctggacgcagccacacagtggccggggctgaagccacacagcccagaaggccagaaaaggcagccagatccccagggcagcctcgttaggacaaggctgtgccaggctgggaggctcggggctccccacgcccccatgcagtgaccgcttccccgatgtgagccgcctcggagtgtggcctggatccatcctgctagcacctccccagacagggctccagcctgtcggccacaccccagactccaggcccccgttgaagccgctcccggttccctccccagctcctcgtctttgaactgccgccgccgtggtgacccctgctttgccccactgggagagtccttagcctgggcctcctcctagctggagtgccatggctggggggtctcagcatgtagggcttctgtggttgtggatgggaggctcctggtggggcagaaaggctgcaacgctgattcctaaggcccagctgccagggaagacagagcaggctttgtgagagaggacctccatgcccccgccacctccccactccagcagataaggccgagcccacaccatctggcccaggctggcccccacccaccttccttgcgaccaccaacacacaggaactctgtgtgagagagagggcgcccagcccaggcctggtggagggggaggggagaagccaagggacacaggagaccacccccgagcttgcctcagggccaagccggcccaacccaaccactcggggcccccatcttgggggtcacccatggcctcagatgatggggtcagcaggcccaggagaattaggaaggccatggggcagcctccagtctgctctcagcttgtgccttgtaaataaatgtacaggttggatgtgg

SEQ ID NO: 58155 - DNA, 1823 bp, Homo sapiens
gagaagctaggggtgaggaagccctggggcgctgccgccgctttccttaaccacaaatcaggccggacaggagagggaggggtgggggacagtgggtgggcattcagactgccagcactttgctatctacagccggggctcccgagcggcagaaagttccggccactctctgccgcttgggttgggcgaagccaggaccgtgccgcgccaccgccaggatatggagctactgtcgccaccgctccgcgacgtagacctgacggcccccgacggctctctctgctcctttgccacaacggacgacttctatgacgacccgtgtttcgactccccggacctgcgcttcttcgaagacctggacccgcgcctgatgcacgtgggcgcgctcctgaaacccgaagagcactcgcacttccccgcggcggtgcacccggccccgggcgcacgtgaggacgagcatgtgcgcgcgcccagcgggcaccaccaggcgggccgctgcctactgtgggcctgcaaggcgtgcaagcgcaagaccaccaacgccgaccgccgcaaggccgccaccatgcgcgagcggcgccgcctgagcaaagtaaatgaggcctttgagacactcaagcgctgcacgtcgagcaatccaaaccagcggttgcccaaggtggagatcctgcgcaacgccatccgctatatcgagggcctgcaggctctgctgcgcgaccaggacgccgcgccccctggcgccgcagccgccttctatgcgccgggcccgctgcccccgggccgcggcggcgagcactacagcggcgactccgacgcgtccagcccgcgctccaactgctccgacggcatgatggactacagcggccccccgagcggcgcccggcggcggaactgctacgaaggcgcctactacaacgaggcgcccagcgaacccaggcccgggaagagtgcggcggtgtcgagcctagactgcctgtccagcatcgtggagcgcatctccaccgagagccctgcggcgcccgccctcctgctggcggacgtgccttctgagtcgcctccgcgcaggcaagaggctgccgcccccagcgagggagagagcagcggcgaccccacccagtcaccggacgccgccccgcagtgccctgcgggtgcgaaccccaacccgatataccaggtgctctgaggggatggtggccgcccacccgcccgagggatggtgcccctagggtccctcgcgcccaaaagattgaacttaaatgcccccctcccaacagcgctttaaaagcgacctctcttgaggtaggagaggcgggagaactgaagtttccgcccccgccccacagggcaaggacacagcgcggttttttccacgcagcacccttctcggagacccattgcgatggccgctccgtgttcctcggtgggccagagctgaaccttgaggggctaggttcagctttctcgcgccctcccccatgggggtgagaccctcgcagacctaagccctgccccgggatgcaccggttatttgggggggcgtgagacccagtgcactccggtcccaaatgtagcaggtgtaaccgtaacccacccccaacccgtttcccggttcaggaccactttttgtaatacttttgtaatctattcctgtaaataagagttgctttgccagagcaggagcccctggggctgtatttatctctgaggcatggtgtgtggtgctacagggaatttgtacgtttataccgcaggcgggcgagccgcgggcgctcgctcaggtgatcaaaataaaggcgctaatttataaaaaaaaaaaaaaaaaa

SEQ ID NO: 58156 - DNA, 1530 bp, Homo sapiens
aaatggcacccagcagttggcgtgaggggctgctggagcttgggggctggtggcaggaacaagccttttccgaccccatggagctgtatgagacatccccctacttctaccaggaaccccgcttctatgatggggaaaactacctgcctgtccacctccagggcttcgaaccaccaggctacgagcggacggagctcaccctgagccccgaggccccagggccccttgaggacaaggggctggggacccccgagcactgtccaggccagtgcctgccgtgggcgtgtaaggtgtgtaagaggaagtcggtgtccgtggaccggcggcgggcggccacactgagggagaagcgcaggctcaagaaggtgaatgaggccttcgaggccctgaagagaagcaccctgctcaaccccaaccagcggctgcccaaggtggagatcctgcgcagtgccatccagtacatcgagcgcctccaggccctgctcagctccctcaaccaggaggagcgtgacctccgctaccggggcgggggcgggccccagccaggggtgcccagcgaatgcagctctcacagcgcctcctgcagtccagagtggggcagtgcactggagttcagcgccaacccaggggatcatctgctcacggctgaccctacagatgcccacaacctgcactccctcacctccatcgtggacagcatcacagtggaagatgtgtctgtggccttcccagatgaaaccatgcccaactgagattgtcttccaagccgggcatccttgcgagccccccaagctggccacagatgccactacttctgtagcaggggcctcctaagccaggctgccctgatgctaggaagccagctctggggtgccataggccagactatccccttcctcatccatgtaaggttaacccaccccccagcaagggactggacgccctcattcagctgcctccttagaggagagggcatcccctttccagggaggtaaagcaggggaccagagcgccccctcgtgtatgccccagctcagggggcaaactcaggagcttcctttttatcataacgcggcctctaattccaccccccaagtgaaacggtttgagagacgcagtgccctgacctggacaagctgtgcacgtctcctgttctggtctcttcccgatgccagtggctgggctgggcctgccctgaattgagagagaagaaggggagaggaacagccctctgttcccaagtccctggggggccaaacttttgcagtgaatattgggaaccttccagtggttttatgttttgttttgtttcgtgtgttgtttgtaaagctgccatccgaccaaggtctcctgtgctgaagttgccggggacaggcagggaaaaggggttggggcctcttgggggtgatttcttttgttaacaaagcatcgtgtggttttgccattgttttgtattttttttttttttttttttttttgctaacttatttggatttccttttttaaaaaatgaataaagactggttgcca

SEQ ID NO: 58157 - DNA, 2244 bp, Homo sapiens
gggaaggagatgcctcttccttcccttcaatagtgggttaaacccagctggcaccctctggaactacgggaacaatattcttcaagagaaggtcactctaccaaagccaggagcacagtattctcaggatctcaacaaggaagagcagaccaaggttgcttctgattccttacaaccttccgtaattccaggcttgtggccccaaattcagggccccacccttccaggaacaaatcattatagtaataatttgccttcatcttccatataccaactaagcatgtttaactacgaacgtccaaaacacttcatccagtcccaaaacccatgtggctccagattgcagcctcctggaccagaaacctccagcttctctagccagaccaaacagtcttccattatcatccagccccgccagtgtacagagcaaagattttctgcctcctcaacactgagctctcacatcaccatgtcctcctctgctttccctgcttctccccagcagcatgctggctccaacccaggccaaagggttacaaccacctataaccagtccccagccagcttcctcagctccatattaccatcacagcctgattacaatagcagtaaaatcccttccgctatggattccaactatcaacagtcctcagctggccaacctataaatgcaaagccatcccaaactgcaaatgctaagcccataccaagaactcctgatcatgaaatacaaggatcaaaagaagctttgattcaagatttggaaagaaagctgaaatgcaaggacacccttcttcataatggaaatcaacgtctaacatatgaagagaagatggctcgcagattgctaggaccacagaatgcagctgctgtgtttcaagctcaggatgacagtggtgcacaagactcgcagcaacacaactcagaacatgcgcgactgcaagttcctacatcacaagtaagaagtagatcaacctcaaggggagatgtgaatgatcaggatgcaatccaggagaaattttacccaccacgtttcattcaagtgccagagaacatgtcgattgatgaaggaagattctgcagaatggacttcaaagtgagtggactgccagctcctgatgtgtcatggtatctaaatggaagaacagttcaatcagatgatttgcacaaaatgatagtgtctgagaagggtcttcattcactcatctttgaagtagtcagagcttcagatgcaggggcttatgcatgtgttgccaagaatagagcaggagaagccaccttcactgtgcagctggatgtccttgcaaaagaacataaaagagcaccaatgtttatctacaaaccacagagcaaaaaagttttagagggagattcagtgaaactagaatgccagatctcggctatacctccaccaaagcttttctggaaaagaaataatgaaatggtacaattcaacactgaccgaataagcttatatcaagataacactggaagagttactttactgataaaagatgtaaacaagaaagatgctgggtggtatactgtgtcagcagttaatgaagctggagtgactacatgtaacacaagattagacgttacggcacgtccaaaccaaactcttccagctcctaagcagttacgggttcgaccaacattcagcaaatatttagcacttaatgggaaaggtttgaatgtaaaacaagcttttaacccagaaggagaatttcagcgtttggcagctcaatctggactctatgaaagtgaagaactttaataactttaccaacattggaaaacagccaactacaccattagtaatatatttgattacatttttttgaaattaatccatagctgtattaacagattatggttttaattaggtaatatagttaatatatatttataatattatttatcctttgactcttgcacattctatgtacccctccgatttgtgaagcctacaggaaatctgggtatatggatttgtaactgcagaagactatcttaaaatacaggattttaacatttaagtcatgcacatttaacaattacaggttataaattagtatcaactttttaaacacatctaatgcttgtaataacgtttactggtactgctttctaaatactgttttacccgttttctcttgtaggaatactaacatggtatagattatctgagtgttccacagttgtatgtcaaaagaaaataaaattcaaatatttaaaacggac

SEQ ID NO: 58158 - DNA, 1661 bp, Homo sapiens
gtttctccctaagtgcttctttggatctcaggctctaggtgcaatgtgaaggggagtccctgggcagactgatccctggctcagacagttcagtgggagaatcccaaaggccttttccctccttcctgagcctccgggcaaggagggagggatcttggttccagggtctcagtaccccctgtgccatttgagctgcttgcgctcatcatctctattaataaccaacttccctcccccactgccagtgctgcccccacgcctgcccagctcgtgttctccggtcacagcagctcagtcctccaaagctgctggaccccagggagagctgaccactgcccgagcagccggctgaatccacctccacaatgccgctctcaggaaccccggcccctaataagaagaggaaatccagcaagctgatcatggaactcactggaggtggacaggagagctcaggcttgaacctgggcaaaaagatcagtgtcccaagggatgtgatgttggaggaactgtcgctgcttaccaaccggggctccaagatgttcaaactgcggcagatgagggtggagaagtttatttatgagaaccaccctgatgttttctctgacagctcaatggatcacttccagaagttccttccaacagtggggggacagctgggcacagctggtcagggattctcatacagcaagagcaacggcagaggcggcagccaggcagggggcagtggctctgccggacagtatggctctgatcagcagcaccatctgggctctgggtctggagctgggggtacaggtggtcccgcgggccaggctggcagaggaggagctgctggcacagcaggggttggtgagacaggatcaggagaccaggcaggcggagaaggaaaacatatcactgtgttcaagacctatatttccccatgggagcgagccatgggggttgacccccagcaaaaaatggaacttggcattgacctgctggcctatggggccaaagctgaacttcccaaatataagtccttcaacaggacggcaatgccctatggtggatatgagaaggcctccaaacgcatgaccttccagatgcccaagtttgacctggggcccttgctgagtgaacccctggtcctctacaaccaaaacctctccaacaggccttctttcaatcgaacccctattccctggctgagctctggggagcctgtagactacaacgtggatattggcatccccttggatggagaaacagaggagctgtgaggtgtttcctcctctgatttgcatcatttcccctctctggctccaatttggagagggaatgctgagcagatagcccccattgttaatccagtatccttatgggaatggagggaaaaaggagagatctacctttccatcctttactccaagtccccactccacgcatccttcctcaccaactcagagctccccttctacttgctccatatggaacctgctcgtttatggaatttgctctgccaccagtaacagtcaataaacttcaaggaaaatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 58159 - DNA, 20431 bp, Homo sapiens
gctgcccagagcccccatagagagaggtccccgccgccaccctcatggatcagccacagttcagcggggcgccccgctttctcacccggcccaaggccttcgtggtgtcggtgggcaaggacgccaccctcagctgccagatcgtgggtaatcccacgccacaggtgagctgggagaaggaccagcagccggtggcggccggcgcgcgcttccgtctggcccaggacggcgacctctaccgcctcactatcctggacctggcgctgggcgacagtgggcaatacgtgtgccgcgcgcgcaatgccataggcgaggccttcgctgctgtgggcctgcaggtggacgcggaggccgcgtgcgccgagcaggcgccgcacttcctgctgcggcccacgtccatccgcgtgcgcgagggctcagaggccaccttccgctgccgcgtgggtggctccccgaggccggcagtgagctggtccaaggacgggcggcgcctgggtgagcccgacggcccccgcgtgcgcgtggaggagctcggcgaggcaagtgcgctgcgcattcgggcggcgcggccgcgcgacggcggcacttacgaggtccgcgccgagaacccgctgggcgctgccagcgccgccgcggcgctagtggtggactcggacgccgcggacacggccagccggcccgggacctccacggccgcgctcctggcgcacctgcagcggcggcgcgaggctatgcgcgccgagggcgcccccgcctcaccgcccagcaccggcacgcgcacctgcacggtgactgaaggcaagcacgcgcgcctcagctgctacgtgaccggcgagcccaagcccgagacggtgtggaagaaggacggccagctggtgaccgagggccggcgccacgtggtgtacgaggacgcgcaggagaacttcgtgctcaagatcctcttctgcaagcagtcggaccgcggcctctacacctgcacggcgtccaacctcgtgggccagacctacagctctgtgctggtcgtagtgcgcgagcccgcggttcccttcaaaaagcggctgcaagatctggaggtgcgggagaaggagtcggccacgttcctatgtgaggtgccccagccgtccactgaggccgcgtggttcaaggaggagacgcggttgtgggcgagcgccaagtacggcatcgaggaggagggcaccgagcgccgcctgaccgtgcgcaatgtctcggccgacgacgacgcggtgtacatctgcgagacgccagagggcagccgcacggtggcggagctcgcagtccaaggaaacctcctccgaaagctccctcggaagacggcggtgcgcgtgggcgacacggctatgttttgcgtggagctggcggtcccggtgggccccgtccactggctgcggaaccaggaggaagtggtggcggggggccgcgtggccatctccgcggagggcacgcgccacacactaaccatctcccagtgctgcctggaggatgtgggccaggtggcctttatggctggcgactgccagacgtccacccagttctgcgtgtcggcccccaggaagcctcccctgcaaccccctgtggatcctgtggtaaaggccaggatggagagttccgtgattctcagctggtccccaccaccccatggggaacgccctgtcactatcgacggctacctggtagagaagaagaagcttggcacctacacctggatcaggtgccacgaggctgaatgggtggctacacctgagctgaccgtggctgatgtggcggaggaggggaacttccagttccgagtgtccgctctcaacagctttggtcagagtccctacctcgagttcccggggactgtccacctggcccccaagctggccgtgaggacaccgctgaaggcggtgcaggcggtagagggtggcgaggtcactttctccgtggacctcacggtggcctcagcgggtgagtggttcctggatgggcaggccctgaaggccagcagtgtgtatgagatccactgtgatcgcacccggcacacgctcaccatccgggaggtgcccgccagcctgcacggggcgcagctgaagttcgtggccaacggcattgagagcagcatccggatggaggtccgggcggccccagggctgactgccaacaagccgccagccgcagctgcccgggaggtgctggctcggctgcacgaggaggcgcagctgctggctgagctgtcagatcaggctgcggctgtgacgtggctgaaggatggtcgcacactgtccccaggccccaagtatgaggtgcaggcatcggccgggcggcgggtgctccttgtgcgagatgtggcccgggacgatgcaggcctctacgagtgcgtcagccgcgggggccgcatcgcctaccagctctccgtgcaaggcctcgcgcgctttctgcacaaggacatggcgggcagctgtgtggatgccgtggctgggggcccggcgcagtttgagtgtgagacctccgaagcccacgtccacgtgcactggtacaaggatggcatggagctgggccactccggtgagcgcttcttgcaggaggatgtggggacgcggcaccggctggtggcagccacagtcaccaggcaggatgaaggcacctactcctgccgcgtgggcgaggactctgtggacttccggctccgcgtctctgagcccaaggtggtgtttgctaaggagcagctggcacgcaggaagctgcaggcagaggcaggagccagtgccacactgagctgcgaggtggcccaggcccagacggaggtgacgtggtacaaggatgggaagaagctgagctccagctcgaaagtgtgcatggaggccacaggctgcacgcgcaggctggttgtgcagcaggcaggccaggcggatgccggggagtatagctgcgaggctgggggccagcggctctccttccatctggatgtcaaagagcccaaggtggtgtttgccaaggaccaggtggcacacagtgaggtgcaggctgaggcaggggccagtgccacgctgagctgcgaggtggcccaggcccagacggaggtgatgtggtacaaagatgggaagaagctgagctccagcttgaaagtgcatgtagaggccaagggctgcagacggaggctggtggtgcagcaggcaggcaagacagatgccggggactacagctgcgaggccaggggccagagggtctccttccgcctgcacatcacagagcccaagatgatgtttgcaaaggagcagtcagtgcataatgaggtgcaggctgaggcgggggccagtgccatgctgagctgtgaggtggcccaggcccagacggaggtgacgtggtacaaggatgggaagaagctgagctccagctcaaaagtgggcatggaggtcaaagggtgcacacggaggctggtgctgccacaggcgggcaaagcagatgctggggagtacagctgtgaggctgggggccagagagtctccttccacctgcacatcacagagcccaagggggtgtttgcgaaggagcagtcagtgcataatgaggtgcaggctgaggcggggaccactgccatgctgagctgtgaggtggcccagccccagacagaggtgacgtggtacaaggacgggaagaagctgagctccagctcaaaagtacgcatggaggtcaagggctgcacacgaaggctggtagtgcagcaggtgggcaaagcagatgctggggagtacagctgcgaggctgggggccagagagtctcctttcaactgcacatcacagagcccaaggcagtgtttgccaaggagcagttggtgcataatgaggtgcggactgaggcaggggccagtgccacactgagctgtgaggtggcccaggcccagacagaggtgacgtggtacaaggatgggaagaagctgagctccagttcgaaagtgcgcatagaggctgcgggctgcatgcggcagctggtggtgcagcaggcaggccaggcagatgctggggagtacacctgtgaggctgggggccagcggctctccttccacctggatgtttcagagcccaaggcggtgtttgcaaaggagcagctggcacacaggaaggtgcaggccgaggcgggggccattgccacgctgagctgcgaggtggcccaggcccagacagaggtgacgtggtacaaggacgggaagaagctgagctccagctcgaaagttcgaatggaggctgtgggctgcacacggaggctggtggtgcagcaggcatgccaggcggacaccggggagtatagctgcgaggccgggggccagcggctctccttcagcctggacgtggcagagcccaaggtggtgtttgccaaggagcagccagtgcacagggaggtgcaggcccaggcgggggccagcaccacactcagctgcgaggtggctcaggcccagacggaggtgatgtggtacaaggacgggaagaagctgagcttcagctcgaaagtgcgcatggaggctgtgggctgcacacggaggctggtggtgcagcaggcgggccaggcggtcgccggggagtacagctgcgaggcggggagccagcggctctccttccacctgcacgtggcagagcccaaggcggtgtttgccaaggagcagccagcgagcagggaggtgcaggctgaggcggggaccagtgccacgctgagctgcgaggtggcccaggcccagacagaggtgacgtggtacaaggacgggaagaaactgagctccagctcgaaagtgcgaatggaggccgtgggctgcacacggaggctggtggtgcaggaggcaggccaggcggacgccggggagtacagctgcaaggccggggatcagcggctgtccttccacctgcacgtggcagagcccaaggtggtgtttgccaaggagcagccagcacacagggaggtgcaggctgaggcgggggccagtgccacgctgagctgcgaggtggcccaggcccagacagaggtgacgtggtacaaggatgggaagaagctgagttccagctcgaaagtgcgcgtggaggccgtgggctgcacacggaggctggtggtgcagcaggcgggccaggcggatgctggggagtacagctgtgaggcggggggccaacggctgtccttccgcctgcacgtggcagagctggagccccaaatttcagagagaccctgccgcagggagcctctggtggtcaaggagcatgaagacatcatcctgaccgccacactggccacaccctctgcggccacggtgacctggctcaaggatggtgtggagattcgccgcagcaagcggcatgagacagccagccagggggacacccacaccctgaccgtgcatggcgcccaggttctggacagcgccatctacagctgccgtgtgggcgcagaggggcaggacttcccagtgcaggtggaagaggtggccgccaagttctgccggctgctggagcctgtgtgcggcgagctgggtggcacggtgacactggcctgcgagctaagcccagcgtgtgcagaggtggtgtggcgctgcggcaacacgcagcttcgggtgggcaagcgcttccagatggtggccgaggggcccgtgcgctcactcactgtgttggggctgcgcgcagaggacgcaggggagtacgtgtgtgagagccgtgatgaccacaccagtgcgcagctcaccgtcagtgtgccccgagtggtgaagtttatgtctgggctgagcaccgtggtcgcagaggagggcggcgaggccaccttccagtgcgtggtgtcccccagtgatgtggcagtcgtgtggttccgggacggtgccctgcttcagcccagcgagaagtttgccatatcacagagtggcgccagccacagcctgaccatctcagacctggtgctggaggacgcgggccagatcaccgtggaggctgagggcgcctcatcctctgctgccctgagggtccgagaggcgcctgtgctgttcaaaaagaagctggagccgcagacggtggaggagcggagctcggtgaccctggaggtggagctgacgcggccgtggccggagctgaggtggacacggaacgcgacggccctggcgccgggaaagaacgtggagatccacgccgagggcgcccgccaccgcctggttctgcacaacgtaggttttgccgaccgtggcttctttggctgcgagacgccggatgacaagacacaggccaaactcaccgtggagatgcgccaggtacggctcgtacggggcctgcaggcagtggaggcacgggagcagggcacggctaccatggaggtgcagctgtcgcatgcggacgtggatggcagctggactcgtgacggtctgcggttccagcaggggcccacgtgccacctggctgtgcggggccccatgcacaccctcacactctcggggctgcggccagaggatagtggccttatggtcttcaaggccgaaggagtgcacacgtcggcgcggctcgtggtcaccgagcttcccgtgagcttcagccgcccgctgcaggacgtggtgaccactgagaaggagaaggttaccctggagtgcgagctgtcgcgtcctaatgtggatgtgcgctggctgaaggacggtgtggagctgcgggcaggcaagacgatggccatcgcagcccagggcgcctgcaggagcctcaccatttaccggtgcgagttcgcggatcagggagtgtatgtgtgtgatgcccatgatgcccagagctctgcctccgtgaaggtacaaggaaggacatacactctcatctaccggagagtcctggcggaagatgcaggagagatccaatttgtagccgaaaatgcagaatcgcgagcccagctccgagtgaaggagctgccagtgaccctcgtgcgcccgctgcgggacaagattgccatggagaagcaccgcggtgtgctggagtgtcaggtgtcccgggccagcgcccaggtgcggtggttcaagggcagtcaggagctgcagcccgggcccaagtacgagctggtcagtgatggcctctaccgcaagctgatcatcagtgatgtccacgcagaggacgaggacacctacacctgtgacgccggtgatgtcaagaccagtgcacagttcttcgtggaagagcaatccatcaccattgtgcggggtctgcaggacgtgacagtgatggagcccgctcctgcctggtttgagtgtgagacctccatcccctcagtgcggccacctaagtggctcctggggaagacggtgttgcaggctggggggaacgtgggcctggagcaggagggcacggtgcaccggctgatgctgcggcggacctgctccaccatgaccgggcccgtgcacttcaccgttggcaagtcgcgctcctctgcccgcctggtggtctcagacatccccgtagtcctcacacggccgttggagcccaagacagggcgtgagctgcagtcagtggtcctgtcctgcgacttccggccagcccccaaggctgtgcagtggtacaaggatgacacgcccctgtctccctctgagaagtttaagatgagcctggagggtcagatggctgagctgcgcatcctccggctcatgcctgctgatgctggtgtctaccggtgccaggcgggcagtgcccacagcagcactgaggtcactgtggaagcgcgggaggtgacagtgacagggccgctacaggatgcagaggccacggaggagggctgggccagcttctcctgtgagctgtcccacgaggatgaggaggtcgagtggtcgctcaacgggatgcccctgtacaacgacagcttccatgagatctcacacaagggccggcgccacacgctggtactgaagagcatccagcgggctgatgcgggcatagtacgcgcctcctccctgaaggtgtcgacctctgcccgcctggaggtccgagtgaagccggtggtgttcctgaaggcgctggatgacctgtccgcagaggagcgcggcaccctggccctgcagtgtgaagtctctgaccccgaggcccatgtggtgtggcgcaaagatggcgtgcagctgggccccagtgacaagtatgacttcctgcacacggcgggcacgcgggggctcgtggtgcatgacgtgagccctgaagacgccggcctgtacacctgccacgtgggctccgaggagacccgggcccgggtccgcgtgcacgatctgcacgtgggcatcaccaagaggctgaagacaatggaggtgctggaaggggaaagctgcagctttgagtgcgtcctgtcccacgagagtgccagcgacccggccatgtggacagtcggtgggaagacagtgggcagctccagccgcttccaggccacacgtcagggccgaaaatacatcctggtggtccgggaggctgcaccaagtgatgccggggaggtggtcttctctgtgcggggcctcacctccaaggcctcactcattgtcagagagaggccggccgccatcatcaagcccctggaagaccagtgggtggcgccaggggaggacgtggagctgcgctgtgagctgtcacgggcgggaacgcccgtgcactggctgaaggacaggaaggccatccgcaagagccagaagtatgatgtggtctgcgagggcacgatggccatgctggtcatccgcggggcctcgctcaaggacgcgggcgagtacacgtgtgaggtggaggcttccaagagcacagccagcctccatgtggaagaaaaagcaaactgcttcacagaggagctgaccaatctgcaggtggaggagaaaggcacagctgtgttcacgtgcaagacggagcaccccgcggccacagtgacctggcgcaagggcctcttggagctacgggcctcagggaagcaccagcccagccaggagggcctgaccctgcggctcaccatcagtgccctggagaaggcagacagcgacacctatacctgcgacattggccaggcccagtcccgggcccagctcctagtgcaaggccggagagtgcacatcatcgaggacctggaggatgtggatgtgcaggagggctcctcggccaccttccgttgccggatctccccggccaactacgagcctgtgcactggttcctggacaagacacccctgcatgccaacgagctcaatgagatcgatgcccagcccgggggctaccacgtgctgaccctgcggcagctggcgctcaaggactcgggcaccatctactttgaggcgggtgaccagcgggcctcggccgccctgcgggtcactgagaagccaagcgtcttctcccgggagctcacagatgccaccatcacagagggtgaggacttgaccctggtgtgcgagaccagcacctgcgacattcctgtgtgctggaccaaggatgggaagaccctgcgggggtctgcccggtgccagctgagccatgagggccaccgggcccagctgctcatcactggggccaccctgcaggacagtggacgctacaagtgtgaggctgggggcgcctgcagcagctccattgtcagggtgcatgcgcggccagtgcggttccaggaggccctgaaggacctggaggtgctggagggtggtgctgccacactgcgctgtgtgctgtcatctgtggctgcgcccgtgaagtggtgctatggaaacaacgtcctgaggccaggtgacaaatacagcctacgccaggagggtgccatgctggagctggtggtccggaacctccggccgcaggacagcgggcggtactcatgctccttcggggaccagactacttctgccaccctcacagtgactgccctgcctgcccagttcatcgggaaactgagaaacaaggaggccacagaaggggccacggccacgctgcggtgtgagctgagcaaggcagcccctgtggagtggagaaaggggtccgagaccctcagagatggggacagatactgtctgaggcaggacggggccatgtgtgagctgcagatccgtggcctggccatggtggatgccgcggagtactcgtgtgtgtgtggagaggagaggacctcagcctcactcaccatcaggcccatgcctgcccacttcataggaagactgagacaccaagagagcatagaaggggccacagccacgctgcggtgtgagctgagcaaggcggcccccgtggagtggaggaaggggcgtgagagcctcagagatggggacagacatagcctgaggcaggacggggctgtgtgcgagctgcagatctgtggcctggctgtggcagatgctggggagtactcctgtgtgtgtggggaggagaggacctctgccactctcaccgtgaaggccctgccagccaagttcacagagggtctgaggaatgaagaggccgtggaaggggccacagccatgttgtggtgtgaactgagcaaggtggcccctgtggagtggaggaaggggcccgagaacctcagagatggggacagatacatcctgaggcaggaggggaccaggtgtgagctgcagatctgtggcctggccatggcggacgccggggagtacttgtgtgtgtgcgggcaggagaggacctcagccacgctcaccatcagggctctgcctgccaggttcatagaagatgtgaaaaaccaggaggccagagaaggggccacagctgtgctgcagtgtgagctgaacagtgcagcccctgtggagtggagaaaggggtctgagacccttagagatggggacagatacagcctgaggcaggacgggactaaatgtgagctgcagattcgtggcctggccatggcagacactggggagtactcgtgcgtgtgcgggcaggagaggacctcggctatgctcaccgtcagggctctacccatcaagttcacagagggtctgaggaacgaagaggccacagaaggggcaacagccgtgctgcggtgtgagctgagcaagatggcccccgtggagtggtggaaggggcatgagaccctcagagatggagacagacacagcctgaggcaggacggggccaggtgtgagctgcagatccgcggcctcgtggcagaggacgctggggagtacctgtgcatgtgcgggaaggagaggacctcagccatgctcaccgtcagggccatgccttccaagttcatagagggtctgaggaatgaagaggccacagaaggggacacggccacgctgtggtgtgagctgagcaaggcggcaccggtggagtggaggaaggggcatgagaccctcagagatggggacagacacagcctgaggcaggacgggtccaggtgtgagctgcagatccgtggcctggctgtggtggatgccggggagtactcgtgtgtgtgcgggcaggagaggacctcagccacactcactgtcagggccctgcctgccagattcatagaagatgtgaaaaaccaggaggccagagaaggggccacggccgtgctgcaatgtgagctgagcaaggcggcccccgtggagtggaggaaggggtctgagaccctcagaggtggggacagatacagcctgaggcaggatgggaccagatgtgagctgcagattcatggcctgtctgtggcagacactggggagtactcgtgtgtgtgcgggcaggagaggacctcggccacactcaccgtcagggccccacagccagtgttccgggagccgctgcagagtctgcaggcggaggagggctccacggccaccctgcagtgtgagctgtctgagcccactgctacagtggtctggagcaagggtggcctgcagctgcaggccaatgggcgccgggagccacggcttcagggctgcaccgcggagctggtgttacaggacctacaacgtgaagacactggcgaatacacttgcacctgtggctcccaggccaccagtgccaccctcactgtcacagctgcgcctgtgcggttcctccgagagctgcagcaccaggaggtggatgagggaggcaccgcacacttatgctgcgagctgagccgggcgggtgcgagcgtggagtggcgcaagggctccctacagctcttcccttgtgccaagtaccagatggtgcaggatggtgcagctgcagagctgctggtacgcggagtggagcaggaggatgcgggtgactacacgtgtgacacgggccacacgcagagcatggccagcctctctgtccgtgtccccaggcccaagttcaagacccggcttcagagtctggagcaggagacaggtgacatagcccggctgtgctgtcagctgagtgatgcagagtcgggggccgtggtgcaatggctcaaggagggcgtggagctgcatgcgggccccaagtacgagatgcggagccagggggccacgcgggagctgctgatccaccaactggaggccaaggacacgggcgagtatgcctgtgtgacaggcggccagaaaaccgctgcctccctcagggtcacagagcctgaggtgaccattgtacgggggctggttgatgcggaggtgacggccgatgaggatgttgagttcagctgtgaggtgtccagggctggagccacaggcgtgcagtggtgcctacagggcctgccactgcaaagcaatgaggtgacagaggtggctgtgcgggatggccgcatccacaccctgcggctgaagggcgtgacgcccgaggacgctggcactgtctccttccatttgggaaaccatgcttcctctgcccagctcaccgtcagagctcctgaggtgaccatcctggagcccctgcaggacgtgcagctcagtgagggccaggatgccagcttccagtgccggctatccagagcttcaggccaggaggcccgctgggctttaggaggggtgcccctgcaggccaacgagatgaatgacatcactgtggagcagggcacactccacctgctcaccctgcacaaggtgacccttgaggatgctggaactgtcagtttccacgtgggcacgtgtagctctgaggcccagctgaaagtcacagccaagaacacggtggtgcgggggctggagaatgtggaggcgctggagggcggcgaggcgctgttcgagtgccagctgtcccagcccgaggtggccgcccacacctggctgctggacgacgaacccgtgcacacctcggagaacgccgaggtggtcttcttcgagaacggcctgcgccacctgctgctgctcaaaaacttgcggccacaagacagctgccgggtgaccttcctggctggggatatggtgacgtccgcattcctcacggtccgaggctggcgcctggagatcctggagcctctgaaaaacgcggcggtccgggccggcgcacaggcatgcttcacctgcacgctcagcgaggcggtgcccgtgggagaggcgtcctggtacatcaatggcgcggcagtgcagccggatgacagcgactggactgtcaccgccgacggcagtcaccacgccctactgctgcgcagcgcccagccccaccacgccggggaggtcaccttcgcttgccgcgacgccgtggcctctgcgcggctcaccgtgctgggcctccctgatcccccagaggatgctgaggtggtggctcgcagcagccacactgtgacactgtcttgggcagctcccatgagtgatggaggcggtggtctctgtggctaccgcgtggaggtgaaggagggggccacaggccagtggcggctgtgccacgagctggtgcctggacccgagtgtgtggtggatggcctggcccccggggagacctaccgcttccgtgtggcagctgtgggccctgtgggtgctggggaaccggttcacctgccccagacagtgcggcttgcagagccaccgaagcctgtgcctccccagccctcagcccctgagagccggcaggtggcagctggtgaagatgtctctctggagcttgaggtggtggctgaggctggtgaggtcatctggcacaagggaatggagcgcatccagcccggtgggcggttcgaggtggtctcccagggtcggcaacagatgctggtgatcaagggcttcacggcagaagaccagggcgagtaccactgtggcctggctcagggctccatctgccctgcggctgccaccttccaggtggcactgagcccagcctctgtggatgaggcccctcagcccagcttgccccccgaggcagcccaggagggtgacctgcacctactgtgggaggccctggctcggaaacgtcgcatgagccgtgagcccacgctggactccattagcgagctgccagaggaggacggccgctcgcagcgcctgccacaggaggcagaggaggtggcacctgatctctctgaaggctactccacggccgatgagctggcccgcactggagatgctgacctctcacacaccagctctgatgatgagtcccgggcaggcaccccttccctggtcacctacctcaagaaggctgggaggccaggcacctcaccactggccagcaaggttggggccccagcagccccctctgtgaagccacagcagcagcaggagccactggctgctgtgcgcccaccactgggagacctgagcaccaaagacctgggtgatccctcaatggacaaggcagctgtgaagatccaggctgcctttaagggctacaaggtccggaaggagatgaagcagcaggaagggcccatgttctcccacacatttggggacaccgaggcacaggtgggggatgccctgcggctggagtgtgtcgtggccagcaaggcagatgtgcgagcccgctggctgaaggatggtgtggagctgaccgatgggcggcaccatcacatcgaccagcttggggatggcacctgctctctgctgatcactggcctggaccgtgctgatgctggctgctacacctgtcaggtgagcaacaagtttggccaggtgacccacagtgcctgtgtggtggtcagtgggtcagagagtgaagccgagagctcctctgggggtgagctggacgatgccttccgccgggctgcccgtcggctgcaccggctcttccgcaccaaaagtccggctgaagtttcagatgaggagctcttcctgagtgcagacgagggccctgcagagccagaggagcccgcggactggcagacataccgcgaagatgagcatttcatctgcatccgttttgaggcgctcactgaggcccgccaggcggtaactcgcttccaggagatgtttgccacactgggcattggggtggagatcaagctggtggaacaggggcctcggagggtagagatgtgcatcagcaaagagactcctgcccctgtggtgcctccagagccattgcccagcctactgacttctgacgctgccccagtgttcctgactgagttgcagaaccaagaagtgcaggatgggtatcctgtgagctttgactgcgtggtgacaggtcagcccatgcccagtgtgcgctggttcaaggatgggaagttgttggaggaggatgatcactacatgattaatgaagaccaacagggtggccatcagctcatcatcacagccgtggtgccagcagacatgggcgtctaccgctgcctggccgagaacagcatgggtgtctcctccaccaaggctgagctccgtgtggacttgacaagcacagactatgacactgcagcagatgccacggagtcctcatcctacttcagtgcccaaggctacctgtccagccgggagcaggagggaacagagtccaccactgatgagggccagctgccccaggtggtggaggagctgagagacctccaggtggcccctggcacacgcctggccaagttccagctcaaggtgaaaggctaccctgctcccagattatactggttcaaagatggccagcccctgaccgcatctgcccacatccgcatgactgacaagaagatcctgcacaccctggagatcatctccgtcacccgggaggactctggccagtatgcagcctatatcagcaatgccatgggtgctgcctactcgtctgcccggctgctggttcgaggccctgatgagccagaagagaagcctgcatcagatgtgcatgagcagctggtgccgccccgaatgctggagaggttcacccccaagaaagtgaagaaaggctccagcatcaccttctctgtgaaggtagaaggacgcccggtgcccaccgtgcactggctcagggaggaggctgagagaggcgtgctgtggattggccctgacacaccgggctacaccgtggccagctctgcgcagcagcacagcctggtcctgctggacgtgggccggcagcaccagggcacctacacatgcattgccagcaacgctgccggccaggccctctgctccgccagcctgcacgtctcgggcctgcctaaggtggaggagcaggagaaagtgaaggaagcgctgatttccactttcctgcaggggaccacacaagccatctcagcacaggggttggaaactgcgagttttgctgaccttggtgggcagaggaaagaagagcctctggctgccaaggaggccctcggccacctgtccctcgctgaggtgggcacagaggagttcctgcagaaactgacctcccagatcactgagatggtatcggccaagatcacgcaggccaagctgcaggtgcccggaggtgacagtgatgaggactccaagacaccatctgcatccccccgccatggccgatcacggccatcctccagcatccaggagtcttcctcagagtcagaggacggcgatgcccgaggcgagatctttgacatctacgtggtcaccgctgactacctgcccctaggggctgagcaggatgccatcacgctgcgggaaggccagtatgtggaggtcctggatgcagcccacccactgcgctggcttgtccgcaccaagcccaccaagtccagcccctcacggcagggctgggtgtcaccagcctacctggacaggaggctcaagctgtcacctgagtggggggccgctgaggcccctgagttccctggggaggctgtgtctgaagacgaatacaaggcaaggctgagctctgtgatccaggagctgctgagttctgagcaggccttcgtggaggagctgcagttcctgcagagccaccacctgcagcacctggagcgctgcccccacgtgcccatagctgtggccggccagaaggcagtcatcttccgcaatgtgcgggacatcggccgcttccacagcagcttcctgcaggagttgcagcagtgcgacacggacgacgacgtggccatgtgcttcatcaagaaccaggcggcctttgagcagtacctggagttcctggtggggcgtgtgcaggctgagtcggtggtcgtcagcacggccatccaggagttctacaagaaatacgcggaggaggccctgttggcaggggacccctctcagcccccgccaccacctctgcagcactacctggagcagccagtggagcgggtgcagcgctaccaggccttgctgaaggagctgatccgcaacaaggcgcggaacagacagaactgcgcgctgctggagcaggcctatgccgtggtgtctgccctgccacagcgcgctgagaacaagctgcacgtgtccctcatggagaactacccaggcaccctgcaggccctgggcgagcccatccgccagggccacttcatcgtgtgggagggtgcaccgggggcccgcatgccctggaagggccacaaccgtcacgtgttcctcttccgcaaccacctggtaatctgcaagccccggcgagactcccgcaccgataccgtcagctacgtgttccggaacatgatgaagctgagcagcatcgacctgaacgaccaggtggagggggatgaccgcgccttcgaggtgtggcaggagcgggaggactcggtgcgcaagtacctgctgcaggcacggacagccattatcaagagctcgtgggtgaaggagatctgtggcatccagcagcgtctggccctgcctgtgtggcggcccccggactttgaagaggagctggccgactgcacagccgagctgggtgagacagtcaagctggcctgccgcgtgacgggcacacccaagcctgtcatcagctggtacaaagatgggaaagcagtgcaggtggacccccaccacatcctcattgaagaccctgatggctcgtgtgcactcatcctggacagcctgaccggtgtggactctggccagtacatgtgcttcgcggccagcgccgctggcaactgcagtaccctgggcaagatcctggtgcaagtcccaccacggttcgtgaacaaggtccgggcctcaccctttgtggagggagaggacgcccagttcacctgcaccatcgaaggcgccccgtacccgcagatcaggtggtacaaggacggggccctgctgaccactggcaacaagttccagacactgagtgagcctcgcagcggcctgctagtgctggtgatccgggcggccagcaaggaggacctggggctctacgagtgtgagctggtgaaccggctgggctccgcgcgggctagtgcggagctgcgcattcagagccccatgctgcaggcccaggagcagtgtcacagggagcagctcgtggctgcagtggaagtcactgagcaagagactaaagtccccaagaaaaccgtcatcatagaagagaccatcaccactgtggtgaagagcccacgtggccaacgacggtcccccagcaagtccccctcccgctcaccttcccgctgctctgccagcccgctgaggccaggcctactggcccccgacctgctgtacctgccaggtgctggccagccccgcaggccggaggcagaaccaggccagaagcccgtggtgcccacactgtatgtgacggaggccgaggcccactctccagctctgcccggactctcggggccccagcccaagtgggtggaggtggaggagaccattgaagtccgggtgaagaagatgggcccgcagggtgtgtctcccaccacagaggtgcccaggagctcatcggggcatctcttcacactgcccggtgcgacccccggaggggaccccaattccaacaactccaacaacaagctgctggcccaggaggcctgggcccagggcacagccatggtcggcgtcagagagccccttgtcttccgcgtggatgccagaggcagtgtggactgggctgcttctggcatgggcagcctggaggaggagggcaccatggaggaggcgggagaggaagagggggaagacggagacgcctttgtgacggaggagtcccaggacacacacagccttggggatcgtgaccccaagatcctcacgcacaacggccgcatgctgacactggctgacctggaagattacgtgcctggggaaggggagaccttccactgtggtggccctgggcctggcgcccctgatgaccctccctgcgaggtctcggtgatccagagagagatcggggagcccacggtggggcagcctgtgctgctcagcgtggggcatgcactgggtccccgaggccctctcggcctctttaggcctgagccccgtggggcgtcaccaccgggaccccaggtccgtagccttgagggcacctccttcctcttgcgggaggccccggctcggcctgtgggcagtgctccctggacgcagtctttctgcacccgcatccggcgttctgcggacagtggccagagcagcttcaccacagagctttccacccagaccgtcaacttcgggacagtgggggagacggtcacccttcacatctgcccagacagggatggggatgaggcggcacagccctgatgctgctgccatggtggcttggggcagcggggagaaaggagtgtccttgaggcctaggacgctgcccggcctcagcagcagccctgggagcctcctgagggccctccctgtccctggccacgggcccttcttacctcactcaacttcagccaggaggactgggtggtgcttgcaatgttggaatgaccggctcaaagacctcagctctgggctgtttcctgtcagcctggcaggagcctcaggactgtggacgaaggatgtggccttgggcatttgtcctgttcccacatgggcctggtccctccctcctggccccagccacagctgccaggcctgacatggccttgcctctcctgcagtcttggtgactgagacccttgggtggcgcttcccagctctgcaggccctcctggccttttctgcagggtggacacagggtctgtgtgtgggcagcagcccctgtctctcagcaagaataaagcagcttcctgtgcaaaaaaaaaaaaaaaaaaaaaaaaaaaaaa

SEQ ID NO: 58160 - DNA, 2696 bp, Homo sapiens
ggctaatgcacagacatgaacatctattgaggaaaaccacaaaaaacttcaaaacagctacaacgggaaaaagagagttttgtcccacagtcagcaggccactagtttattaacttccagtcaccttgatttttgctaaaatgaagactctgcagtctacacttctcctgttactgcttgtgcctctgataaagccagcaccaccaacccagcaggactcacgcattatctatgattatggaacagataattttgaagaatccatatttagccaagattatgaggataaatacctggatggaaaaaatattaaggaaaaagaaactgtgataatacccaatgagaaaagtcttcaattacaaaaagatgaggcaataacaccattacctcccaagaaagaaaatgatgaaatgcccacgtgtctgctgtgtgtttgtttaagtggctctgtatactgtgaagaagttgacattgatgctgtaccacccttaccaaaggaatcagcctatctttacgcacgattcaacaaaattaaaaagctgactgccaaagattttgcagacatacctaacttaagaagactcgattttacaggaaatttgatagaagatatagaagatggtactttttcaaaactttctctgttagaagaactttcacttgctgaaaatcaactactaaaacttccagttcttcctcccaagctcactttatttaatgcaaaatacaacaaaatcaagagtaggggaatcaaagcaaatgcattcaaaaaactgaataacctcaccttcctctacttggaccataatgccctggaatccgtgcctcttaatttaccagaaagtctacgtgtaattcatcttcagttcaacaacatagcttcaattacagatgacacattctgcaaggctaatgacaccagttacatccgggaccgcattgaagagatacgcctggagggcaatccaatcgtcctgggaaagcatccaaacagttttatttgcttaaaaagattaccgatagggtcatacttttaacctctattggtacaacatataaatgaaagtacacctacactaatagtctgtctcaacaatgagtaaaggaacttaagtattggtttaatattaaccttgtatctcattttgaaggaatttaatattttaagcaaggatgttcaaaatcttacatataataagtaaaaagtaagactgaatgtctacgttcgaaacaaagtaatatggaaaatatttaaacagcattacaaaatcctagtttatactatactaccatttaaatatcatgtttttatataaatgcccaaatttgagatgcattattcctattactaatgatgtaagtacgaggataaatccaagaaactttcaactctttgcctttcctggcctttactggatcccaaaagcatttaaggtacatgttccaaaaactttgaaaagctaaatgtttcccatgatcgctcattcttcttttattattcatacgttattccttataaagtaagaactttgttttcctcctatcaaggcagctattttattaaatttttcacttagtctgagaaatagcagatagtctcatatttaggaaaactttccaaataaaataaatgttattctctgataaagagctaatacagaaatgttcaagttattttactttctggtaatgtcttcagtaaaatattttctttatctaaatattaacattctaagtctaccaaaaaaagttttaaactcaagcaggccaaaaccaatatgcttataagaaataatgaaaagttcatccatttctgataaagttctctatggcaaagtctttcaaatacgagataactgcaaaatattttccttttatactacagaaatgagaatctcatcaataaattagttcaagcataagatgaaaacagaatattctgtggtgccagtgcacactaccttcccacccatacacatccatgttcactgtaacaaactgaatattcacaataaagcttctgagtaacactttctgattactcatgataaactgacatggctaactgcaagaattaaatcttctatctgagagtaataatttatgatgactcagtggtgccagagtaaagtttctaaaataacattcctctcacttgtaccccactaaaagtattagtctacacattacattgaagttaaacacaaaattatcagtgttttagaaacatgagtccggactgtgtaagtaaaagtacaaacattatttccaccataaagtatgtattgaaatcaagttgtctctgtgtacagaatacatacttattcccatttttaagcatttgcttctgttttccctacctagaatgtcagatgtttttcagttatctccccatttgtcaaagttgacctcaagataacatttttcattaaagcatctgagatctaagaacacaattattattctaacaatgattattagctcattcacttattttgataactaatgatcacagctattatactactttctcgttattttgtgtgcatgcctcatttccctgacttaaacctcactgagagcgcaaaatgcagctttatactttttactttcaattgcctagcacaatagtgagtacatttgaattgaatatataataaatattgcaaaataaaatccaaaaaaaaaaaaaaaaa

SEQ ID NO: 58161 - DNA, 2793 bp, Homo sapiens
ggctaatgcacagacatgaacatctattgaggaaaaccacaaaaaacttcaaaacagctacaacgggttaaatactgttctctggcccttactgcgcacaccctgccaaaacatcctctaagcttttaaatattgcttcgatggtctgaatttttatttccagggaaaaagagagttttgtcccacagtcagcaggccactagtttattaacttccagtcaccttgatttttgctaaaatgaagactctgcagtctacacttctcctgttactgcttgtgcctctgataaagccagcaccaccaacccagcaggactcacgcattatctatgattatggaacagataattttgaagaatccatatttagccaagattatgaggataaatacctggatggaaaaaatattaaggaaaaagaaactgtgataatacccaatgagaaaagtcttcaattacaaaaagatgaggcaataacaccattacctcccaagaaagaaaatgatgaaatgcccacgtgtctgctgtgtgtttgtttaagtggctctgtatactgtgaagaagttgacattgatgctgtaccacccttaccaaaggaatcagcctatctttacgcacgattcaacaaaattaaaaagctgactgccaaagattttgcagacatacctaacttaagaagactcgattttacgggaaatttgatagaagatatagaagatggtactttttcaaaactttctctgttagaagaactttcacttgctgaaaatcaactactaaaacttccagttcttcctcccaagctcactttatttaatgcaaaatacaacaaaatcaagagtaggggaatcaaagcaaatgcattcaaaaaactgaataacctcaccttcctctacttggaccataatgccctggaatccgtgcctcttaatttaccagaaagtctacgtgtaattcatcttcagttcaacaacatagcttcaattacagatgacacattctgcaaggctaatgacaccagttacatccgggaccgcattgaagagatacgcctggagggcaatccaatcgtcctgggaaagcatccaaacagttttatttgcttaaaaagattaccgatagggtcatacttttaacctctattggtacaacatataaatgaaagtacacctacactaatagtctgtctcaacaatgtgtaaaggaacttaagtattggtttaatattaaccttgtatctcattttgaaggaatttaatattttaagcaaggatgttcaaaatcttacatataataagtaaaaagtaagactgaatgtctacgttcgaaacaaagtaatatgaaaatatttaaacagcattacaaaatcctagtttatactagactaccatttaaaaatcatgtttttatataaatgcccaaatttgagatgcattattcctattactaatgatgtaagtacgaggataaatccaagaaactttcaactctttgcctttcctggcctttactggatcccaaaagcatttaaggtacatgttccaaaaactttgaaaagctaaatgtttcccatgatcgctcattcttcttttatgattcatacgttattccttataaagtaagaactttgttttcctcctatcaaggcagctattttattaaatttttcacttagtctgagaaatagcagatagtctcatatttaggaaaactttccaaataaaataaatgttattctctgataaagagctaatacagaaatgttcaagttattttactttctggtaatgtcttcagtaaaatattttctttatctaaatattaacattctaagtctaccaaaaaaagttttaaactcaagcaggccaaaaccaatatgcttataagaaataatgaaaagttcatccatttctgataaagttctctatggcaaagtctttcaaatacgagataactgcaaaatattttccttttatactacagaaatgagaatctcatcaataaattagttcaagcataagatgaaaacagaatattctgtggtgccagtgcacactaccttcccacccatacacatccatgttcactgtaacaaactgaatattcacaataaagcttctgagtaacactttctgattactcatgataaactgacatggctaactgcaagaattaaatcttctatctgagagtaataatttatgatgactcagtggtgccagagtaaagtttctaaaataacattcctctcacttgtaccccactaaaagtattagtctacacattacattgaagttaaacacaaaattatcagtgttttagaaacatgagtccggactgtgtaagtaaaagtacaaacattatttccaccataaagtatgtattgaaatcaagttgtctctgtgtacagaatacatacttattcccatttttaagcatttgcttctgttttccctacctagaatgtcagatgtttttcagttatctccccatttgtcaaagttgacctcaagataacatttttcattaaagcatctgagatctaagaacacaattattattctaacaatgattattagctcattcacttattttgataactaatgatcacagctattatactactttctcgttattttgtgtgcatgcctcatttccctgacttaaacctcactgagagcgcaaaatgcagctttatactttttactttcaattgcctagcacaatagtgagtacatttgaattgaatatataataaatattgcaaaataaaatccaaaaaaaaaaaaaaaaa

SEQ ID NO: 58162 - DNA, 2976 bp, Homo sapiens
ggctaatgcacagacatgaacatctattgaggaaaaccacaaaaaacttcaaaacagctacaacggtatcctaagaatatttcaattaaatattagtatgtctgctgaaggcactaattattaagaaacttaaaattatcaatctttcttgaatttctgatagagaagtaaaactattttccaaaactatttttcagaatgttcactgatacataaaaactgctagcatctaattaaagatcactaagggttaaatactgttctctggcccttactgcgcacaccctgccaaaacatcctctaagcttttaaatattgcttcgatggtctgaatttttatttccagggaaaaagagagttttgtcccacagtcagcaggccactagtttattaacttccagtcaccttgatttttgctaaaatgaagactctgcagtctacacttctcctgttactgcttgtgcctctgataaagccagcaccaccaacccagcaggactcacgcattatctatgattatggaacagataattttgaagaatccatatttagccaagattatgaggataaatacctggatggaaaaaatattaaggaaaaagaaactgtgataatacccaatgagaaaagtcttcaattacaaaaagatgaggcaataacaccattacctcccaagaaagaaaatgatgaaatgcccacgtgtctgctgtgtgtttgtttaagtggctctgtatactgtgaagaagttgacattgatgctgtaccacccttaccaaaggaatcagcctatctttacgcacgattcaacaaaattaaaaagctgactgccaaagattttgcagacatacctaacttaagaagactcgattttacgggaaatttgatagaagatatagaagatggtactttttcaaaactttctctgttagaagaactttcacttgctgaaaatcaactactaaaacttccagttcttcctcccaagctcactttatttaatgcaaaatacaacaaaatcaagagtaggggaatcaaagcaaatgcattcaaaaaactgaataacctcaccttcctctacttggaccataatgccctggaatccgtgcctcttaatttaccagaaagtctacgtgtaattcatcttcagttcaacaacatagcttcaattacagatgacacattctgcaaggctaatgacaccagttacatccgggaccgcattgaagagatacgcctggagggcaatccaatcgtcctgggaaagcatccaaacagttttatttgcttaaaaagattaccgatagggtcatacttttaacctctattggtacaacatataaatgaaagtacacctacactaatagtctgtctcaacaatgtgtaaaggaacttaagtattggtttaatattaaccttgtatctcattttgaaggaatttaatattttaagcaaggatgttcaaaatcttacatataataagtaaaaagtaagactgaatgtctacgttcgaaacaaagtaatatgaaaatatttaaacagcattacaaaatcctagtttatactagactaccatttaaaaatcatgtttttatataaatgcccaaatttgagatgcattattcctattactaatgatgtaagtacgaggataaatccaagaaactttcaactctttgcctttcctggcctttactggatcccaaaagcatttaaggtacatgttccaaaaactttgaaaagctaaatgtttcccatgatcgctcattcttcttttatgattcatacgttattccttataaagtaagaactttgttttcctcctatcaaggcagctattttattaaatttttcacttagtctgagaaatagcagatagtctcatatttaggaaaactttccaaataaaataaatgttattctctgataaagagctaatacagaaatgttcaagttattttactttctggtaatgtcttcagtaaaatattttctttatctaaatattaacattctaagtctaccaaaaaaagttttaaactcaagcaggccaaaaccaatatgcttataagaaataatgaaaagttcatccatttctgataaagttctctatggcaaagtctttcaaatacgagataactgcaaaatattttccttttatactacagaaatgagaatctcatcaataaattagttcaagcataagatgaaaacagaatattctgtggtgccagtgcacactaccttcccacccatacacatccatgttcactgtaacaaactgaatattcacaataaagcttctgagtaacactttctgattactcatgataaactgacatggctaactgcaagaattaaatcttctatctgagagtaataatttatgatgactcagtggtgccagagtaaagtttctaaaataacattcctctcacttgtaccccactaaaagtattagtctacacattacattgaagttaaacacaaaattatcagtgttttagaaacatgagtccggactgtgtaagtaaaagtacaaacattatttccaccataaagtatgtattgaaatcaagttgtctctgtgtacagaatacatacttattcccatttttaagcatttgcttctgttttccctacctagaatgtcagatgtttttcagttatctccccatttgtcaaagttgacctcaagataacatttttcattaaagcatctgagatctaagaacacaattattattctaacaatgattattagctcattcacttattttgataactaatgatcacagctattatactactttctcgttattttgtgtgcatgcctcatttccctgacttaaacctcactgagagcgcaaaatgcagctttatactttttactttcaattgcctagcacaatagtgagtacatttgaattgaatatataataaatattgcaaaataaaatccaaaaaaaaaaaaaaaaa

SEQ ID NO: 58163 - DNA, 9176 bp, Homo sapiens
ctggtggtccagtacctccaaagatatggaatacactcctgaaatatcctgaaaacttttttttttcagaatcctttaataagcagttatgtcaatctgaaagttgcttacttgtactttatattaatagctattcttgtttttcttatccaaagaaaaatcctctaatccccttttcacatgatagttgttaccatgtttaggcattagtcacatcaacccctctcctctcccaaacttctcttcttcaaatcaaactttattagtccctcctttataatgattccttgcctcgttttatccagatcaattttttttcactttgatgcccagagctgaagaaatggactactgtataaattattcattgccaagagaataattgcattttaaacccatattataacaaagaataatgattatattttgtgatttgtaacaaataccctttattttcccttaactattgaattaaatattttaattatttgtattctctttaactatcttggtatattaaagtattatcttttatatatttatcaatggtggacacttttataggtactctgtgtcatttttgatactgtaggtatcttatttcatttatctttattcttaatgtacgaattcataatatttgattcagaacaaatttatcactaattaacagagtgtcaattatgctaacatctcatttactgattttaatttaaaacagtttttgttaacatgcatgtttagggttggcttcttaataatttcttcttcctcttctctctctcctcttcttttggtcagtgttgtgcgggttaatacaacaaactgtaacaagtgtacctggtatggacttgttgtccgggacgtacattttcgcggtcctgctagcatgcgtggtgttccactctggcgcccaggagaaaaactacaccatccgagaagaaatgccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggaataaacggagttcaaaactacgaactaattaagagtcaaaacatttttggcctcgatgtcattgaaacaccagaaggagacaagatgccacaactgattgttcaaaaggagttagatagggaagagaaggatacctacgtgatgaaagtaaaggttgaagatggtggctttcctcaaagatccagtactgctattttgcaagtgagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaacttctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaattcgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccgccaatgaaggaggttgtgcgatcttgcacccccatgaaagagtctacaactatggagatctggattcatccccaaccacagcggaaatctgaagggaaagtggcaggaaagtcccagcggcgtgtcacatttcacctgccagaaggctctcaggaaagcagcagtgatggtggactgggagaccatgatgcaggcagccttaccagcacatctcatggcctgccccttggctatcctcaggaggagtactttgatcgtgctacacccagcaatcgcactgaaggggatggcaactccgatcctgaatctactttcatacctggactaaagaaagctgcagaaataactgttcaaccaactgtggaagaggcctctgacaactgcactcaagaatgtctcatctatggccattctgatgcctgctggatgccggcatctctggatcattccagctcttcgcaagcacaggcctctgctctatgccacagcccaccactgtcacaggcctctactcagcaccacagcccacgagtgacacagaccattgctctctgccacagccctccagtgacacagaccatcgcattgtgccacagcccaccaccgatacaggtgtctgctctccaccacagtcctcctctagtgcaggctactgcacttcaccacagcccaccatcagcacaggcctcagccctctgctacagccctcctttagcacaggctgctgcaatcagccacagctctcctctgccacaggttattgccctccatcgtagtcaggcccaatcatcagtcagtttgcagcaaggttgggtgcaaggtgctgatgggctatgctctgttgatcagggagtgcaaggtagtgcaacatctcagttttacaccatgtctgaaagacttcatcccagtgatgattcaattaaagtcattcctttgacaaccttcactccacgccaacaggccagaccgtccagaggtgattcccccattatggaagaacatcccttgtaaagctaaaatagttacttcaaattttcagaaaagatgtatatagtcaaaatttaagatacaattccaatgagtattctgattatcagatttgtaaataactatgtaaatagaaacagataccagaataaatctacagctagacccttagtcaatagttaaccaaaaaattgcaatttgtttaattcagaatgtgtatttaaaaagaaaaggaatttaacaatttgcatccccttgtacagtaaggcttatcatgacagagcgcactatttctgatgtacagtattttttgttgtttttatcatcatgtgcaatattactgatttgtttccatgctgattgtgtggaaccagtatgtagcaaatggaaagcctagaaatatcttattttctaagtttacctttagtttacctaaacttttgttcagataacgttaaaaggtatacgtactctagcctttttttgggctttctttttgatttttgtttgttgttttcagtttttttgttgttgttagtgagtctcccttcaaaatacgcagtaggtagtgtaaatactgcttgtttgtgtctctctgctgtcatgttttctaccttattccaatactatattgttgataaaatttgtatatacattttcaataaagaatatgtataaactgtacagatctagatctacaacctatttctctactctttagtagagttcgagacacagaagtgcaataactgccctaattaagcaactatttgttaaaaagggcctctttttactttaatagtttagtgtaaagtacatcagaaataaagctgtatctgccattttaagcctgtagtccattattacttgggtctttacttctgggaatttgtatgtaacagcctagaaaattaaaaggaggtggatgcatccaaagcacgagtcacttaaaatatcgacggtaaactactattttgtagagaaactcaggaagatttaaatgttgatttgacagctcaataggctgttaccaaagggtgttcagtaaaaataacaaatacatgtaactgtagataaaaccatatactaaatctataagactaagggatttttgttattctagctcaacttactgaagaaaaccactaataacaacaagaatatcaggaaggaacttttcaagaaatgtaattataaatctacatcaaacagaattttaaggaaaaatgcagagggagaaataaggcacatgactgcttcttgcagtcaacaagaaataccaataacacacacagaacaaaaaccatcaaaatctcatatatgaaataaaatatattcttctaagcaaagaaacagtactattcatagaaaacattagttttcttctgttgtctgttatttccttcttgtatcctcttaactggccattatcttgtatgtgcacattttataaatgtacagaaacatcaccaacttaattttcttccatagcaaaactgagaaaataccttgtttcagtataacactaaaccaagagacaattgatgtttaatgggggcggttggggtgggggggggagtcaatatctcctattgattaacttagacatagattttgtaatgtataacttgatatttaatttatgattaaactgtgtgtaaattttgtaacataaactgtggtaattgcataatttcattggtgaggatttccactgaatattgagaaagtttcttttcatgtgcccagcaggttaagtagcgttttcagaatatacattattcccatccattgtaaagttccttaagtcatatttgactgggcgtgcagaataacttcttaacttttaactatcagagtttgattaataaaattaattaatgttttttctccttcgtgttgttaatgttccaagggatttggagcatactggttttccaggtgcatgtgaatcccgaaggactgatgatatttgaatgtttattaaattattatcatacaaatgtgttgatattgtggctattgttgatgttgaaaattttaaacttggggaagattaagaaaagaaccaatagtgacaaaaatcagtgcttccagtagattttagaacattctttgcctcaaaaaacctgcaaagatgatgtgagattttttcttgtgttttaattattttcacattttctctctgcaaaactttagttttctgatgatctacacacacacacacacacacacgtgcacacacacacacatttaaatgatataaaaagaagaggttgaaagattattaaataacttatcaggcatctcaatggttactatctatgttagtgaaaatcaaataggactcaaagttggatatttgggatttttcttctgacagtataatttattgagttactagggaggttcttaaatcctcatatctggaaacttgtgacgttttgacacctttcctatagatgatataggaatgaaccaatacgcttttattaccctttctaactctgattttataatcagacttagattgtgtttagaatattaaatgactgggcaccctcttcttggtttttaccagagaggctttgaatggaagcaggctgagagtagccaaagaggcaaggggtattagcccagttattctcccctatgccttccttctctttctaagcgtccactaggtctggccttggaaacctgttacttctagggcttcagatctgatgatatctttttcatcacattacaagttatttctctgactgaatagacagtggtataggttgacacagcacacaagtggctattgtgatgtatgatgtatgtagtcctacaactgcaaaacgtcttactgaaccaacaatcaaaaaatggttctgttttaaaaaggattttgtttgatttgaaattaaaacttcaagctgaatgacttatatgagaataatacgttcaatcaaagtagttattctattttgtgtccatattccattagattgtgattattaattttctagctatggtattactatatcacacttgtgagtatgtattcaaatactaagtatcttatatgctacgtgcatacacattcttttcttaaactttacctgtgttttaactaatattgtgtcagtgtattaaaaattagcttttacatatgatatctacaatgtaataaatttagagagtaattttgtgtattcttatttacttaacattttacttttaattatgtaaatttggttagaaaataataataaatggttagtgctattgtgtaatggtagcagttacaaagagcctctgccttcccaaactaatatttatcacacatggtcattaaatgggaaaaaaatagactaaacaaatcacaaattgttcagttcttaaaatgtaattatgtcacacacacaaaaaatccttttcaatcctgagaaaattaaaggcgttttactcacatggctatttcaacattagttttttttgtttgtttctttttcatggtattactgaaggtgtgtatactccctaatacacatttatgaaaatctacttgtttaggcttttatttatactcttctgatttatattttttattataattattatttcttatctttcttcttttatattttttggaaaccaaatttatagttagtttaggtaaactttttattatgaccattagaaactattttgaatgcttccaactggctcaattggccgggaaaacatgggagcaagagaagctgaaatatatttctgcaagaacctttctatattatgtgccaattaccacaccagatcaattttatgcagaggccttaaaatattctttcacagtagctttcttacactaaccgtcatgtgcttttagtaaatatgatttttaaaagcagttcaagttgacaacagcagaaacagtaacaaaaaaatctgctcagaaaaatgtatgtgcacaaataaaaaaaattaatggcaattgtttagtgattgtaagtgatactttttaaagagtaaactgtgtgaaatttatactatccctgcttaaaatattaagatttttatgaaatatgtatttatgtttgtattgtgggaagattcctcctctgtgatatcatacagcatctgaaagtgaacagtatcccaaagcagttccaaccatgctttggaagtaagaaggttgactattgtatggccaaggatggcagtatgtaatccagaagcaaacttgtattaattgttctatttcaggttctgtattgcatgttttcttattaatatatattaataaaagttatgagaaat

SEQ ID NO: 58164 - DNA, 9146 bp, Homo sapiens
ctggtggtccagtacctccaaagatatggaatacactcctgaaatatcctgaaaacttttttttttcagaatcctttaataagcagttatgtcaatctgaaagttgcttacttgtactttatattaatagctattcttgtttttcttatccaaagaaaaatcctctaatccccttttcacatgatagttgttaccatgtttaggcattagtcacatcaacccctctcctctcccaaacttctcttcttcaaatcaaactttattagtccctcctttataatgattccttgcctcgttttatccagatcaattttttttcactttgatgcccagagctgaagaaatggactactgtataaattattcattgccaagagaataattgcattttaaacccatattataacaaagaataatgattatattttgtgatttgtaacaaataccctttattttcccttaactattgaattaaatattttaattatttgtattctctttaactatcttggtatattaaagtattatcttttatatatttatcaatggtggacacttttataggtactctgtgtcatttttgatactgtaggtatcttatttcatttatctttattcttaatgtacgaattcataatatttgattcagaacaaatttatcactaattaacagagtgtcaattatgctaacatctcatttactgattttaatttaaaacagtttttgttaacatgcatgtttagggttggcttcttaataatttcttcttcctcttctctctctcctcttcttttggtcagtgttgtgcgggttaatacaacaaactgtaacaagtgtacctggtatggacttgttgtccgggacgtacattttcgcggtcctgctagcatgcgtggtgttccactctggcgcccaggagaaaaactacaccatccgagaagaaatgccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggaataaacggagttcaaaactacgaactaattaagagtcaaaacatttttggcctcgatgtcattgaaacaccagaaggagacaagatgccacaactgattgttcaaaaggagttagatagggaagagaaggatacctacgtgatgaaagtaaaggttgaagatggtggctttcctcaaagatccagtactgctattttgcaagtgagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaacttctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaattcgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccgccaatgaaggaggttgtgcgatcttgcacccccatgaaagagtctacaactatggagatctggattcatccccaaccacagtcccagcggcgtgtcacatttcacctgccagaaggctctcaggaaagcagcagtgatggtggactgggagaccatgatgcaggcagccttaccagcacatctcatggcctgccccttggctatcctcaggaggagtactttgatcgtgctacacccagcaatcgcactgaaggggatggcaactccgatcctgaatctactttcatacctggactaaagaaagctgcagaaataactgttcaaccaactgtggaagaggcctctgacaactgcactcaagaatgtctcatctatggccattctgatgcctgctggatgccggcatctctggatcattccagctcttcgcaagcacaggcctctgctctatgccacagcccaccactgtcacaggcctctactcagcaccacagcccacgagtgacacagaccattgctctctgccacagccctccagtgacacagaccatcgcattgtgccacagcccaccaccgatacaggtgtctgctctccaccacagtcctcctctagtgcaggctactgcacttcaccacagcccaccatcagcacaggcctcagccctctgctacagccctcctttagcacaggctgctgcaatcagccacagctctcctctgccacaggttattgccctccatcgtagtcaggcccaatcatcagtcagtttgcagcaaggttgggtgcaaggtgctgatgggctatgctctgttgatcagggagtgcaaggtagtgcaacatctcagttttacaccatgtctgaaagacttcatcccagtgatgattcaattaaagtcattcctttgacaaccttcactccacgccaacaggccagaccgtccagaggtgattcccccattatggaagaacatcccttgtaaagctaaaatagttacttcaaattttcagaaaagatgtatatagtcaaaatttaagatacaattccaatgagtattctgattatcagatttgtaaataactatgtaaatagaaacagataccagaataaatctacagctagacccttagtcaatagttaaccaaaaaattgcaatttgtttaattcagaatgtgtatttaaaaagaaaaggaatttaacaatttgcatccccttgtacagtaaggcttatcatgacagagcgcactatttctgatgtacagtattttttgttgtttttatcatcatgtgcaatattactgatttgtttccatgctgattgtgtggaaccagtatgtagcaaatggaaagcctagaaatatcttattttctaagtttacctttagtttacctaaacttttgttcagataacgttaaaaggtatacgtactctagcctttttttgggctttctttttgatttttgtttgttgttttcagtttttttgttgttgttagtgagtctcccttcaaaatacgcagtaggtagtgtaaatactgcttgtttgtgtctctctgctgtcatgttttctaccttattccaatactatattgttgataaaatttgtatatacattttcaataaagaatatgtataaactgtacagatctagatctacaacctatttctctactctttagtagagttcgagacacagaagtgcaataactgccctaattaagcaactatttgttaaaaagggcctctttttactttaatagtttagtgtaaagtacatcagaaataaagctgtatctgccattttaagcctgtagtccattattacttgggtctttacttctgggaatttgtatgtaacagcctagaaaattaaaaggaggtggatgcatccaaagcacgagtcacttaaaatatcgacggtaaactactattttgtagagaaactcaggaagatttaaatgttgatttgacagctcaataggctgttaccaaagggtgttcagtaaaaataacaaatacatgtaactgtagataaaaccatatactaaatctataagactaagggatttttgttattctagctcaacttactgaagaaaaccactaataacaacaagaatatcaggaaggaacttttcaagaaatgtaattataaatctacatcaaacagaattttaaggaaaaatgcagagggagaaataaggcacatgactgcttcttgcagtcaacaagaaataccaataacacacacagaacaaaaaccatcaaaatctcatatatgaaataaaatatattcttctaagcaaagaaacagtactattcatagaaaacattagttttcttctgttgtctgttatttccttcttgtatcctcttaactggccattatcttgtatgtgcacattttataaatgtacagaaacatcaccaacttaattttcttccatagcaaaactgagaaaataccttgtttcagtataacactaaaccaagagacaattgatgtttaatgggggcggttggggtgggggggggagtcaatatctcctattgattaacttagacatagattttgtaatgtataacttgatatttaatttatgattaaactgtgtgtaaattttgtaacataaactgtggtaattgcataatttcattggtgaggatttccactgaatattgagaaagtttcttttcatgtgcccagcaggttaagtagcgttttcagaatatacattattcccatccattgtaaagttccttaagtcatatttgactgggcgtgcagaataacttcttaacttttaactatcagagtttgattaataaaattaattaatgttttttctccttcgtgttgttaatgttccaagggatttggagcatactggttttccaggtgcatgtgaatcccgaaggactgatgatatttgaatgtttattaaattattatcatacaaatgtgttgatattgtggctattgttgatgttgaaaattttaaacttggggaagattaagaaaagaaccaatagtgacaaaaatcagtgcttccagtagattttagaacattctttgcctcaaaaaacctgcaaagatgatgtgagattttttcttgtgttttaattattttcacattttctctctgcaaaactttagttttctgatgatctacacacacacacacacacacacgtgcacacacacacacatttaaatgatataaaaagaagaggttgaaagattattaaataacttatcaggcatctcaatggttactatctatgttagtgaaaatcaaataggactcaaagttggatatttgggatttttcttctgacagtataatttattgagttactagggaggttcttaaatcctcatatctggaaacttgtgacgttttgacacctttcctatagatgatataggaatgaaccaatacgcttttattaccctttctaactctgattttataatcagacttagattgtgtttagaatattaaatgactgggcaccctcttcttggtttttaccagagaggctttgaatggaagcaggctgagagtagccaaagaggcaaggggtattagcccagttattctcccctatgccttccttctctttctaagcgtccactaggtctggccttggaaacctgttacttctagggcttcagatctgatgatatctttttcatcacattacaagttatttctctgactgaatagacagtggtataggttgacacagcacacaagtggctattgtgatgtatgatgtatgtagtcctacaactgcaaaacgtcttactgaaccaacaatcaaaaaatggttctgttttaaaaaggattttgtttgatttgaaattaaaacttcaagctgaatgacttatatgagaataatacgttcaatcaaagtagttattctattttgtgtccatattccattagattgtgattattaattttctagctatggtattactatatcacacttgtgagtatgtattcaaatactaagtatcttatatgctacgtgcatacacattcttttcttaaactttacctgtgttttaactaatattgtgtcagtgtattaaaaattagcttttacatatgatatctacaatgtaataaatttagagagtaattttgtgtattcttatttacttaacattttacttttaattatgtaaatttggttagaaaataataataaatggttagtgctattgtgtaatggtagcagttacaaagagcctctgccttcccaaactaatatttatcacacatggtcattaaatgggaaaaaaatagactaaacaaatcacaaattgttcagttcttaaaatgtaattatgtcacacacacaaaaaatccttttcaatcctgagaaaattaaaggcgttttactcacatggctatttcaacattagttttttttgtttgtttctttttcatggtattactgaaggtgtgtatactccctaatacacatttatgaaaatctacttgtttaggcttttatttatactcttctgatttatattttttattataattattatttcttatctttcttcttttatattttttggaaaccaaatttatagttagtttaggtaaactttttattatgaccattagaaactattttgaatgcttccaactggctcaattggccgggaaaacatgggagcaagagaagctgaaatatatttctgcaagaacctttctatattatgtgccaattaccacaccagatcaattttatgcagaggccttaaaatattctttcacagtagctttcttacactaaccgtcatgtgcttttagtaaatatgatttttaaaagcagttcaagttgacaacagcagaaacagtaacaaaaaaatctgctcagaaaaatgtatgtgcacaaataaaaaaaattaatggcaattgtttagtgattgtaagtgatactttttaaagagtaaactgtgtgaaatttatactatccctgcttaaaatattaagatttttatgaaatatgtatttatgtttgtattgtgggaagattcctcctctgtgatatcatacagcatctgaaagtgaacagtatcccaaagcagttccaaccatgctttggaagtaagaaggttgactattgtatggccaaggatggcagtatgtaatccagaagcaaacttgtattaattgttctatttcaggttctgtattgcatgttttcttattaatatatattaataaaagttatgagaaat

SEQ ID NO: 58165 - DNA, 9056 bp, Homo sapiens
ggtggtccagtacctccaaagatatggaatacactcctgaaatatcctgaaaccttttttttttcagaatcctttaataagcagttatgtcaatctgaaagttgcttacttgtactttatattaatagctattcttgtttttcttatccaaagaaaaatcctctaatccccttttcacatgatagttgttaccatgtttaggcgttagtcacatcaacccctctcctctcccaaacttctcttcttcaaatcaaactttattagtccctcctttataatgattccttgcctccttttatccagatcaattttttttcactttgatgcccagagctgaagaaatggactattgtataaattattcattgccaagagaataattgcattttaaacccatgttataacaaagaataatgattatattttgtgatttgtaacaaataccctttattttcccttaactattgaattaaatattttaattatttgtattctctttaactatcttggtatattaaagtattatcttttatatatttatcaatggtggacacttttataggtactctgtgtcatttttgatactgtaggtatcttatttcatttatctttattcttaatgtacgaattcataatatttgattcagaacagatttatcactaattaacagagtgtcaattatgctaacatctcatttactgattttaatttaaaacagtttttgttaacatgcatgtttagggttggcttcttaataatttcttcttcctcttctctctctcctcttcttttggtcagtgttgtgcgggttaatacaacaaactgtcacaagtgtttgttgtccgggacgtacattttcgcggtcctgctagtatgcgtggtgttccactctggcgcccaggagaaaaactacaccatccgagaagaaattccagaaaacgtcctgataggcaacttgttgaaagaccttaacttgtcgctgattccaaacaagtccttgacaactactatgcagttcaagctagtgtacaagaccggagatgtgccactgattcgaattgaagaggatactggtgagatcttcactaccggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggcataaacggagttcaaaactacgaactaattaagagtcaaaacatttttggcctcgatgtcattgaaacaccagaaggagacaagatgccacaactgattgttcaaaaggagttagatagggaagagaaggatacctatgtgatgaaagtaaaggttgaagatggtggctttcctcaaagatccagtactgctattttgcaagtaagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaattcctttcagattaaggccagtattcagtaatcagttcctcctggagaatgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgatgaaagtaagtgcaacggatgcagacagtgggcctaatgctgagatcaattacctgctaggccctgatgctccacctgaattcagcctggatcgtcgtacaggcatgctgactgtagtgaagaaactagatagagaaaaagaggataaatatttattcacaattctggcaaaagataatggggtaccacccttaaccagcaatgtcacagtctttgtaagcattattgatcagaatgacaatagcccagttttcactcacaatgaatacaaattctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttacaactattcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcagtgaccaatgctacactgattaatgaactggtgcgcaaaagcattgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacatgcagaattctgaatgggctaccccaaacccagaaaacaggcagatgataatgatgaagaaaaagaaaaagaagaagaagcattcccctaagaacctgctgcttaatgttgtcactattgaagaaactaaggcagatgatgttgacagtgatggaaacagagtcacactagaccttcctattgatctagaagagcaaacaatgggaaagtacaattgggtaactacacctactactttcaagcctgacagccctgatttggcccgacactacaaatctgcctctccacagcctgccttccaaattcagcctgaaactcccctgaatttgaagcaccacatcatccaagaactgcctctcgataacacctttgtggcctgtgactctatctccaattgttcctcaagcagttcagatccctacagcgtttctgactgtggctatccagtgacaaccttcgaggtacctgtgtccgtacacaccagaccgtcccagcggcgtgtcacatttcacctgccagaaggctctcaggaaagcagcagtgatggtggactgggagaccatgatgcaggcagccttaccagcacatcccatggcctgccccttggctatcctcaggaggagtactttgatcgtgctacacccagcaatcgcactgaaggggatggcaactccgatcctgaatctactttcatacctggactaaagaaagaaataactgttcaaccaactgtggaagaggcctctgacaactgcactcaagaatgtctcatctatggccattctgatgcctgctggatgccggcatctctggatcattccagctcttcacaagcacaggcctctgctctatgccacagcccaccactgtcacaggcctctactcagcaccacagcccaccagtgacacagaccattgttctctgccacagccctccagtgacacagaccatcgcattgtgccacagcccaccaccgatacaggtgtctgctctccaccacagtcctcctctagtgcagggtactgcacttcaccacagcccaccatcagcacaggcctcagccctctgctacagccctcctttagcacaggctgctgcaatcagccacagctcttctctgccacaggttattgccctccatcgtagtcaggcccaatcatcagtcagtttgcagcaaggttgggtgcaaggtgctaatggactatgctctgttgatcagggagtgcaaggtagtgcaacatctcagttttacaccatgtctgaaagacttcatcccagtgatgattcaattaaagtcattcctttgacaaccttcgctccacgccaacaggccagaccgtccagaggtgattcccccattatggaaacacatcccttgtaaagctaaaatagttacttcaaattttcagaaaagatgtatatagtcaaaatttaagatacaattccaatgagtattctgattatcagatttgtaaataactatgtaaatagaaacagataccagaataaatctacagctagacccttagtcaatagttaaccaaaaaattgcaatttgtttaattcagaatgtgtatttaaaaagaaaaggaatttaacaatttgcatccccttgtacagtaaggcttatcatgacagagcgtactatttctgatgtacagtattttttgttgtttttatcatcatgtgcaatattactgatttgtttccatgctgattgtgtggaaccagtatgtagcaaatggaaagcctagaaatatcttattttctaagtttacctttagtttacctaaacttttgttcagataatgttaaaaggtatacgtactctagccttttttggggctttctttttgatttttgtttgtggttttcagtttttttgttgttgttagtgagtctcccttcaaaatacacagtaggtagtgtaaatactgcttgtttgtgtctctctgctgtcatgttttctaccttattccaatactatattgttgataaaatttgtatatacattttcaataaagaatatgtataaactgtacagatctagatctacaacctatttctctactctttagtagagttcgagacacagaagtgcaataactgccctaattaagcaactatttgttaaaaagggcccctttttactttaatagtttagtgtaaagtacatcagaaataaaactgtatctgacattttaagcctgtagtccattattacttgggtctttacttctgggaatttgtatgtaacagcctagaaaattaaaaggaggtggatgcatccaaagcacgagtcacttaaaatatcgacggtaaactactattttgtagagaaactcaggaagatttaaatgttgatttgacagctcaataggctgttaccaaagggtgttcagtaaaaataacaaatacatgtaactgtagataaaaccacatactaaatctataagactaagggatttttgttattctagctcaacttactgaagaaaaccactaataacaacaagaatatcaggaaggaacttttcaagaaatgtaattataaatctacatcaaacagaattttaaggaaaaatgcagagggagaaataaggcacatgactgcttcttgcagtcaagaagaaataccaataacacacacagaacaaaaaccatcaaaatctcatatatgaaataaaatatattcttctaagcaaagaaacagtactattcatagaaaacattagttttctcctgttgtctgttatttccttcttttatcctcttaactggccattatcttgtatgtgcacattttataaatgtacagaaacatcaccaacttgattttcttccatagcaaaactgagaaaataccttgtttcagtataacactaaaccaagagacaattgatgtttaatgggggcggttggggttgggggggagtcaatatctcctattgattaacttagacatagattttgtaatgtataacttgatatttaatttatgattaaactgtaattttgtaacataaactgtggtaattgcataatttcattggtgaggatttcctttgaatattgagaaagtttcttttcatgtgcccagcaggttaagtagcgttttcagaatatacattattcccatccattgtaaagttccttaagtcatatttgactgggcgtgcagaataacttcttaactattaactatcagagtttgattaataaaattaattaattttttttctccttcgtgttgttaatgttccaagggatttggagcatactggttttccaggtgcatgtgaatcccgaaggactgatgatatttgaatgtttattaaattattatcacacaaatgtgttgatattgtggctattgttgatgttgaaaattgtaaacttggggaagattaagaaaagaaccaatagtgacaaaaatcagtgcttccagtagattttagaacattctttgcctcaaaaaacctgcaaagatgatgtgagattttttcttgtgttttaattattttcacattttctctctgcaaacctttagttttctgatgatctacacacacacatacacacacacacacacacacgtgcacacacacacatttaaaggatataaaaagaagaggttgaaagattattaaataacttatcaggcatctcaatggttactatctatgttagtgaaaatcaaataggactcaaagttggatatttgggatttttcttctgacagtataatttattgagttactagggaggttcttaaatcctcatatctggaaacttgtgaagttttgacacctttcctatagatataggaatgaaccaatacgcttttattaccctttctaactctgattttataatcagacttagattgtgtttagaatattaaatgactgggcaccctcttcttggtttttaccagagaggctttgaatggaagcaggctgagagtagccaaagaggcaaggggtattagcccagttattctcccctatgccttctcttcctaagcgtccactaggtctggccttggaaatctgttacttctacggcttcagatctgatgatatctttttcatcacattacaagttatttctttgactgaatagacagtggtataggttgacacagcacacaagtggctattgtgatgtatgatgtatgtagtcccacaactgcaaaacgtcttactgaagcaacaatcgaaaaatggttctgttttaaaaaggattttgtttgatttgaaattaaaacttcaaactgaatgacttatatgagaataatatgttcaatcaaagtagttattctattttgtgtccatattccattagattgtgattattaattttctagctatggtattactatatcacacttgtgagtatgtattcaaatactaagtatcttatatgctacgtgcatacacattcttttcttaaactttacctgtgttttaactaatattgtgtcagtgtattaaaaattagcttttacatatgatatctacaatgtaataaatttagagagtaattttgtgtattcttatttacttaacattttacttttaattatgtaaatttggttagaaaataataataaatggttagtgctattgtgtaatggtagcagttacaaagagcctctgccttcccaaactaatatttatcacacatggtcattaaatgggaaaaaaatagactaaacaaatcacaaattgttcagttcttaaaatgtaattatgtcacacacacaaaaaaatccttttcaatcctgagaaaattaaaggtgttttactcacatggatatttcaacattagttttttttgtttgtttctttttcatggtattactgaaggtgtgtatactccctaatacacatttatgaaaatctacttgtttagacttttatttatactcttctgatttatattttttattataattattatttcttatcttcttttatattttttggaaaccaaatttatagttagtttaggtaaactttttattatgaccattagaaactattttgaatgtttccaactggctcaattggctgggaaaacatgggaacaagagaagctgaaatatatttctgcaagaacctttctatattatgtgccaattaccacaccagatcaattttatgcagaggccttaaaatattctttcacagtagctttcttacactaaccgtcatgtgcttttagtaaatatgatttttaaaagcagttcaagttgacaacagcagaaacagtaacaaaaaaatctgctcagaaaaatgtatgtgcacaaataaaaaaaattaatggcaattgtttagtgactgtaagtgatactttttaaagagtaaactgtgtgaaatttatactatccctgcttaaaatattaagatttttatgaaatatgtatttatgtttgtattgtgggaagattcctcctctgtgatatcatacagcatctgaaagtgaacagtatcccaaagcagttccaagcatgctttggaagtaagaaggttgactattgtatggccaaggatggcagtatgtaatccagaagcaaacttgtattaattgttctatttcaggttctgtattgcatgttttcttattaatatatattaataaaagttatgagaaataaaaaaaaaaaaaaaaaaaa

SEQ ID NO: 58166 - DNA, 1722 bp, Homo sapiens
gcggccggtcgaccggagtggctgccctgcgcggggacactcagagcccggtgggcgggaggaaggcggcatgccccagacggtgatcctcccgggccctgcgccctggggcttcaggctctcagggggcatagacttcaaccagcctttggtcatcaccaggattacaccaggaagcaaggcggcagctgccaacctgtgtcctggagatgtcatcctggctattgacggctttgggacagagtccatgactcatgctgatgcgcaggacaggattaaagcagcagctcaccagctgtgtctcaaaattgacaggggagaaactcacttatggtctccacaagtatctgaagatgggaaagcccatcctttcaaaatcaacttagaatcagaaccacaggacgggaactactttgaacacaagcataatattcggcccaaacctttcgtgatcccgggccgaagcagtggatgcagcactccctccgggattgactgtggcagtggacgcagcaccccttcttctgtcagtactgttagtaccatttgcccaggtgacttgaaagttgcggctaagctggcccctaacattcctttggaaatggaacttcctggtgtgaagattgtacatgctcagtttaatacacctatgcagttgtactcagatgacaatattatggaaacactccagggtcaggtttcaacagccctaggggaaacacctttgatgaacgagcccacagcctcggtgccccccgagtcggacgtgtaccggatgctccacgacaatcggaatgagcccacacagcctcgccagtcgggctccttcagagtgctccagggaatggtggacgatggctctgatgaccgtccggctggaacgcggagtgtgagagctccggtgacgaaagtccatggcggttcaggcggggcacagaggatgccgctctgtgacaaatgtgggagtggcatagttggtgctgtggtgaaggcgcgggataagtaccggcaccctgagtgcttcgtgtgtgccgactgcaacctcaacctcaagcaaaagggctacttcttcatagaaggggagctgtactgcgaaacccacgcaagagcccgcacaaagcccccagagggctatgacacggtcactctgtatcccaaagcttaagtctctgcaggcgtggcacgcacgcacgcacccacccacgcgcacttacacgagaagacattcatggctttgggcagaaggattgtgcagattgtcaactccaaatctaaagtcaaggctttagacctttatcctattgtttattgaggaaaaggaatgggaggcaaatgcctgctatgtgaaaaaaacatacacttagctatgttttgcaactctttttggggctagcaataatgatatttaaagcaataattttttgtatgtcatactccacaatttacatgtatattacagccatcaaacacataaacatcaagatatttgaaggactctaattgtctttccttgacaagttgattttgcaattgtggtaaatagcaaataacaatcttgtattctaacataatctgcagttgtctgtatgtgttttaactattacagtgcatgttagggagaaattccctgaatttctttagttttgtattcaaacaattatgccactcgatgcaacaaacataataaatacataaaggatttaaaaaaaaaaaaaaaaaaaa

SEQ ID NO: 58167 - DNA, 845 bp, Homo sapiens
cccgtccagagtcctctgtggtccctgctgccaccatggccactcaccgcctcgtgatggtccggcacggcgagagcacatggaaccaggagaaccgtttctgtggctggttcgatgcagagctgagtgaaaaggggaccgaggaggccaagcggggagccaaggccatcaaggatgccaagatggagtttgacatctgctacacgtcagtgctgaagcgggccatccgcaccctctgggccatcctggacggcacggaccagatgtggctgcctgtggtgcgcacttggcgcctcaatgagcggcattacgggggcctcacaggcctcaacaaggcagaaacggccgccaagcacggggaggagcaggtgaagatctggaggcgctccttcgacatcccgccgcccccgatggacgagaagcacccctactacaactccattagcaaggagcgtcggtacgcaggcctgaagcccggggaactccccacctgcgagagcctcaaggacaccattgcccgggccctgcccttctggaacgaggagattgttccccagatcaaggccggcaagcgagtgctcattgcagcccacgggaacagcctgcggggcattgtcaagcacctggaagggatgtcagaccaggcgatcatggagctgaacctgcccacggggatccccattgtgtatgagctgaacaaggagctgaagcccaccaagcccatgcagttcctgggtgatgaggaaacggtgcggaaggccatggaggctgtggctgcccagggcaaggccaagtgaggggtgggcttgggcaataaaggcacctcccccaacaaaaaaaaaaaa

SEQ ID NO: 58168 - DNA, 2184 bp, Homo sapiens
cgctatgcagagaaagcccccctggctcttctctctcaatccataatccagcgatgctgcagctgtaaaagcattaatagaaaatcaatccacaacctcgcggggcagcgatcgtcgagcgccgtttccaggctgccttccctggggtcgggagcggccccgctccccccgtggctggcgcggaatgtggtgatccgtcccggggcggggatgacttcatgcagccggagctccgcggcgggagcggaggctgctgctggcaggtggggcgcgggccggcgcgagctgaccgagcactcggcgggcgcggcgggactgcggcccgtggcggcgtgcgcggggacctgcgctgactaggtccggggaagtttcctgactttctgagaagccctggtttccccaaagaagtgatttctgatagaaatctgaaggtcatctccaagaaaaaagagatctagtatagtcaatgaattaaagacaagaaggtttccaatcagtccctgctatgtggatatttggtagcaatgactgatgtggaaactacatatgcagattttattgcttcaggaagaacaggtagaagaaatgcaatacatgatatcctggtttcctctgcaagtggcaacagcaatgaattagccttgaaattagcaggtcttgatatcaacaagacagaaggtgaagaagatgcacaacgaagttctacagaacaaagtggggaagcccagggagaagcagcaaaatctgaaagctaacaccccactttgaccctcgaccacacctgaaaatgtctcaaatctccaggagtatctggaatgcatttgtttccatgagtgaaaagaggaaaaagaaaatggctgtgctgcattgcaggaacctgctcattatcatgttaaaaatgagggcagaggctgtggctgcaggcagacttttccctacctctgtcattagcaatggttgaaatcatgtggcttgtgtttgggcgtcatttttgtatggatcctttcacttgatcatatgacgaaatgcttatagagagtagctccgacctagatgatgattcttcctgtagcatctggcccctcacaatgtcagaggatttaattgtgtctaattgcgaagggttgattgaaccccagagtttaaatatctctggctcaagtgttcacccagtaaaagaaagatccagaaagcactgtttttagcattacgtatctgtgtgttactgctgtgttatttacactgttttgtattgtacaatatatatgctcagcactgcccccttctctgattgcttatgaaaaacaaaatgatgtacattactgtgaatttttataccactcatttttaaaagggctgtcttttcattttagttttccatactgtggtggtgtacacaggatagaacacccttttttaaaacacagtctttccccttgctcattgtatgttgatgagttgattaagtctaacagattcatcaagactccattgctttattatagagacatttgaaaatatccattaatgtgaatatcacctgaattcagtctgtttggtgtctgcacagactggaattcaatctgtcaaatttgttttattctcaagtggagaacttctcccacataatatatatatatatatatattttaatttatgagaattttggacaattggaaaggtagaaaagaaaagccaagatcatactaaggactggaaatattttgttctatggaatcaaatttctcacaatgctgtatgatactatttaaatttggaggacaacttatcttcactaagctgaatcaggtggagaaagtaatctccttgcaatcatgtggacaccaatcacaaaagtaaagccctggtgttgtgttttcatgtcttttttcagccctctcagatccaaatgttattatgcactttttaatgtttgtaaacttttactaataattagtgtgaattgcattctgatacaataatgattatcattagaagctaacaaaattctcattaatactgtgtttgatggcctctgctgtgttttaacatcgtgcttcttatatggaaagtttttgtgagctgtgtaatccctctggtcagtattatgaaatcatttgtcagtggtaataaataaggaaccagtaatatgccaatggttcatgaattactggacaaatagca

SEQ ID NO: 58169 - DNA, 2055 bp, Homo sapiens
cgctatgcagagaaagcccccctggctcttctctctcaatccataatccagcgatgctgcagctgtaaaagcattaatagaaaatcaatccacaacctcgcggggcagcgatcgtcgagcgccgtttccaggctgccttccctggggtcgggagcggccccgctccccccgtggctggcgcggaatgtggtgatccgtcccggggcggggatgacttcatgcagccggagctccgcggcgggagcggaggctgctgctggcaggtggggcgcgggccggcgcgagctgaccgagcactcggcgggcgcggcgggactgcggcccgtggcggcgtgcgcggggacctgcgctgactaggtccggggaagtccctgctatgtggatatttggtagcaatgactgatgtggaaactacatatgcagattttattgcttcaggaagaacaggtagaagaaatgcaatacatgatatcctggtttcctctgcaagtggcaacagcaatgaattagccttgaaattagcaggtcttgatatcaacaagacagaaggtgaagaagatgcacaacgaagttctacagaacaaagtggggaagcccagggagaagcagcaaaatctgaaagctaacaccccactttgaccctcgaccacacctgaaaatgtctcaaatctccaggagtatctggaatgcatttgtttccatgagtgaaaagaggaaaaagaaaatggctgtgctgcattgcaggaacctgctcattatcatgttaaaaatgagggcagaggctgtggctgcaggcagacttttccctacctctgtcattagcaatggttgaaatcatgtggcttgtgtttgggcgtcatttttgtatggatcctttcacttgatcatatgacgaaatgcttatagagagtagctccgacctagatgatgattcttcctgtagcatctggcccctcacaatgtcagaggatttaattgtgtctaattgcgaagggttgattgaaccccagagtttaaatatctctggctcaagtgttcacccagtaaaagaaagatccagaaagcactgtttttagcattacgtatctgtgtgttactgctgtgttatttacactgttttgtattgtacaatatatatgctcagcactgcccccttctctgattgcttatgaaaaacaaaatgatgtacattactgtgaatttttataccactcatttttaaaagggctgtcttttcattttagttttccatactgtggtggtgtacacaggatagaacacccttttttaaaacacagtctttccccttgctcattgtatgttgatgagttgattaagtctaacagattcatcaagactccattgctttattatagagacatttgaaaatatccattaatgtgaatatcacctgaattcagtctgtttggtgtctgcacagactggaattcaatctgtcaaatttgttttattctcaagtggagaacttctcccacataatatatatatatatatatattttaatttatgagaattttggacaattggaaaggtagaaaagaaaagccaagatcatactaaggactggaaatattttgttctatggaatcaaatttctcacaatgctgtatgatactatttaaatttggaggacaacttatcttcactaagctgaatcaggtggagaaagtaatctccttgcaatcatgtggacaccaatcacaaaagtaaagccctggtgttgtgttttcatgtcttttttcagccctctcagatccaaatgttattatgcactttttaatgtttgtaaacttttactaataattagtgtgaattgcattctgatacaataatgattatcattagaagctaacaaaattctcattaatactgtgtttgatggcctctgctgtgttttaacatcgtgcttcttatatggaaagtttttgtgagctgtgtaatccctctggtcagtattatgaaatcatttgtcagtggtaataaataaggaaccagtaatatgccaatggttcatgaattactggacaaatagca

SEQ ID NO: 58170 - DNA, 2647 bp, Homo sapiens
gagataagcggcctctaggcgccgggccctcagtctctcccagcgaccgccgcgggggcaaggcctggagctgtggttcgaatttgtgcaggcagcgggtgctggcttttagggtccgccgcctctctgcctaatgagctgcaccagaatgatccaggttttagatccacgtcctttgacaagttcggtcatgcccgtggatgtggccatgaggctttgcttggcacattcaccacctgtgaagagtttcctgggcccgtacgatgaatttcaacgacgacattttgtgaataaattaaagcccctgaaatcatgtctcaatataaaacacaaagccaaatcacagaatgactggaagtgctcacacaaccaagccaagaagcgcgttgtgtttgctgactccaagggcctctctctcactgcgatccatgtcttctccgacctcccagaagaaccagcgtgggatctgcagtttgatctcttggaccttaatgatatctcctctgccttaaaacaccacgaggagaaaaacttgattttagatttccctcagccttcaaccgattacttaagtttccggagccactttcagaagaactttgtctgtctggagaactgctcgttgcaagagcgaacagtgacagggactgttaaagtcaaaaatgtgagttttgagaagaaagttcagatccgtatcactttcgattcttggaaaaactacactgacgtagactgtgtctatatgaaaaatgtgtatggtggcacagatagtgataccttctcatttgccattgacttaccccctgtcattccaactgagcagaaaattgagttctgcatttcttaccatgctaatgggcaagtcttttgggacaacaatgatggtcagaattatagaattgttcatgttcaatggaagcctgatggggtgcagacacagatggcaccccaggactgtgcattccaccagacgtctcctaagacagagttagagtcaacaatctttggcagtccgaggctggctagtgggctcttcccagagtggcagagctgggggagaatggagaacttggcctcttatcgatgaattaagcaacaatgtaactggtcttgacttgtcatattcccccatgcaatcctaggtctgtattgctcaattttaggaagcctttgctactccatcagtaggtttagatttgagcttttgagacctggctatggaaaagaaagacacttgagaatttagtgttggggtctgtacagatgatgctacccaatttggctttgaaggatcaagtaacaggttgaaaactatttttataaaggtaatactttttcagttcccttcttccttccctctcaatccactagctttcatgttgggcaaggaaaagttgaggaaggatggctgatggtgatggaaagctgtgttaatggtatgaggaatgtgtgaaaagtatacacaaagggctctgaagctcaagtcagaggagtgggaggtctgatcattgttggtggaaaaacgtaaggttattttgtgcttttaagttggttttacaattctttcctggggaaattatttctggaggggaaaaagatccattctacgtatccttgtggagaaaagctaaataacctttaagaatgtgggtggtattggagaaagaagatgaattatagctccggagaatcaagatcttaagtgaagcctttctgttcagatgtgatctataaataatcataatttggggaaagtttaagcaaatctggctttgtagtcctgatgttataagtgactttgtgatcaaactgtcaggcttgggttcttgttatagaatgcttggtatagaaaaaccatgccatcattaatggctaacaacacgtagggacttcatgtcatgtcaaagatagctctttgcaagtgccttgattaaaccagaaaactgtcatcgtttaacccaaatatctgaatggtcatctggtaactcatgggtttttggcctcataagatggtccactctgtacacaggcattcctcctgcaataatgttgtatctttgagaccgttgtcagtgtacacaactcacatccttcatattgaaggtgactcatttttctgcacacttttttgatgtgatgcttgacgtgaggcccgacactaggattctcaatgcaagaatccagtaccttgcacatagaagtagcaacccatcccttgcctattttcatcttgctgttttcttttttttaaaaaaatggatgtgacttgttttgaatgttttgtattatacttgtttttgtgtgtgcataaattcattctgtaggatcttaagaaaaagagtcccagaatgttgcttctattattgtgcacaaccattgagaggtgttacaagaatgcagttaattttaacatgtgtgatgtgccatggtggaaaagtactatcggaataactctgcagtgacagaatttgaagtttggctagcatccatacttttctactgtaaatatttcactctcctctagctatccttgatgagcttctcactttaagaataaatgtgtttgatataaaaaaaaaaaaaaaaaaaaaaaaaaaaaaaaaaaaaaaaaaaaaaaaaaaaaaaaaaaaaaaaaaaaaaaaaaaaa

SEQ ID NO: 58171 - DNA, 2299 bp, Homo sapiens
ttggtctggggctggccacatggagcccgggctggagcacgcactgcgcaggaccccttcctggagcagccttgggggttctgagcatcaagagatgagcttcctagagcaagaaaacagcagctcatggccatcaccagctgtgaccagcagctcagaaagaatccgtgggaaacggagggccaaagccttgagatggacaaggcagaagtcggtggaggaaggggagccaccaggtcagggggaaggtccccggtccaggccagctgctgagtccaccgggctggaggccacattccccaagaccacacccttggctcaagctgatcctgccggggtgggcactccaccaacagggtgggactgcctcccctctgactgtacagcctcagctgcaggctccagcacagatgatgtggagctggccacggagttcccagccacagaggcctgggagtgtgagctagaaggcctgctggaagagaggcctgccctgtgcctgtccccgcaggccccatttcccaagctgggctgggatgacgaactgcggaaacccggcgcccagatctacatgcgcttcatgcaggagcacacctgctacgatgccatggcaactagctccaagctagtcatcttcgacaccatgctggagatcaagaaggccttctttgctctggtggccaacggtgtgcgggcagcccctctatgggacagcaagaagcagagctttgtggggatgctgaccatcactgacttcatcctggtgctgcatcgctactacaggtcccccctggtccagatctatgagattgaacaacataagattgagacctggagggagatctacctgcaaggctgcttcaagcctctggtctccatctctcctaatgatagcctgtttgaagctgtctacaccctcatcaagaaccggatccatcgcctgcctgttcttgacccggtgtcaggcaacgtactccacatcctcacacacaaacgcctgctcaagttcctgcacatctttggttccctgctgccccggccctccttcctctaccgcactatccaagatttgggcatcggcacattccgagacttggctgtggtgctggagacagcacccatcctgactgcactggacatctttgtggaccggcgtgtgtctgcactgcctgtggtcaacgaatgtggtcaggtcgtgggcctctattcccgctttgatgtgattcacctggctgcccagcaaacctacaaccacctggacatgagtgtgggagaagccctgaggcagaggacactatgtctggagggagtcctttcctgccagccccacgagagcttgggggaagtgatcgacaggattgctcgggagcaggtacacaggctggtgctagtggacgagacccagcatctcttgggcgtggtctccctctccgacatccttcaggcactggtgctcagccctgctggcatcgatgccctcggggcctgagaagatctgagtcctcaatcccaagccacctgcacacctggaagccaatgaagggaactggagaactcagccttcatcttcccccacccccatttgctggttcagctatgattcaggcttcttcagccctcccaaattgcccttgccctacctgtgctcccagaagccctcgggcatgcccagtgcaccatgggatgatgaaattaaggagaacagctgagtcaagcttggaggtccctgaaccagaggcactaggattaccccagggccatctgtgctccatgcccgcccatccccttgccgcctgactgggtcggatggccccagtgggtttagtcagggcttctggattcctcggtttctgggctacctatggcttcagccttcagctcctgggagtcccagctgttgttcccagcaacgtcgccactgccctcctactctccaggctttgtcatttcaaggctgctgaaatgctgcatttcaggggccaccatggagcagccgttatttatagaactgcctgttggaggtggggagtcctccctccattcttgtccagaaaactccttagctctcgcagtgagccatgttcttagtctccagggatggatggccttgtatatggacccctgagaatgagcaattgagaaaacaaaacaaaaggaacaatccatgaacttagattttattggtttcactcaaaatgctgcagtcatttgacctgaacttgtggcaagagacttgtgctttctaaattcaaagactagaaggaaaatggataaaaatcacaagtgccgtttctcttgc

SEQ ID NO: 58172 - DNA, 1664 bp, Homo sapiens
cccaactggcagcgacagctgcagacgggctgaaccagctttgttcccagggtggcgcctgctctccatccaggccccattccggctcccacccgacgctgcttttgttcccacgtttcggggggcagctggcactgtgattcctgccccatgagtgcctagaggcacggagccaccagggatcaccccacgtgggacacagggcttggggaggatggggcaggaccagaccaagcagcagatcgagaaggggctccagctgtaccagtccaaccagacagagaaggcattgcaggtgtggacaaaggtgctggagaagagctcggacctcatggggcgcttccgcgtgctgggctgcctggtcacagcccactcggagatgggccgctacaaggagatgctgaagttcgctgtggtccagatcgacacggcccgggagctggaggatgccgacttcctcctggagagctacctgaacctggcacgcagcaacgagaagctgtgcgagtttcacaagaccatctcctactgcaagacctgccttgggctgcctggtaccagggcaggtgcccagctcggaggccaggtcagcctgagcatgggcaatgccttcctgggcctcagcgtcttccagaaggccctggagagcttcgagaaggccctgcgctatgcccacaacaatgatgacgccatgctcgagtgccgcgtgtgctgcagcctgggcagcttctatgcccaggtcaaggactacgagaaagccctgttcttcccctgcaaggcggcagagcttgtcaacaactatggcaaaggctggagcctgaagtaccgggccatgagccagtaccacatggccgtggcctatcgcctgctgggccgcctgggcagtgccatggagtgttgtgaggagtctatgaagatcgcgctgcagcacggggaccggccactgcaggcgctctgcctgctctgcttcgctgacatccaccggagccgtggggacctggagacagccttccccaggtacgactccgccatgagcatcatgaccgagatcggaaaccgcctggggcaggtgcaggcgctgctgggtgtggccaagtgctgggtggccaggaaggcgctggacaaggctctggatgccatcgagagagcccaggatctggccgaggaggtggggaacaagctgagccagctcaagctgcactgtctgagcgagagcatttaccgcagcaaagggctgcagcgggaactgcgggcgcacgttgtgaggttccacgagtgcgtggaggagacggagctctactgcggcctgtgcggcgagtccataggcgagaagaacagccggctgcaggccctaccttgctcccacatcttccacctcaggtgcctgcagaacaacgggacccggagctgtcccaactgccgccgctcatccatgaagcctggctttgtatgactcctggcagcaggcgtgggcttcctcctcgccactcctgctctttctccactgcacgccagaggcccatttactcctggggcagctgccaggtcgtcctcaccatagccaaggccttggggcctgcccagggctgctcccctgggcccagctcccctccctgcctctttgtactttgctctttatagaaaaataaactgtttgtacctgg

SEQ ID NO: 58173 - DNA, 5769 bp, Homo sapiens
agagagaagatacttcctctcgtagtggacacttgtcttttcagaagatttatacgactgagagtcaaaacttttaccagagactttcatagtcagtttgaattctgcaaaatttctctttatcttctggaatgtatgctctagacttggagtggctcaagctcttcgatgtgatcctatcaatgtcaagagaaagaagcactgaagagtcataattgtgtcctgatttataaatcggagacagagggagacgaaaaccacactccagaaagtagcttaatcggactcactactaagatgttaaaagtgaagaggctggaagaattcaacacgtgttataacagcaaccagctggagaaaatggccttttttcagtgcagggaagaggtggagaaagtgaagtgttttctggaaaaaaattctggggaccaggattcaagatctggacataatgaggcgaaggaggtgtggtcaaacgccgacctgacggaaaggatgcccgtcaaaagcaaaaggacatcagccctcgcagttgacatcccggctcctccggccccatttgatcatcgtattgtgacagccaagcaaggagcggtcaacagcttctatactgtgagcaagacagaaatcctaggaggagggcgtttcggccaggttcacaagtgtgaggagacggccacaggtctgaagctggcagccaaaatcatcaagaccagaggcatgaaggacaaggaggaggtgaagaacgagatcagcgtcatgaaccagctggaccacgcgaacctcatccagctgtacgatgccttcgagtctaagaacgacattgtcctggtcatggagtatgtggatggtggggagctgtttgaccgcatcatcgatgagagctacaatttgacggagcttgataccatcctgttcatgaagcagatatgtgaggggataaggcacatgcatcagatgtacattctccacttggacctgaagcctgagaatatcctgtgtgtgaatcgggatgctaagcaaataaaaattattgattttggattggccagaagatacaaacccagagagaagctgaaggtgaactttggaaccccagaatttctcgcccctgaagttgtgaactatgattttgtttcatttcccactgacatgtggagtgtgggggtcatcgcctatatgctacttagcggtttgtcgcctttcctgggtgacaatgatgctgagacgctgaacaacatcctggcctgcaggtgggacttagaggatgaagaatttcaggacatctcggaggaggccaaggagttcatctctaagcttctgattaaggagaagagttggcgaataagtgcaagcgaagctctcaagcacccctggttgtcagaccacaagctccactccagactcagtgcccagaagaagaagaatcgtggctctgatgcccaggactttgtgaccaaatagtctacaggaggcagccatttggaaggaaaactgctgtggttgctgctgcttcgagaaaattttttgaaaaatcagcagttctgatgccttgacccctgtgatgacctggtagtcttagcagggggagccctcgaccctgaatgtgaacttgaactggagtgcctctgctgcgctcagaggaacacccagcgctgcagtctggtctcagggcgcaaacacatccctgcacccggtggtggtgatgttgggaagatgtttccctgccatcttgagattttttacttttttaaaaaaattttttgatcttagtcactggggcagggggtgcattatgtctgccatttctcaaatgactacagctgtgacacttaagattgattggagattttaaaactggaggatgcatttagagggagaaagctacttccagccattagactatgcctttggaaggggcaattagatggccagaaagaattctgactcccatgcacccttggagacttagtttcacagactctgtcattttgatttggtctgtggtcacgtgactacaatggataaataatttgtttgctggaacagaagccgtctttgaattctccaacaagaggcatcagccactgtgtctttcatttattctgaattgtccccagcgtgcgttttcttccatgtagctgattctgtttttcacatctatactccctgcacccttctgactgacagttcatccccacaaaacacattggttttgagaggtgatgcaaaaagtatctgtttatggttggactttgaaattctgactttgaaataatgtcaacagtcacaacaggtttcctcaagccccatttgtcaactaaaagagacggatctgcacctcctggagcaagatagcactgagctttcaacattgaagtgacttgggaaataacattcaagcttctgggtaaacacatacaaacagtggcaaagaccaagtacagtctctcgcctgtgctgtctcatgggactcaatggtggtgaagaaatctcaatcggacaccagaggtgggggcaactctgcaagctcacctgctggacgtgagaatgttggaacgttccagttggaaggttcctatgcctagcctgtgtgccatttcatggcagatatgtaagaaaggaaatggccctactgtagacagcttatggggcccagaaaggcactgggctttaaagagcgaaatgagtgtgtcatttccacatgaaggagaggcaaggaaaagccccacaaaattcctgttacccgctgaactccaagctcaccaaccagattcatgagctttctcacattttccatttccaaataactgttgtgttgaatcagctgtgttaatgcctttattctttgttttttttttttagacggagtctcgctctgtcacgaggctggagtgcagtggccccatctcggctcactgcaacctccgcctcccaggttcaagcgattctcctgcagcctcccgagtagctgggattacaggcgcacgccaccacgcacggctgatttttgcatttttagtagagatggggtttctccatgttggccagaatggtctcaattactgttgtcgcaatagcaatgaaaggcataagaattacttggtggcctcatgagggatggcagtttcactttgcatcagctttcccccattatctctcagatccacttaaggaatccttacagcatgccgtgaatgtgtgcaacatccttattctcatctttaaggtaaggaggaagtagagatagaaggaaatacgtgatttggtgaaggccacatgcgaattttgtggtcgtgttagttataaaactgactcctttccagcctttgctcttacattatgatgcgtttctttttctcctttggccttgcatttatccgaggttggtttcttatgttcctgtgatgtgactatgcttaagtgtttaatttagtttgcttaaaacacacacaccacacacacacacacacacaaaaccctgtgactggagtgttatattactatgctatctttagctgatgatattcattgagcctggaaaaatacaagccagtgcatgcattaatacttagttagaccgcagagagctggcattcactcaaatgctaaacaggacacaggggtctgatttgaagcccctcgtggaagggcgttttctgtcctgtggtgtgcattctctaccaaatcaagcaggagatcttttgcacgacgtgcaatttgcatccaccttcccttctgactcaggttggcagataaactgtccccagaccctgccacacatggaagagacagctcaggccaaatacaggcatgatttctttgccaagttaatgcactgatgaccctgcagtgagtgggtgtgatttttgttttgttttgaggtttagaaaggagactgtactttgaaaatggatcttgtttgattctgtagttaaatttctacatttggaatgggaaggcatctccatgccagcagggtgccttttatatgagtgctgagggtagtttgcattgcagagttcatgattacagtctagagttacttgaaatgggagattatcagtctagtgttcatcccgcccctgctccatgtccttgtgtggctgctccagcgagagctggtaactaggtagactgctgctctaatggggaaagggggctttgcaaagccgaggaaccaagccagatgcgagcatggactcagaaaagctgagtctggctagaccagggctatggagatcaatttttccaacaggtcattaggatttgggaggctgtatttctcctccaccctcttaatggatggtatggctttgctcactcactaggcagttcccactttctttagcaaatggaggaaattaagcaccgatgtagcacttcccactgcctggagagaaataaacctcgcaagttattaaggagaaggcatgccacattggtaatttggaagacaccaacacttacccagaatctgttgctatttaaaaatcagggagaggagggcacatgtccccatttgctacattacaaactttggacgagactctcatctgaactaacttggggaaacaatttctaggttgaagctggtaacactcatgtctgttgagtgccataagtttgttttcagttatttcctctaacttgatattaatttgctttctttcctcaaaaatgtaagtaggcatgttgccattgttgtggcttgctttgatgtatgtttggaaagatgtgtggatacttaatttttatccattttatggaaattagcttagcaatttttttttctcttttaagaatcaaaatatggatttgatactaggaacagaatctgctctttatttcattccttttttgtctcttctgcttcctctgcccctcccccagccacgcagcacgggtgccagtgtgcatgcgtgtgctgggggccaaatgacagaaccccggttgaaagtccgcttgtaaaagcacaagtgagaggcagcatcaggcccctggagggctgtggtcctcggactcggttctttcctgtcccctggccgtcctgtcatccctgtgtgctgcagcatcaccacggcctacttcccaatatccacaaagcttcgcctttgcttttgcactctcttttacatttttttacttctttcctttttcttaagttcggatccaagtttgtcttcttatccatcaccatgctccctgaaagcctttttgagattaagaaattttcttaccaggagtcaactttccgtctgtcctaaagggaagtgggtgctggatttattagatattgggttcctggattaagatgacttcctcacatagcttggagtctgcagtttctcagttagaagtgttctatatttctttttgttccattttagtgcgctgtgctttgtataagtggtctttctatgggcagtttcaccttccatgaaggcttataactcaaccactactacccattcagaagagcagaaagcatctgctgtgtgagcgttcatatgttacctaatgtgtattttgctgtcgtctcagctgatagatgtcagtgagtctttctgactaggtttattggtgttgataagaaattaaaaaaaggattcataacgtggtgattgtgtctatcatgtatattttaaatttctgaacgtactttcatttagctgtttttctttgctttctaaagatgtataacaatcatgtatatgtattatattgaagaataaacatggaccttatttacaaaaaaaaaaaaaaaaa

SEQ ID NO: 58174 - DNA, 2317 bp, Homo sapiens
cgcgctgcagtgccttccccacctcggccccgcccgcccccgccgagccgagcaccagggcggcggcggcggcggcggcggcggcggcggctggagcagcccgggaggaggaggcggcgagaatggcagcggcgtcgtgggcgcggcggagatgagcgcccgcgaccccgggcccagggcggcacagccggagtgggcgggggtcccgatgcaggcccgaggggggccatggggcaggtcctgccggtcttcgcccactgcaaagaagctccgtctacagcctcctcaactcctgattccacagaaggagggaacgacgactctgattttcgagagctgcacacagcccgggaattctcagaggaggacgaggaggagaccacgtcgcaggactggggcaccccccgggagctgaccttctcctacatcgcctttgatggtgtagtgggctccgggggccgcagggattcaactgcccgccgcccccgcccccagggccgctcagtctcggaaccacgagaccagcaccctcagcccagcctgggcgacagcttggagagcatccccagcctgagccaatccccggagcctggacgacggggtgatcctgacaccgcgcctccatccgagcgccctctggaagacctgaggcttcggttggaccatctgggctgggtggcccggggaacgggatccggggaggactcttccaccagcagctccaccccgctggaagacgaagaaccccaagaacccaacagattggagacaggagaagctggggaagaactggacctacgactccgacttgctcagccctcatcgcccgaggtcttgactccccagctcagtccgggctctgggacaccccaggccggtactccgtccccatcccgatcgcgagattcgaactctgggcccgaagagccattgctggaagaggaagaaaagcagtgggggccactggagcgagagccagtaaggggacagtgcctcgatagcacggaccaattagaattcacggtggagccacgccttctaggaacagctatggaatggttaaagacatcattgcttttggctgtttacaagacggttccaattttggaattgtccccacctctgtggacagccattggctgggtccaaaggggccccaccccccctactcctgtcctccgggttctactgaagtgggcaaaatccccgagaagcagcggtgtccccagcctctcactcggagccgatatggggagtaaagtggcggacctgctgtactggaaggacacgaggacgtcaggagtggtcttcacaggcctgatggtctccctcctctgcctcctgcactttagcatcgtgtccgtggccgcgcacttggctctgttgctgctctgcggcaccatctctctcagggtttaccgcaaagtgctgcaggccgtgcaccggggggatggagccaaccctttccaggcctacctggatgtggacctcaccctgactcgggagcagacggaacgtttgtcccaccagatcacctcccgcgtggtctcggcggccacgcagctgcggcacttcttcctggtagaagacctcgtggattccctcaagctggccctcctcttctacatcttgaccttcgtgggtgccatcttcaatggtttgactcttctcattctgggagtgattggtctattcaccatccccctgctgtaccggcagcaccaggctcagatcgaccaatatgtggggttggtgaccaatcagttgagccacatcaaagctaagatccgagctaaaatcccagggaccggagccctggcctctgcagcagccgcagtctccggatccaaagccaaagccgaatgagaacggtgtctctgcccgcaggacgcctgcccccagcccccgcagccctctggccccctccatctcttgtccgttcccacccacccccctcctcggcccgagccttttcccggtgggtgtcaggatcactcccactagggactctgcgctaattacctgagcgaccaggactacatttcccaagaggctctgctccaggagtccaggaaagacgaggcaccttggccgcggggcctgctgggacttgtagttgcctagacagggcaccaccctgcacttccggacccgccgctggaggcgccgtgaggcgttggtgtctcctggatgctactagccccaacgccggggctttgcatggggcccaggggaggcctgagcttggatttacactgtaataaagactcctgtggaaaaccaaaaaaaaaaaaaaaaaaaaaaaaaaaaaaaaaaa

SEQ ID NO: 58175 - DNA, 2100 bp, Homo sapiens
cgcgcgctgcagtgccttccccacctcggccccgcccgcccccgccgagccgagcaccagggcggcggcggcggcggcggcggcggcggcggctggagcagcccgggaggaggaggcggcgagaatggcagcggcgtcgtgggcgcggcggagatgagcgcccgcgaccccgggcccagggcggcacagccggagtgggcgggggtcccgatgcaggcccgaggggggccatggggcaggtcctgccggtcttcgcccactgcaaagaagctccgtctacagcctcctcaactcctgattccacagaaggagggaacgacgactctgattttcgagagctgcacacagcccgggaattctcagaggaggacgaggaggagaccacgtcgcaggactggggcaccccccgggagctgaccttctcctacatcgcctttgatggtgtagtgggctccgggggccgcagggattcaactgcccgccgcccccgcccccagggccgctcagtctcggaaccacgagaccagcaccctcagcccagcctgggcgacagcttggagagcatccccagcctgagccaatccccggagcctggacgacggggtgatcctgacaccgcgcctccatccgagcgccctctggaagacctgaggcttcggttggaccatctgggctgggtggcccggggaacgggatccggggaggactcttccaccagcagctccaccccgctggaagacgaagaaccccaagaacccaacagattggagacaggagaagctggggaagaactggacctacgactccgacttgctcagccctcatcgcccgaggtcttgactccccagctcagtccgggctctgggacaccccaggccggtactccgtccccatcccgatcgcgagattcgaactctgggcccgaagagccattgctggaagaggaagaaaagcagtgggggccactggagcgagagccagtaaggggacagtgcctcgatagcacggaccaattagaattcacggtggagccacgccttctagtggcggacctgctgtactggaaggacacgaggacgtcaggagtggtcttcacaggcctgatggtctccctcctctgcctcctgcactttagcatcgtgtccgtggccgcgcacttggctctgttgctgctctgcggcaccatctctctcagggtttaccgcaaagtgctgcaggccgtgcaccggggggatggagccaaccctttccaggcctacctggatgtggacctcaccctgactcgggagcagacggaacgtttgtcccaccagatcacctcccgcgtggtctcggcggccacgcagctgcggcacttcttcctggtagaagacctcgtggattccctcaagctggccctcctcttctacatcttgaccttcgtgggtgccatcttcaatggtttgactcttctcattctgggagtgattggtctattcaccatccccctgctgtaccggcagcaccaggctcagatcgaccaatatgtggggttggtgaccaatcagttgagccacatcaaagctaagatccgagctaaaatcccagggaccggagccctggcctctgcagcagccgcagtctccggatccaaagccaaagccgaatgagaacggtgtctctgcccgcaggacgcctgcccccagcccccgcagccctctggccccctccatctcttgtccgttcccacccacccccctcctcggcccgagccttttcccggtgggtgtcaggatcactcccactagggactctgcgctaattacctgagcgaccaggactacatttcccaagaggctctgctccaggagtccaggaaagacgaggcaccttggccgcggggcctgctgggacttgtagttgcctagacagggcaccaccctgcacttccggacccgccgctggaggcgccgtgaggcgttggtgtctcctggatgctactagccccaacgccggggctttgcatggggcccaggggaggcctgagcttggatttacactgtaataaagactcctgtggaaaaccaaaaaaaaaaaaaaaaaaaaaaaaaaaaaaaaaaa

SEQ ID NO: 58176 - DNA, 1113 bp, Homo sapiens
ccccgagaagcagcggtgtccccagcctctcactcggagccgatatggggagtaaagtggcggacctgctgtactggaaggacacgaggacgtcaggagtggtcttcacaggcctgatggtctccctcctctgcctcctgcactttagcatcgtgtccgtggccgcgcacttggctctgttgctgctctgcggcaccatctctctcagggtttaccgcaaagtgctgcaggccgtgcaccggggggatggagccaaccctttccaggcctacctggatgtggacctcaccctgactcgggagcagacggaacgtttgtcccaccagatcacctcccgcgtggtctcggcggccacgcagctgcggcacttcttcctggtagaagacctcgtggattccctcaagctggccctcctcttctacatcttgaccttcgtgggtgccatcttcaatggtttgactcttctcattctgggagtgattggtctattcaccatccccctgctgtaccggcagcaccaggctcagatcgaccaatatgtggggttggtgaccaatcagttgagccacatcaaagctaagatccgagctaaaatcccagggaccggagccctggcctctgcagcagccgcagtctccggatccaaagccaaagccgaatgagaacggtgtctctgcccgcaggacgcctgcccccagcccccgcagccctctggccccctccatctcttgtccgttcccacccacccccctcctcggcccgagccttttcccggtgggtgtcaggatcactcccactagggactctgcgctaattacctgagcgaccaggactacatttcccaagaggctctgctccaggagtccaggaaagacgaggcaccttggccgcggggcctgctgggacttgtagttgcctagacagggcaccaccctgcacttccggacccgccgctggaggcgccgtgaggcgttggtgtctcctggatgctactagccccaacgccggggctttgcatggggcccaggggaggcctgagcttggatttacactgtaataaagactcctgtggaaaaccaaaaaaaaaaaaaaaaaaaaaaaaaaaaaaaaaaa

SEQ ID NO: 58177 - DNA, 2148 bp, Homo sapiens
cgcgcgctgcagtgccttccccacctcggccccgcccgcccccgccgagccgagcaccagggcggcggcggcggcggcggcggcggcggcggctggagcagcccgggaggaggaggcggcgagaatggcagcggcgtcgtgggcgcggcggagatgagcgcccgcgaccccgggcccagggcggcacagccggagtgggcgggggtcccgatgcaggcccgaggggggccatggggcaggtcctgccggtcttcgcccactgcaaagaagctccgtctacagcctcctcaactcctgattccacagaaggagggaacgacgactctgattttcgagagctgcacacagcccgggaattctcagaggaggacgaggaggagaccacgtcgcaggactggggcaccccccgggagctgaccttctcctacatcgcctttgatggtgtagtgggctccgggggccgcagggattcaactgcccgccgcccccgcccccagggccgctcagtctcggaaccacgagaccagcaccctcagcccagcctgggcgacagcttggagagcatccccagcctgagccaatccccggagcctggacgacggggtgatcctgacaccgcgcctccatccgagcgccctctggaagacctgaggcttcggttggaccatctgggctgggtggcccggggaacgggatccggggaggactcttccaccagcagctccaccccgctggaagacgaagaaccccaagaacccaacagattggagacaggagaagctggggaagaactggacctacgactccgacttgctcagccctcatcgcccgaggtcttgactccccagctcagtccgggctctgggacaccccaggccggtactccgtccccatcccgatcgcgagattcgaactctgggcccgaagagccattgctggaagaggaagaaaagcagtgggggccactggagcgagagccagtaaggggacagtgcctcgatagcacggaccaattagaattcacggtggagccacgccttctaggtaagcaacgtgtatgaagatgctgcattggcccacagaaggcaaaagtggcggacctgctgtactggaaggacacgaggacgtcaggagtggtcttcacaggcctgatggtctccctcctctgcctcctgcactttagcatcgtgtccgtggccgcgcacttggctctgttgctgctctgcggcaccatctctctcagggtttaccgcaaagtgctgcaggccgtgcaccggggggatggagccaaccctttccaggcctacctggatgtggacctcaccctgactcgggagcagacggaacgtttgtcccaccagatcacctcccgcgtggtctcggcggccacgcagctgcggcacttcttcctggtagaagacctcgtggattccctcaagctggccctcctcttctacatcttgaccttcgtgggtgccatcttcaatggtttgactcttctcattctgggagtgattggtctattcaccatccccctgctgtaccggcagcaccaggctcagatcgaccaatatgtggggttggtgaccaatcagttgagccacatcaaagctaagatccgagctaaaatcccagggaccggagccctggcctctgcagcagccgcagtctccggatccaaagccaaagccgaatgagaacggtgtctctgcccgcaggacgcctgcccccagcccccgcagccctctggccccctccatctcttgtccgttcccacccacccccctcctcggcccgagccttttcccggtgggtgtcaggatcactcccactagggactctgcgctaattacctgagcgaccaggactacatttcccaagaggctctgctccaggagtccaggaaagacgaggcaccttggccgcggggcctgctgggacttgtagttgcctagacagggcaccaccctgcacttccggacccgccgctggaggcgccgtgaggcgttggtgtctcctggatgctactagccccaacgccggggctttgcatggggcccaggggaggcctgagcttggatttacactgtaataaagactcctgtggaaaaccaaaaaaaaaaaaaaaaaaaaaaaaaaaaaaaaaaa

SEQ ID NO: 58178 - DNA, 15359 bp, Homo sapiens
tctacctcgcgggtgcctctggtgtctccagaggtctccgaccccagcccgcccccagccctcccgcccagcccgcagccccctccctctgttccccgacctcagaccctgggcttccgacctcgacatcatgggtgacgcagaaggcgaagacgaggtccagttcctgcggacggacgatgaggtggtcctgcagtgcagcgctaccgtgctcaaggagcagctcaagctctgcctggccgccgagggcttcggcaaccgcctgtgcttcctggagcccactagcaacgcgcagaatgtgccccccgatctggccatctgttgcttcgtcctggagcagtccctgtctgtgcgagccctgcaggagatgctggctaacacggtggaggctggcgtggagtcatcccagggcgggggacacaggacgctcctgtatggccatgccatcctgctccggcatgcacacagccgcatgtatctgagctgcctcaccacctcccgctccatgactgacaagctggccttcgatgtgggactgcaggaggacgcaacaggagaggcttgctggtggaccatgcacccagcctccaagcagaggtctgaaggagaaaaggtccgcgttggggatgacatcatccttgtcagtgtctcctccgagcgctacctgcacctgtcgaccgccagtggggagctccaggttgacgcttccttcatgcagacactgtggaacatgaaccccatctgctcccgctgcgaagagggcttcgtgacgggaggtcacgtcctccgcctctttcatggacatatggatgagtgtctgaccatttcccctgctgacagtgatgaccagcgcagacttgtctactatgaggggggagctgtgtgcactcatgcccgctccctctggaggctggagccactgagaatcagctggagtgggagccacctgcgctggggccagccactccgagtccggcatgtcactaccgggcagtacctagcgctcaccgaggaccagggcctggtggtggttgacgccagcaaggctcacaccaaggctacctccttctgcttccgcatctccaaggagaagctggatgtggcccccaagcgggatgtggagggcatgggcccccctgagatcaagtacggggagtcactgtgcttcgtgcagcatgtggcctcaggactgtggctcacctatgccgctccagaccccaaggccctgcggctcggcgtgctcaagaagaaggccatgctgcaccaggagggccacatggacgacgcactgtcgctgacccgctgccagcaggaggagtcccaggccgcccgcatgatccacagcaccaatggcctatacaaccagttcatcaagagcctggacagcttcagcgggaagccacggggctcggggccacccgctggcacggcgctgcccatcgagggcgttatcctgagcctgcaggacctcatcatctacttcgagcctccctccgaggacttgcagcacgaggagaagcagagcaagctgcgaagcctgcgcaaccgccagagcctcttccaggaggaggggatgctctccatggtcctgaattgcatagaccgcctaaatgtctacaccactgctgcccactttgctgagtttgcaggggaggaggcagccgagtcctggaaagagattgtgaatcttctctatgaactcctagcttctctaatccgtggcaatcgtagcaactgtgccctcttctccacaaacttggactggctggtcagcaagctggatcggctggaggcctcgtctggcatcctggaggtcctgtactgtgtcctcattgagagtccagaggttctgaacatcatccaggagaatcacatcaagtccatcatctccctcctggacaagcatgggaggaaccacaaggtcctggacgtgctatgctccctgtgtgtgtgtaatggtgtggctgtacgctccaaccaagatcttattactgagaacttgctgcctggccgtgagcttctgctgcagacaaacctcatcaactatgtcaccagcatccgccccaacatctttgtgggccgagcggaaggcaccacgcagtacagcaaatggtactttgaggtgatggtggacgaggtgactccatttctgacagctcaggccacccacttgcgggtgggctgggccctcaccgagggctacaccccctaccctggggccggcgagggctggggcggcaacggggtcggcgatgacctctattcctacggctttgatggactgcatctctggacaggacacgtggcacgcccagtgacttccccagggcagcacctcctggcccctgaagacgtgatcagctgctgcctggacctcagcgtgccgtccatctccttccgcatcaacggctgccctgtgcagggtgtctttgagtccttcaacctggacgggctcttcttccctgttgtcagcttctcggctggtgtcaaggtgcggttcctccttggtggccgccatggtgaattcaagttcctgcccccacctggctatgctccatgccatgaggctgtgctccctcgagagcgactccatcttgaacccatcaaggagtatcgacgggaggggccccgggggcctcacctggtgggccccagtcgctgcctctcacacaccgacttcgtgccctgccctgtggacactgtccagattgtcctgccgccccatctggagcgcattcgggagaagctggcggagaacatccacgagctctgggcgctaacccgcatcgagcagggctggacctacggcccggttcgggatgacaacaagaggctgcacccgtgtcttgtggacttccacagccttccagagcctgagaggaactacaacctgcagatgtctggggagacgctcaagactctgctggctctgggctgccacgtgggcatggcggatgagaaggcggaggacaacctgaagaagacaaaactccccaagacgtatatgatgagcaatgggtacaagccggctccgctggacctgagccacgtgcggctgacgccggcgcagacaacactggtggaccgtctggcagaaaatgggcacaacgtgtgggcccgagaccgcgtgggccagggctggagctacagcgcagtgcaggacatcccagcgcgccgaaaccctcggctggtgccctaccgcctgctggatgaagccaccaagcgcagcaaccgggacagcctctgccaggccgtgcgcaccctcctgggctacggctacaacatcgagcctcctgaccaggagcccagtcaggtggagaaccagtctcgttgtgaccgggtgcgcatcttccgggcagagaaatcctatacagtgcagagcggccgctggtacttcgagtttgaagcagtcaccacaggcgagatgcgcgtgggctgggcgaggcccgagctgaggcctgatgtagagctgggagctgacgagctggcctatgtcttcaatgggcaccgcggccagcgctggcacttgggcagtgaaccatttgggcgcccctggcagccgggcgatgtcgttggctgtatgatcgacctcacagagaacaccattatcttcaccctcaatggcgaggtcctcatgtctgactcaggctccgaaacagccttccgggagattgagattggggacggcttcctgcccgtctgcagcttgggacctggccaggtgggtcatctgaacctgggccaggacgtgagctctctgaggttctttgccatctgtggcctccaggaaggcttcgagccatttgccatcaacatgcagcgcccagtcaccacctggttcagcaaaggcctgccccagtttgagccagtgccccttgaacaccctcactatgaggtatcccgagtggacggcactgtggacacgcccccctgcctgcgcctgacccaccgcacctggggctcccagaacagcctggtggagatgcttttcctgcggctgagcctcccagtccagttccaccagcacttccgctgcactgcaggggccaccccgctggcacctcctggcctgcagccccccgccgaggacgaggcccgggcggcggaacccgaccctgactacgaaaacctgcgccgctcagctgggggctggagcgaggcagagaacggcaaagaagggactgcgaaggagggcgcccccgggggcaccccgcaggcggggggagaggcgcagcccgccagggcggagaatgagaaggatgccaccaccgagaagaacaagaagagaggcttcttattcaaggccaagaaggtcgccatgatgacccagccaccggccacccccacgctgccccgactccctcacgacgtggtgcctgcagacaaccgcgatgaccccgagatcatcctcaacaccaccacgtactattactccgtgagggtctttgctggacaggagcccagctgcgtgtgggcgggctgggtcacccctgactaccatcagcacgacatgagcttcgacctcagcaaggtccgggtcgtgacggtgaccatgggggatgaacaaggcaacgtccacagcagcctcaagtgtagcaactgctacatggtgtggggcggagactttgtgagtcccgggcagcagggccggatcagccacacggaccttgtcattgggtgcctggtggacttggccactggcttaatgacctttacagccaatggcaaagagagcaacacctttttccaggtggaacccaacactaagctatttcctgccgtcttcgtcctgcccacccaccagaacgtcatccagtttgagctggggaagcagaagaacatcatgccgttgtcagccgccatgttccaaagcgagcgcaagaacccggccccgcagtgcccaccgcggctggagatgcagatgctgatgccagtgtcctggagccgcatgcccaaccacttcctgcaggtggagacgaggcgtgccggcgagcggctgggctgggccgtgcagtgccaggagccgctgaccatgatggcgctgcacatccccgaggagaaccggtgcatggacatcctggagctgtcggagcgcctggacctgcagcgcttccactcgcacaccctgcgcctctaccgcgctgtgtgcgccctgggcaacaatcgcgtggcgcacgctctgtgcagccacgtagaccaagctcagctgctgcacgccctggaggacgcgcacctgccaggcccactgcgcgcaggctactatgacctcctcatcagcatccacctcgaaagtgcctgccgcagccgccgctccatgctctctgaatacatcgtgcccctcacgcctgagacccgcgccatcacgctcttccctcctggaaggagcacagaaaatggtcacccccggcatggcctgccgggagttggagtcaccacttcgctgaggcccccgcatcatttctcgcccccctgtttcgtggccgctctgccagctgctggggcagcagaggccccggcccgcctcagccctgccatcccgctggaggccctgcgggacaaggcactgaggatgctgggggaggcggtgcgcgacggtgggcagcacgctcgcgaccccgtcggggcctccgtggagttccagtttgtgcctgtgctcaagctcgtgtccaccctgctggtgatgggcatctttggcgatgaggatgtgaaacagatcttgaagatgattgagcctgaggtcttcactgaggaagaggaggaggaggacgaggaggaagagggtgaagaggaagatgaggaggagaaggaggaggatgaggaggaaacagcacaggaaaaggaagatgaggaaaaagaggaagaggaggcagcagaaggggagaaagaagaaggcttggaggaagggctgctccagatgaagttgccagagtctgtgaagttacagatgtgccacctgctggagtatttctgtgaccaagagctgcagcaccgtgtggagtccctggcagcctttgcggagcgctatgtggacaagctccaggccaaccagcggagccgctatggcctcctcataaaagccttcagcatgaccgcagcagagactgcaagacgtacccgtgagttccgctccccaccccaggaacagatcaatatgctattgcaattcaaagatggtacagatgaggaagactgtcctctccctgaagagattcgacaggatttgcttgactttcatcaagacctgctggcacactgtggaattcagctagatggagaggaggaggaaccagaggaagagaccaccctgggcagccgcctcatgagcctgttggagaaagtgcggctggtgaagaagaaggaagagaaacctgaggaggagcggtcagcagaggagagcaaaccccggtccctgcaggagctggtgtcccacatggtggtgcgctgggcccaagaggacttcgtgcagagccccgagctggtgcgggccatgttcagcctcctgcaccggcagtacgacgggctgggtgagctgctgcgtgccctgccgcgggcgtacaccatctcaccgtcctccgtggaagacaccatgagcctgctcgagtgcctcggccagatccgctcgctgctcatcgtgcagatgggcccccaggaggagaacctcatgatccagagcatcgggaacatcatgaacaacaaagtcttctaccaacacccgaacctgatgagggcgctgggcatgcacgagacggtcatggaggtcatggtcaacgtcctcgggggcggcgagtccaaggagatccgcttccccaagatggtgacaagctgctgccgcttcctctgctatttctgccgaatcagccggcagaaccagcgctccatgtttgaccacctgagctacctgctggagaacagtggcatcggcctgggcatgcagggctccacgcccctggacgtggctgctgcctccgtcattgacaacaatgagctggccttggcattgcaggagcaggacctggaaaaggttgtgtcctacctggcaggctgtggcctccagagctgccccatgcttgtggccaaagggtacccagacattggctggaacccctgtggtggagagcgctacctggacttcctgcgctttgctgtcttcgtcaacggcgagagcgtggaggagaacgccaatgtggtggtgcggctgctcatccggaagcctgagtgcttcggacccgccctgcggggtgagggtggctcagggctgctggctgccatcgaagaggccatccgcatctccgaggaccctgcgagggatggcccaggcatccgcagggaccggcggcgcgagcactttggtgaggaaccgcctgaagaaaaccgggtgcacctgggacacgccatcatgtccttctatgccgccttgatcgacctgctcggacgctgtgcaccagagatgcatctaatccaagccggcaagggtgaggccctgcggatccgcgccatcctccgctcccttgtgcccttggaggaccttgtgggcatcatcagcctcccactgcagattcccaccctgggcaaagatggggctctggtgcagccaaagatgtcagcatccttcgtgccggaccacaaggcgtccatggtgctcttcctggaccgtgtgtatggcatcgagaaccaggacttcttgctgcacgtgctggacgtggggttcctgcccgacatgagggcagccgcctcgctggacacggccactttcagcaccaccgagatggcgctggccgtgaaccgctacctgtgcctggccgtgctgccgctcatcaccaagtgtgcgccgctctttgcgggcacagaacaccgcgccatcatggtggactctatgctgcataccgtgtaccgcctgtctcggggtcgttcgctcaccaaggcgcagcgtgacgtcatcgaggactgcctcatgtcgctctgcaggtacatccgcccgtcgatgctgcagcacctgttgcgccgcctggtgttcgacgtgcccatcctcaacgagttcgccaagatgccactcaagctcctcaccaaccactatgagcgctgttggaagtactactgcctacccacgggctgggccaacttcggggtcacctcagaggaggagctgcacctcacacggaaactcttctggggcatctttgactctctggcccataagaaatacgacccggagctgtaccgcatggccatgccttgtctgtgcgccattgccggggctctgccccccgactatgtggatgcctcatactcatctaaggcagagaaaaaggccacagtggatgctgaaggcaactttgatccccggcctgtggagaccctcaatgtgatcatcccggagaagctggactccttcattaacaagtttgcggagtacacacacgagaagtgggccttcgacaagatccagaacaactggtcctatggagagaacatagacgaggagctgaagacccaccccatgctgaggccctacaagaccttttcagagaaggacaaagagatttaccgctggcccatcaaggagtccctgaaggccatgattgcctgggaatggacgatagagaaggccagggagggtgaggaggagaagacggaaaagaaaaaaacgcggaagatatcacaaagtgcccagacctatgatcctcgagaaggctacaaccctcagccccccgaccttagtgctgttaccctgtcccgggagctgcaggccatggcagaacaactggcagaaaattaccacaacacgtggggacggaagaagaagcaggagctggaagccaaaggcggtgggacccaccccctgctggtcccctacgacacgctcacggccaaggagaaggcacgagatcgagagaaggcccaggagctactgaaattcctgcagatgaatggctacgcggttacaagaggccttaaggacatggaactggactcgtcttccattgaaaagcggtttgcctttggcttcctgcagcagctgctgcgctggatggacatttctcaggagttcattgcccacctggaggctgtggtcagcagtgggcgagtggaaaagtccccacatgaacaggagattaaattctttgccaagatcctgctccctttgatcaaccagtacttcaccaaccactgcctctatttcttgtccactccggctaaagtgctgggcagcggtggccacgcctctaacaaggagaaggaaatgatcaccagcctcttctgcaaacttgctgctctcgtccgccaccgagtctctctctttgggacagacgccccagctgtggtcaactgtcttcacatcctggcccgctccctggatgccaggacagtgatgaagtcaggccctgagatcgtgaaggctggcctccgctccttcttcgagagtgcctcggaggacatcgagaagatggtggagaacctgcggctgggcaaggtgtcgcaggcgcgcacccaggtgaaaggcgtgggccagaacctcacctacaccactgtggcactgctgccggtcctcaccaccctcttccagcacatcgcccagcaccagttcggagatgacgtcatcctggacgacgtccaggtctcttgctaccgaacgctgtgcagtatctactccctgggaaccaccaagaacacttatgtggaaaagcttcggccagccctcggggagtgcctggcccgtctggcagcagccatgccggtggcgttcctggagccgcagctgaacgagtacaacgcctgctccgtgtacaccaccaagtctccgcgggagcgggccatcctggggctccccaacagtgtggaggagatgtgtcccgacatcccggtgctggagcggctcatggcagacattggggggctggccgagtcaggtgcccgctacacagagatgccgcatgtcatcgagatcacgctgcccatgctatgcagctacctgccccgatggtgggagcgcgggcccgaggcacccccttccgccctgcccgccggcgcccccccaccctgcacagctgtcacctctgaccacctcaactccctgctggggaatatcctgagaatcatcgtcaacaacctgggcattgacgaggcctcctggatgaagcggctggctgtgttcgcacagcccattgtgagccgtgcacggccggagctcctgcagtcccacttcatcccaactatcgggcggctgcgcaagagggcagggaaggtggtgtccgaggaggagcagctgcgcctggaggccaaggcggaggcccaggagggcgagctgctggtgcgggacgagttctctgtgctctgccgggacctctacgccctgtatccgctgctcatccgctacgtggacaacaacagggcgcagtggctgacggagccgaatcccagcgcggaggagctgttcaggatggtgggcgagatcttcatctactggtccaagtcccacaacttcaagcgcgaggagcagaactttgtggtccagaatgagatcaacaacatgtccttcctgactgctgacaacaaaagcaaaatggctaaggcgggagatatacagtccggtggctcggaccaggaacgcaccaagaagaagcgccggggggaccggtactctgtgcagacgtcactgatcgtggccacactgaagaagatgctgcccatcggcctgaatatgtgtgcgcccaccgaccaagacctcatcacgctggccaagacccgttacgccctgaaagacacagatgaggaggtccgggaatttctgcacaacaaccttcaccttcagggaaaggtcgaaggctccccgtctctgcgctggcagatggctctgtaccggggcgtcccgggtcgcgaggaggacgccgatgaccccgagaaaatcgtgcgcagagtccaggaagtgtcagccgtgctctactacctggaccagaccgagcacccttacaagtctaagaaggccgtgtggcacaagcttttgtccaaacagcgccggcgggcagtcgtggcctgtttccgtatgacgcccctgtacaacctgcccacgcaccgggcatgtaacatgttcctggagagctacaaggctgcatggatcctgactgaagaccacagttttgaggaccgcatgatagatgacctttcaaaagctggggagcaggaggaggaggaggaagaggtggaagagaagaagccagaccccctgcaccagttggtcctgcacttcagccgcactgccctgacggaaaagagcaaactggatgaggattacctgtacatggcctatgctgatatcatggcaaagagctgccacctggaggagggaggggagaacggtgaagctgaagaggaggttgaggtctcctttgaggagaaacagatggagaagcagaggctcttgtaccagcaagcacggctgcacacccggggggcggccgagatggtgctgcagatgatcagtgcctgcaaaggagagacaggtgccatggtgtcctccaccctgaagctgggcatctccatcctcaatggaggcaatgctgaggtccagcagaaaatgctggattatcttaaggacaagaaggaagttggcttcttccagagtatccaggcactgatgcaaacatgcagcgtcctggatctcaatgcctttgagagacaaaacaaggccgaggggctgggcatggtgaatgaggatggcactgtcatcaatcgccagaacggagagaaggtcatggcggatgatgaattcacacaagacctgttccgattcctacaattgctctgtgaggggcacaataatgatttccagaactacctacggacacagacagggaacacgaccactattaacatcatcatttgcactgtggactacctcctgcggctgcaggaatccatcagcgacttctactggtactactcgggcaaggatgtcattgaagagcagggcaagaggaacttctccaaagccatgtcggtggctaagcaggtgttcaacagcctcactgagtacatccagggtccctgcaccgggaaccagcagagcctggcgcacagtcgcctatgggacgcagtggtgggattcctgcacgtgttcgcccacatgatgatgaagctcgctcaggactcaagccagatcgagctgctgaaggagctgctggatctgcagaaggacatggtggtgatgttgctgtcgctactagaagggaacgtggtgaacggcatgatcgcccggcagatggtggacatgctcgtggaatcctcatccaatgtggagatgatcctcaagttcttcgacatgttcctgaaactcaaggacattgtgggctctgaagccttccaggactacgtaacggatccccgtggcctcatctccaagaaggacttccagaaggccatggacagccagaagcagttcagcggtccagaaatccagttcctgctttcgtgctccgaagcggatgagaacgaaatgatcaactgcgaagagttcgccaaccgcttccaggagccagcacgcgacatcggcttcaacgtggcggtgctgctgaccaacctgtcggagcatgtgccgcatgaccctcgcctgcacaacttcctggagctggccgagagcatccttgagtacttccgcccctacctgggccgcatcgagatcatgggcgcgtcacgccgcatcgagcgcatctacttcgagatctcagagaccaaccgcgcccagtgggagatgccccaggtgaaggagtccaagcgccagttcatcttcgacgtggtgaacgagggcggcgaggctgagaagatggagctcttcgtgagtttctgcgaggacaccatcttcgagatgcagatcgccgcgcagatctcggagcccgagggcgagccggagaccgacgaggacgagggcgcgggcgcggcggaggcgggcgcggaaggcgcggaggagggcgcggcggggctcgagggcacggcggccacggcggcggcgggggcgacggcgcgggttgtggcggccgcaggccgggccctgcgaggcctcagctaccgcagcctgcggcggcgcgtgcggcggctgcggcggcttacggcccgcgaggcggccaccgcagtggcggcgctgctctgggcagcagtgacgcgcgctggggccgctggcgcgggggcggcggcgggcgcgctgggcctgctctggggctcgctgttcggcggcggcctggtggagggcgccaagaaggtgacggtgaccgagctcctggcaggcatgcccgaccccaccagcgacgaggtgcacggcgagcagccggccgggccgggcggagacgcagacggcgagggtgccagcgagggcgctggagacgccgcggagggcgctggagacgaggaggaggcggtgcacgaggccgggccgggcggtgccgacggggcggtggccgtgaccgatgggggccccttccggcccgaaggggctggcggtctcggggacatgggggacacgacgcctgcggaaccgcccacacccgagggctctcccatcctcaagaggaaattgggggtggatggagtggaggaggagctcccgccagagccagagcccgagccggaaccagagctggagccggagaaagccgatgccgagaatggggagaaggaagaagttcccgagcccacaccagagccccccaagaagcaagcacctccctcaccccctccaaagaaggaggaagctggaggcgaattctggggagaactggaggtgcagagggtgaagttcctgaactacctgtcccggaacttttacaccctgcggttccttgccctcttcttggcatttgccatcaacttcatcttgctgttttataaggtctcagactctccaccaggggaggacgacatggaaggctcagctgctggggatgtgtcaggtgcaggctctggtggcagctctggctggggcttgggggccggagaggaggcagagggcgatgaggatgagaacatggtgtactacttcctggaggaaagcacaggctacatggaacccgccctgcggtgtctgagcctcctgcatacactggtggcctttctctgcatcattggctataattgtctcaaggtgcccctggtaatctttaagcgggagaaggagctggcccggaagctggagtttgatggcctgtacatcacggagcagcctgaggacgatgacgtgaaggggcagtgggaccgactggtgctcaacacgccgtctttccctagcaactactgggacaagtttgtcaagcgcaaggtcctggacaaacatggggacatctacgggcgggagcggattgctgagctactgggcatggacctggccacactagagatcacagcccacaatgagcgcaagcccaacccgccgccagggctgctgacctggctcatgtccatcgatgtcaagtaccagatctggaagttcggggtcatcttcacagacaactccttcctgtacctgggctggtatatggtgatgtccctcttgggacactacaacaacttcttctttgctgcccatctcctggacatcgccatgggggtcaagacgctgcgcaccatcctgtcctctgtcacccacaatgggaaacagctggtgatgaccgtgggccttctggcggtggtcgtctacctgtacaccgtggtggccttcaacttcttccgcaagttctacaacaagagcgaggatgaggatgaacctgacatgaagtgtgatgacatgatgacgtgttacctgtttcacatgtacgtgggtgtccgggctggcggaggcattggggacgagatcgaggaccccgcgggtgacgaatacgagctctacagggtggtcttcgacatcaccttcttcttcttcgtcatcgtcatcctgttggccatcatccagggtctgatcatcgacgcttttggtgagctccgagaccaacaagagcaagtgaaggaggatatggagaccaagtgcttcatctgtggaatcggcagtgactactttgatacgacaccgcatggcttcgagactcacacgctggaggagcacaacctggccaattacatgtttttcctgatgtatttgataaacaaggatgagacagaacacacgggtcaggagtcttatgtctggaagatgtaccaagagagatgttgggatttcttcccagctggtgattgtttccgtaagcagtatgaggaccagcttagctgacacacccccagctggccctccacccccacctcaagtgccttattctcacagcaagccccttagtccccaagcccctccccctaaggcagctgggggagaggtgacctagtac

SEQ ID NO: 58179 - DNA, 5115 bp, Homo sapiens
ccagccatgggctcggggcgcgtacccgggctctgcctgcttgtcctgctggtccacgcccgcgccgcccagtacagcaaagccgcgcaagatgtggatgagtgtgtggaggggactgacaactgccacatcgatgctatctgccagaacaccccgaggtcatacaagtgcatctgcaagtctggctacacaggggacggcaaacactgcaaagacgtggatgagtgcgagcgagaggataatgcaggttgtgtgcatgactgtgtcaacatccctggcaattaccggtgtacctgctatgatggattccacctggcacatgacggacacaactgtctggatgtggacgagtgtgccgagggcaacggcggctgtcagcagagctgtgtcaacatgatgggcagctatgagtgccactgccgggaaggcttcttcctcagcgacaaccagcatacctgtatccagcggccagaagaaggaatgaattgcatgaacaagaaccacggctgtgcccacatttgccgggagacacccaaggggggtattgcctgtgaatgccgtcctggctttgagcttaccaagaaccaacgggactgtaaattgacatgcaactatggtaacggcggctgccagcacacgtgtgatgacacagagcagggtccccggtgcggctgccatatcaagtttgtgctccataccgacgggaagacatgcatcgagacctgtgctgtcaacaacgggggctgtgacagtaagtgccatgatgcagcgactggtgtccactgcacctgccctgtgggcttcatgctgcagccagacaggaagacgtgcaaagatatagatgagtgccgcttaaacaacgggggctgtgaccatatttgccgcaacacagtgggcagcttcgaatgcagttgcaagaaaggctataagcttctcatcaatgagaggaactgccaggatatagacgagtgttcctttgatcgaacctgtgaccacatatgtgtcaacacaccaggaagcttccagtgtctctgccatcgtggctacctgttgtatggtatcacccactgtggggatgtggatgaatgcagcatcaaccggggaggttgccgctttggctgcatcaacactcctggcagctaccagtgtacctgcccagcaggccagggtcggctgcactggaatggcaaagattgcacagagccactgaagtgtcagggcagtcctggggcctcgaaagccatgctcagctgcaaccggtctggcaagaaggacacctgtgccctgacctgtccctccagggcccgatttttgccagagtctgagaatggcttcacggtgagctgtgggacccccagccccagggctgctccagcccgagctggccacaatgggaacagcaccaactccaaccactgccatgaggctgcagtgctgtccattaaacaacgggcctccttcaagatcaaggatgccaaatgccgtttgcacctgcgaaacaaaggcaaaacagaggaggctggcagaatcacagggccaggtggtgccccctgctctgaatgccaggtcaccttcatccaccttaagtgtgactcctctcggaagggcaagggccgacgggcccggacccctccaggcaaagaggtcacaaggctcaccctggaactggaggcagaggtcagagccgaagaaaccacagccagctgtgggctgccctgcctccgacagcgaatggaacggcggctgaaaggatccctgaagatgctcagaaagtccatcaaccaggaccgcttcctgctgcgcctggcaggccttgattatgagctggcccacaagccgggcctggtagccggggagcgagcagagccgatggagtcctgtaggcccgggcagcaccgtgctgggaccaagtgtgtcagctgcccgcagggaacgtattaccacggccagacggagcagtgtgtgccatgcccagcgggcaccttccaggagagagaagggcagctctcctgcgacctttgccctgggagtgatgcccacgggcctcttggagccaccaacgtcaccacgtgtgcaggtcagtgcccacctggccaacactctgtagatgggttcaagccctgtcagccatgcccacgtggcacctaccaacctgaagcaggacggaccctatgcttcccttgtggtgggggcctcaccaccaagcatgaaggggccatttccttccaagactgtgacaccaaagtccagtgctccccagggcactactacaacaccagcatccaccgctgtattcgctgtgccatgggctcctatcagcccgacttccgtcagaacttctgcagccgctgtccaggaaacacaagcacagactttgatggctctaccagtgtggcccaatgcaagaatcgtcagtgtggtggggagctgggtgagttcactggctatattgagtcccccaactacccgggcaactacccagctggtgtggagtgcatctggaacatcaaccccccacccaagcgcaagatccttatcgtggtaccagagatcttcctgccatctgaggatgagtgtggggacgtcctggtcatgagaaagaactcatccccatcctccattaccacttatgagacctgccagacctacgagcgtcccattgccttcactgcccgttccaggaagctctggatcaacttcaagacaagcgaggccaacagcgcccgtggcttccagattccctatgttacctatgatgaggactatgagcagctggtagaagacattgtgcgagatggccggctctatgcctctgaaaaccaccaggagattttaaaggacaagaagctcatcaaggccttctttgaggtgctagcccacccccagaactacttcaagtacacagagaaacacaaggagatgctgccaaaatccttcatcaagctgctccgctccaaagtttccagcttcctgaggccctacaaatagtaaccctaggctcagagacccaattttttaagcccccagactccttagccctcagagccggcagccccctaccctcagacaaggaactctctcctctctttttggagggaaaaaaaaaatatcactacacaaaccaggcactctccctttctgtctttctagtttcctttccttgtctctctctgcctgcctctctactgttcccccttttctaacacactacctagaaaagccattcagtactggctctagtccccgtgagatgtaaagaaacagtacagccccttccactgcccattttaccagctcacattcccgaccccatcagcttggaagggtgctagaggcccatcaaggaagtgggtctggtgggaaacggggaggggaaagaagggcttctgccattatagggttgtgccttgctagtcaggggccaaaatgtcccctggctctgctccctagggtgattctaacagcccagggtcctgccaaagaagcctttgatttacaggcttaatgccagcaccagtcctctggggcacatggtttgagctctggacttcccacatggccagctttcttgtctatacagatcctctctttctttccctacgtctgcctggggtctactccataagggtttacaaatggcccacaacactgagttagtggacaccggctaaatgaggaagagcagcaggcattgtcatggtgaatgccccgctgtagctccctgagagaaagactgtaactctgcaggacagaaacaaggttttaaagcattgccaaaaaaaagaaaacagaaagaaaaaatgtatcatctaaaggactagacacagaacaattggaagtcaacttcaaacactaatcccttttcttgtcttccctggcccagccacctcctcagccccatgtgatgctccctgggggagccctactccccttgctacatgttgtccttaaacatggttattgacctgaagccagcctaggccttgccctacagttgtttttcccttgtagccccagctggcttgtgggcttcaccaaagaggaccccactctgaagccagcctggagccacctacctctggcctcaggctgtgggcagcaaaaggaatgtgtgtgcacttggcgagcctcctgcccaccctgtccacacctaataagtgcaatcattttgagtctttctatgttgtctagacggaggggtttttgttttctgggtttgttttttgtttttgtttcttcttcctctattagcaaaaccctatttatagctgcccaagagaaaagagtgtatgtttggagtggaagaaaatcggttttgaatctcatgaaccttgagtgctggagcatctgatctgtctctatgccaccactggccacctagagcccttggctgtggtaatccagggtaattgcgcagaggcatctgatgtgtaggaaagtaattctggggatttgatggagcagaaaggagagagacctatgtttgctaaaccaatcttgctatccctatgcctctccatggagtcagtgtggacctcatgattatagaggccaatggaactggtcagtgattctctaccccaagtagggaaaacctccatcttttccctgtcttcatcctgttatcccctggtgtacacatggaagaggaccaggacataccacctggggatgggctgactcagggtcccgaggccagagacaaagctgtgggagccaagaataagacagaaggcatcagatatttgcctggctctggtcacttccctttgaagttgacttcaagcttagcttcctcaactactgtttttcagaaggaagaaagaatcaaatggaagaagaatcaagtccatgcccaagcccaaagcctgcacacattctgcccttaatccaagtgttgcctataaaattattttctgttttctcactctagttcccccaaagctgtagtcccaatcaatcaaaggctaccaactgagtcctcaggttcatttcttttttttttttttttctttttaactctcctggtaactcacagaacagctcaggttcatttctaggtgactgtcctaggctactgctcccccaggagactcaacactaaataaaggagtc

SEQ ID NO: 58180 - DNA, 3172 bp, Homo sapiens
caggcagccacaggcctgtcagaccaggacccttaccctctagacatggcctcggtcccctgcaaaccccagccccgtagccctgcgaggttacagacagcctaaacgccaccaccacagggcctgtgccgtgcccctgacccgggcacagaaggccactggcccggaggccatggagacggtgcccccagcagtggacctggtgctgggtgcttctgcctgctgcctggcctgtgtcttcaccaaccccctggaggtggtgaagacgcggctgcagctgcagggggagctgcaggcccggggcacctacccacggccctaccatggcttcatagcctctgtcgctgctgtggcccgagcagacgggctgtggggcctgcagaaggggctggctgccggccttctgtaccaaggcctcatgaatggcgttcgtttctactgctacagcctggcgtgccaggctggcctcacgcagcaaccaggtggcaccgtggttgcgggagccgtggcgggggcactgggagccttcgtggggagccctgcttacctgatcaaaacgcagctgcaagctcagacagtggccgcagtggccgtgggacaccagcacaatcaccagactgtcctgggtgccttggagaccatctggcggcagcaagggctcttggggctgtggcagggcgttggtggggctgtgccccgagtcatggtgggctcagctgcccagctggccaccttcgcctctgccaaggcctgggtacagaagcaacagtggctccctgaggacagctggctggtggccctggctgggggcatgatcagcagcatagccgtggttgtcgtcatgactcccttcgatgtggtcagcacgcggctatacaatcagccggtggacacagctggcaggggccagctctatgggggcctcaccgactgcatggtgaagatctggcggcaggagggccccctggcactctacaagggcctgggccccgcctacctgcgcctgggcccccacaccatcctcagcatgctcttctgggacgagcttcggaaactggctgggcgggcccagcacaagggcacctagacgacggccctcacccccacgtcctgacacggccggcacttggccggaagtgagagcctgctccaggacaactggctgtcccggggcgggccatgggcccaggccctgccagaggtcccgggagagtgtggacagctctggtccatccagccccttggcccacccaggtccagagcatccacttcaagttaccacccattctgtcttccagacagttctcttccttctctgtactgcgtactgggtcaccacatcccagagccttgctcagttatagcaactgctgcgggcgtgcacatggcataggcccagtaacttacatacatcggctcacttaggcctcagacagcagcacgaggcaggcacttttacttcttttaccattagaaagccaaggcctagagtggtgggctttgaccacagccacacaattttgaagtggcagagccaggactggagcttagccctgctcaccctagacctatgcgcttgacaagtgcgtgactgtgacaggcccatgggcccggactgcccataggggtcactgtaccatggcaaaggctgaggtgcaccaggaggctgtggcgtcgtcacctgccttatttgctggagaagctgtagcaaagaaccacagactgggcgacttagacaatagaaatgtattttctcacagttctggaggctggatgctggagaccaaggtgtcagtgggctggtttcttctgaggcctctgtccatggcttgcagatgctgctttctctctgtgtctgcacatggtggtccctcgatgtgcgtctgggtcctgatctcctcctcttataaggacacaaatcatgttggcttagggcccaccctcatgaccccactttaatttttttttttttttttgagatgaagtctcactctgccacccaagctggagtgcagtggcacgatctcggttcactgcaaccttggcctcctaggttcaagcaattctcctgccccagcctcctgagtagctgggattacaggtgtgtgccaccacacccggccaatttttgtatctttagtagagatggggttttgccatgttggccagactggtctcgaactcctgacctcaagtgatccactggccttggcctcccaaagtgctgggattacaggcatgagccacctcacttggcccaattttaacttaattatctctgtcaagagcctatctccatatacagtcacatcctgagctactagggggtaggacttcaacatgcacttctgcaggggccgcagttcagccaacatcatctttttttttgagatggagtctcgctttgttgcccaggctggagtgcggtggtgcaatctcggctcaccacaacctccacctcccaggttcaagtgattctcctgcctcagcctcccgagttgctgggactataggtgtgcgccaccatgcccagctaattttgtatttttagtagagacaggctttcgctgtgttggccaggctggtcttgaatgcctgaccttgccgcccgcctcggcctcccaaaatgctgggattacaggcgtgagccaccgcgcctggcctcagccaacatcatctaagggctctcacggagggcctcccagctgcccgccctgtgggcatttgcacatatcctgacaagcctgaaagaagctccgggtgcccattgttcagtccaggtgcccattgttcccgggactgaggcccgggaaagggaagcgacgtgatagggccagcagcagaccctgggcctttctctagactgagcaccattccccgtgggtgtgctctcagcgccgcaccgaccttcacactgcagagatggatgccaactccctggcaggggcaggactgctgccgagcagccccacctgccctcccagccacaccccaagtctgtaagggccgctcccaggaacacctgctactgcacactccaaaccaataaagttttatattttgtttacttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 58181 - DNA, 716 bp, Homo sapiens
agacagcctgggagggagaaggagttggagctcaagttggagacagcgaggagaaacctgccatagccagggtgtgtctttgatcctcttcaggaggtgaggacaagccagaggtccttggtgtgccctcagaaatctgcctgcagttctcaccaagccgctgtgaaaatggggataaacacccgggagctgtttctcaacttcactattgtcttgattacggttattcttatgtggctccttgtgaggtcctatcagtactgagaggccatgccatggtcctgggattgactgagatgctccggagctgcctgctctatgccctgagaccccactgctgtcattgtcacaggatgccattctccatccgagggcacctgtgacctgcactcacaatatctgctatgctgtagtgctaggattgattatgtgttctccaaagatgctgctcccaagggctgccaagtgtttgccagggaacggtagatttattccccaactcttaactgaaaatgtgttagacaagccacaaagttaaaattaaactggattcatgatgatgtaggattgttacaagcccctgatctgtctcaccacacatcccttcaacccacacggtctgcaaccaaactctaattcaacctgccagaaggaatgttagaggaagtctttgtcagcccttatagctatcatgtgaataaagttaagtcaacttc

SEQ ID NO: 58182 - DNA, 2074 bp, Homo sapiens
atgactgaaaaggcattatgtgattcaatgttctttaaagccaaagccagaacctaccgaggggcatcagagatggagcagaaggaagggaagctctctgaggatgggaccaccgtctccccagctgcggacaaccctgagatgtcaggaggtggagcccctgcagaggagaccaaaggcacagctggaaaggccatcaatgaggggcctcccactgagtcaggaaagcaggaaaaggcaccagccgaggacggcatgtcagcagaactccagggggaagcaaatggattagatgaggtcaaagtggaatctcagagggaggctggtgggaaagaggatgctgaggctgaacttaaaaaggaggatggtgagaaggaagagaccactgtgggttctcaggagatgactggcaggaaagaagagaccaaatctgaacccaaagaggctgaggaaaaggagagcacgctggcctctgagaagcagaaggctgaggagaaagaggccaaacctgaatctgggcagaaagccgatgccaatgacagagacaagcctgaacctaaggcaacagttgaggaggaggacgccaagacagcctctcaggaggagacaggccagaggaaagagtgcagcactgaacccaaggagaaggctactgatgaagaggccaaggctgaatcgcagaaggctgttgtggaggatgaggctaaggctgaacccaaggagcccgatgggaaagaggaggccaaacatggtgcaaaagaggaggctgatgcaaaagaggaggcggaggatgcagaggaggcagagccaggcagtcccagcgaagagcaggagcaggacgtggaaaaagagccagagggaggggcaggggtgattcccagctccccagaggagtggcctgagagccccactggggaggggcacaacctcagcacagatgggctgggtccagactgtgtagcttccggacagaccagtccttcagccagtgagtcttcacccagcgacgtgccccagagtccccctgagtccccttcctcaggggagaagaaggagaaggcaccagagcgcagggtatcagcccctgctcggccccgggggccccgggcacagaaccgcaaagccatcgtggacaagtttggcggggcagcttccggccccacggccttgttccgcaacactaaggcagccggggcagccattggtggtgtcaagaacatgctcttggagtggtgccgagccatgacaaaaaaatacgagcatgtggacatccagaacttctcctccagctggagcagtggtatggccttctgtgccctcatccacaagttcttccctgacgcctttgactacgcagagctggatcccgcaaagcgccggcacaacttcaccctggccttctccacagcagagaaactggctgactgtgctcagctgctggacgtggatgacatggtgcggttggctgtgcccgactccaagtgcgtctacacatacatccaggaactgtaccgcagccttgtgcagaaaggactggtgaagaccaagaagaagtgaggaggtgactggctctgtgggcagagatgggcagggtgcccagctcagcagccacggcccgggggttcccttctgctccatggaggcaccagagccaggggcttaggcaagggtgtgtggcgttggttttaactgcattaaaagtacttttgtaaaatcctgtctggcccctcagtgctctctccatacttggcccaggaacctctgcactctgggataataaactctggccataggggattcctcacctgctgaggtctcaataactgcgcaaggtgtttgggaaaggacaatggcctggttcccaccactaaccagctgtgtgacacatacagttaacctctctgggccccagtttacagtctgaaaggggataatgagagttccaaccttatgaaggtgttgcaagagttaaacgagataatgaaatgggcaaaaagctttgcccagtcctgccactcaagtgttcagtaagtggtcgccaaaaataaaaaacttacattttgactctggtggc

SEQ ID NO: 58183 - DNA, 2074 bp, Homo sapiens; identical to SEQ ID NO: 58182

SEQ ID NO: 58184 - DNA, 2808 bp, Homo sapiens
cggcatgagaggccagcctgccagggaaatccaggaatctgcaacaaaaacgatgacagtctgaaatactctctggtgccaacctccaaattctcgtctgtcacttcagacccccactagttgacagagcagcagaatatcaactccagtagacttgaatgtgcctctgggcaaagaagcagagctaacgaggaaagggatttaaagagtttttcttgggtgtttgtcaaacttttattccctgtctgtgtgcagaggggattcaacttcaattttctgcagtggctctgggtccagccccttacttaaagatctggaaagcatgaagactgggccttttttcctatgtctcttgggaactgcagctgcaatcccgacaaatgcaagattattatctgatcattccaaaccaactgctgaaacggtagcacctgacaacactgcaatccccagtttatgggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgattgagcctcaggagaaaaaactctcagagaacactgattttttggctcctggtgttagttccttcacagattctaaccaacaagaaagtatcacaaagagagaggaaaaccaagaacaacctagaaattattcacatcatcagttgaacaggagcagtaaacatagccaaggcctaagggatcaaggaaaccaagagcaggatccaaatatttccaatggagaagaggaagaagaaaaagagccaggtgaagttggtacccacaatgataaccaagaaagaaagacagaattgcccagggagcatgctaacagcaagcaggaggaagacaatacccaatctgatgatattttggaagagtctgatcaaccaactcaagtaagcaagatgcaggaggatgaatttgatcagggtaaccaagaacaagaagataactccaatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctactgatgatggtaataccacgcccagaaatcatggagttgatgatgatggcgatgatgatggcgatgatggcggcactgatggccccaggcacagtgcaagtgatgactacttcatcccaagccaggcctttctggaggccgagagagctcaatccattgcctatcacctcaaaattgaggagcaaagagaaaaagtacatgaaaatgaaaatataggtaccactgagcctggagagcaccaagaggccaagaaagcagagaactcatcaaatgaggaggaaacgtcaagtgaaggcaacatgagggtgcatgctgtggattcttgcatgagcttccagtgtaaaagaggccacatctgtaaggcagaccaacagggaaaacctcactgtgtctgccaggatccagtgacttgtcctccaacaaaaccccttgatcaagtttgtggcactgacaatcagacctatgctagttcctgtcatctattcgctactaaatgcagactggaggggaccaaaaaggggcatcaactccagctggattattttggagcctgcaaatctattcctacttgtacggactttgaagtgattcagtttcctctacggatgagagactggctcaagaatatcctcatgcagctttatgaagccaactctgaacatgctggttatctaaatgagaagcagagaaataaagtcaagaaaatttacctggatgaaaagaggcttttggctggggaccatcccattgatcttctcttaagggactttaagaaaaactaccacatgtatgtgtatcctgtgcactggcagtttagtgaacttgaccaacaccctatggatagagtcttgacacattctgaacttgctcctctgcgagcatctctggtgcccatggaacactgcataacccgtttctttgaggagtgtgaccccaacaaggataagcacatcaccctgaaggagtggggccactgctttggaattaaagaagaggacatagatgaaaatctcttgttttgaacgaagattttaaagaactcaactttccagcatcctcctctgttctaaccacttcagaaatatatgcagctgtgatacttgtagatttatatttagcaaaatgttagcatgtatgacaagacaatgagagtaattgcttgacaacaacctatgcaccaggtatttaacattaactttggaaacaaaaatgtacaattaagtaaagtcaacatatgcaaaatactgtacattgtgaacagaagtttaattcatagtaatttcactctctgcattgacttatgagataattaatgattaaactattaatgataaaaataatgcatttgtattgttcataatatcatgtgcacttcaagaaaatggaatgctactcttttgtggtttacgtgtattattttcaatatcttaataccctaataaagagtccataaaaatccaaaaaaaaaaaaaaaaaaaaaaaaaaaaaaaaaaaaaaaaaaaaaaaaaaaaaa

SEQ ID NO: 58185 - DNA, 1643 bp, Homo sapiens
atttcagccctgacaccaaggcaggaggctaggaggtctacaaatagcgactgggtagctggtgtgaacacagggggtactgggggggcttagcccccaaggaagaggaccagtttttccccagcaccaccatcaaggcctcgaggctcccagctccctctacagcctgtggactgacttagggaatcccgaacgatgacagaaaaggaggtgctggagtcccctaagccctccttcccagcagagactcggcaaagtgggctacagcggctaaagcagttactcaggaagggttctacagggacaaaggagatggaacttcccccagagccccaggccaatggggaggcagtgggagctgggggtgggcccatctactacatctatgaggaagaggaagaggaagaagaggaggaggaggagccacccccagaacctcctaagctggtcaacgataagccccacaaattcaaagatcacttcttcaagaagccaaagttctgtgatgtctgtgcccggatgattgttctcaacaacaagtttgggcttcgctgtaagaactgcaaaaccaacatccatgaacactgtcagtcctatgtggaaatgcagagatgcttcggcaagatcccacctggtttccatcgggcctatagttccccactctacagcaaccagcagtacgcttgtgtcaaagatctctctgctgccaatcgcaatgatcctgtgtttgaaaccctgcgcactggggtgatcatggcaaacaaggaacggaagaagggacaggcagataagaaaaatcctgtagcagccatgatggaggaggagccagagtcggccagaccagaggaaggcaaaccccaggatggaaaccctgaaggggataagaaggctgagaagaagacacctgatgacaagcacaagcagcctggcttccagcagtctcattactttgtggctctctatcggttcaaagccctggagaaggacgatctggatttcccgccaggagagaagatcacagtcattgatgactccaatgaagaatggtggcgggggaaaatcggggagaaggtcggatttttccctccaaacttcatcattcgggtccgggctggagaacgtgtgcaccgcgtgacgagatccttcgtggggaaccgcgagatagggcagatcactctcaagaaggaccagatcgtggtgcagaaaggagacgaagcgggcggctacgtcaaggtctacaccggccgcaaggtggggctgtttcccaccgactttctagaggaaatttaggcgtgcgggcgcctgcaagcgggagacacccacaccccattctgggcgggcccagtggagtttggggaggggggcgaaagcaacgggactgctgggagaggaggggtaggaaggcccgcctgagcgcgacggggcttccgggaagggactggttctcgcccccttccccagcctggggcctcggatacctgctgcccagagcagcccggacccgaaacctttcaggccccgcttgcaagagctggaaaaaaacgcgtatctactaggaggagccagggactggggcggggggcgggggcgagggagggcgaactgtcgaatgttgcgaatttattaaacttttgacaaaactt

SEQ ID NO: 58186 - DNA, 2040 bp, Homo sapiens
ggggcaccggagctgcgggctgcgtggccgggatgagcgccagcacgggcggtggtggggacagcggcggcagcggcggcagtagcagcagctcacaggcctcctgcgggcccgagtcctcgggctccgaactagccctggccacaccggtgcctcagatgctgcagggccttctgggctccgacgacgaggaacaggaagaccccaaagactactgcaagggcggctaccaccctgtgaagatcggcgacgtgttcaatgggcggtaccacgtggtgcgcaaactgggctggggccacttctccaccgtctggctctgctgggacatccagcgcaagcgctttgtggccctcaaagtggtgaagagtgcggggcattacacggagacagctgtggatgagatcaagctcctgaaatgtgtccgggacagcgaccccagtgaccccaaaagagagaccattgtccagctcattgatgacttcaggatctcaggagtcaatggagtccatgtgtgcatggtgctggaggtgctgggccaccagctcctcaaatggatcatcaagtccaactaccagggcctgcccgtgccctgcgtgaagagcatcgtgaggcaggtgctgcacggcctggactacctccacaccaagtgcaagatcatccacacggacatcaagcccgagaacatcttgctgtgtgtgggggacgcttacatcaggcgcctggctgccgaggccacggagtggcaacaggcaggggcgccgcccccctcccgctccatagtcagcactgccccccaggaggtcttgcagaccggtaagctgtccaaaaacaagaggaagaagatgaggcgcaaacggaaacagcagaagcggctgctggaggagcggctgcgggacctgcagaggctggaggccatggaggctgccacccaggctgaggactctggcttgagactagacgggggcagcggctccacatcctcttcaggctgtcaccccgggggcgccagagcaggtccctccccagcctcttcctcccccgccccggggggcggccgtagcctcagcgcgggctcacagacctcaggcttctccggctccctcttctctcctgcctcctgctccatcctctccggctcgtccaatcagcgagagaccgggggcctcctgtcgcctagcacaccattcggtgcctcgaacctcctggtgaaccccctggagccccaaaatgcagataagatcaagatcaagatcgcagacctgggcaacgcctgctgggtgcacaagcacttcacggaagacatccagactcggcagtaccgggccgtcgaggtgctgatcggcgccgaatacggccccccggcagacatctggagcacagcctgcatggccttcgagctggccactggtgactacctgttcgagccgcattctggagaagactacagtcgtgatgaggaccacatcgctcacatagtggagcttctgggggacatccccccagccttcgccctctcaggccgctattcccgggagttcttcaaccggagaggagagctgcggcacatccacaatctcaagcactggggcctgtacgaggtactcatggaaaagtacgagtggcccctagagcaggccacacagttcagcgcctttctgctgcccatgatggagtacatccccgaaaagcgggccagtgccgctgactgcctccagcacccctggctcaacccctaggcccggctgtggctccacctccagctctccgtgccttaagggaaaagcgggacagctcccaccaccctgctgggcgccagttctccacaaccacagggcagagagacgctggagccaggcccggctctcagagcgtgttctgcctgagacccccgtgagggctctcggagaaagtgtgtgtattcctttcttaataaagtgtggactgaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 58187 - DNA, 5179 bp, Homo sapiens
atgcatggagaaaaaggaatctggcagcacttccagcgggagggggaagctctcctggatttcaagtcccgtgaaagggcccactgccaacgaaacagcctcatcaaagcggcctctttcatggccacagctgttgctggtttggggctccgcctgtcagactgcgtcaccctctcgccaagggtcccccagacgggcgggggctccttgcggccggctagctactctccccgcctccctgcgccctcgccctccgccccgctgtacccgcagagcgcgcggcccagcgcagccccttttggcaccgaggtttccaggtgcccagcgcgaaggcggagccgggttacagccgcctcctcggcgccacagagaagacccccgggagttcggcggcccaggcgctccggctctgcgtcccgagcctcccccggctctccgcgctcctccctctcggcgcgcccggcgcgaagcctgcgattcgtgagccgagcgcagagcgcagagccgagtggcgcacgctgggcagtggcctgggcaaccccaaacgcagccagagccctcacccgagtccgctggcccgcgcactcccggaccatgactgccgagggacccagcccgcctgcccgttggcacagacgcctccccgggctctgggcggcggcgctgctcctgctcggtctgccgcgcctttcggtgcgggcggatggaaagttctttgtgctggagtctcagaatggctctcagggcctacaactggaggctgctcggctttcctgcaagagcaggggcgctcacctggcatctgcagacgagctgcggagagtggtacaggattgctcctttgcggtgtgcaccactggctggctagcagatggtactcttggaacaactgtgtgtagcaaaggaagtggagaacagcaaatcatgagagctgtcgatgtgagaattgagagcaacccagttcctggtggcacatacagtgccctttgtattaaggatgaagagaagccgtgtggagacccgccttcgttcccacacaccatcctgcagggccgcaccggcttggaaatgggggatgaactgctgtacgtgtgtgccccaggccacatcatgggccaccgggagaccgccttcaccttgctatgtaacagctgtggggagtggtacggcctggtgcaggcctgtgggaaagatgaggctgaggcacacattgactatgaagataacttccctgatgacagatctgtgtcattcagagagctcatggaggattcccggacagaggcagatgaggacaggggtcagggagactcctctgaggaggctccaaaacaggaccgtctggtctccatttctgtggggagagaaaacatagcccgggataaagtctttgtgccaaccacaggcttgcctggtgctgggagcagtgtccccgcagattcaccaggatcacggctgctccagaagcacttgttctggtttcctgctgaggctttccacaagcctgggttggaaaaggaggtggatgatgacaccaaaaagcagttttctgctggagacaaccacagtggtgtaaaattggtcccaggtgaacctgaaaccaaggtgatctacggcaacactgatggtccctcggggccatttgtgggcaagaatgacagcaaggcaggagatccagtggtgagcagcagtgatgagtcctggttagatggctaccctgtgacagagggggcttggaggaagacagaggcagaagaggaagaagatggggacagaggggatgggtcagtagggctggatgaaaacgtcctagttactcctgatcagcccattcttgtggaagttaagaagcccaagagtagcaccctcacaccaagcgagggcatgacccatagttcagttcttccatctcaaatgctagatgtggaagctttggcgctcagacccgtgaatgcttccgagactgagggcattggggatggtgacttgacgaagtaccagtcaactctaccctggagattcatcacagaggaatctcccatggccaccctgtcctatgagctcaccagctccaccctggagatattaacagtgaacactgtcaagcagacacctaaccacatcccctcaacgatcatggcaaccacccagcctccagtagaaaccactgttcctgagatccaggatagcttcccatacctgctgtctgaagacttctttggacaggaaggccccgggccaggtgcaagtgaggagcttcatcccaccttggagtcgtgtgtgggggacggatgtcctggcctcagcagaggccctgtgatcgccaccattgtcaccgtcctgtgcctactgctgctcctggcaggtgtggggatggtgtggggctaccgcaagtgccagcacaagagctctgtgtacaagctgaatgttggccagcggcaggctcggcactaccaccagcagatcgagatggagaaggtctaggcacctttggagtgggttctcccaaagccacttgggaggaaaataactgtgacacatcacacgataattcactagagcatgacgcaggtggactgaggctcatcattttttcctcagccctttgttttataggctgagaagtgtctctggagcacctgggagggcagggaggctttggtgacatcatcactcatgtcaatgtctcctccaccatctgccctggaattgactacactaatcccagacctgtgcttgggccctgtttccagtgtgaggtcaaaaatcgcctcttccttcatcacagtattatctttttttttttgagacagagtctcatgctgttgcccaggctggagtgcagtgtcccgatctgagctcactgcaacctctgcctcccaagttcaagcaattctcctgcctcagcctcccaagtaggtgggattacaggcatgcaccaccatgcccagctaatttttttatatttttagtagagatggagtttcaccatgttggccaggctggtcaagaactcctgacctcaagtgatctgccctccttagcctcccaaagtgctaggattccaggtgtgagccacatcacagtattacctttttgaagaaagaaaatcaccagcttcatgccctgaaattttataaatagtcatgataaaccaagtgtatgagagcagtattatctaggacatggatattgaattattgggagaggaatatggaagaataatgggttgtttccttttaatgttgtgatgttgctgagggcagatgaaccaagagccaggacacagtctagaagctttgaggtttcttttttcattgtttcttgaaattagaatttaagactgacattttgttgggggagttgaggagtgaagaaacacacatccccctctgttccctccattctgtgggacagtctgtcatttattttattttattttcaatatttcatggttaaggatttgccattattttttaaaaacaaagttagctttgtaccagtaagtaccatttcctctcagaagcagtggcctagttgtccttgaccagtctgtgcctaggaatgtcttggaatttttgccaggactaacaaaactcagtccttggtttcctctctcaggattaaccatttctctgaactccagtaagagagaatgacacgggagaaaaaaaaaagaaatgttttcagagggccgaacaccaggttatcaagtatgggcacatacttgatggagaagcagaagaatctgtgaaagaatatgaaatgatctgtgctgatctgttctctagtgtggaaactgggagctctgtggaaacagaatccatcctgtctgttgggtaacccatttcgtagcatctaaatcatcttagggtggctcagcgaggatggtttatggcagtggttctcaaagtgtggtcctcagaccagtagcatcagcgtcacctgggaatttgttggagatgcaaattctctagtcccaccctggactcaggaaacaggaaccctgggagtagggcccagttctgtttttaacaagccctccaggtgattttgatatgcactcaagtttgagagcctgttggtttataataatctcaaatgtgaacttcgaggccagctgaagccctaaaggcacagatgagtatgtggtgtgtgttgtgtggaagtcaggcatggctgtgtgcagctgaggtggcatttgaagctgcctaaatgccacctgcaatagtctcctgtatgttggcacagaaatgaaacatgttatatttttctaatatgaatcaccttcttagaaatagttatcagtggtaaaaagtgatgaatgcaacacatttattttgagacaccatagcagtctaagtgtttttgtgtggtagagggaaatcctgatcttttttatgattgaaaaattgttggtggtgttttacctaaggaaaaaaaacattcgcaacatgttttctaccctgccacctcttttcagcaagctttggaaaagtaataggcgaagtagctgtaaagagaggcagcataatcaaagatcttattccccatagttgggtaaaataaagcctgaaggtaccaactagaatacctgtgcatcagacgaagtcaagaacaataggaataaaatgctttctgcatgtagccaaagcaaaacataatagaataaaagccagagactgtatatatttataaattagatcctaatctactgcaagataacttttctatttttaactatataaaataacctctgtctcagcattgggactgtgttagcaactattattgtggaataacccagaacattggatttataccaacaaataggcaatattaatacagtgtattaataaatttattacaaattattaatacagtgtattaataaatttattacaaattattaatacaggtaaatgttttatttgtagacatggactgtgaaataaacccaacacatcagtttttaagttcttattggtgtggtatcctctaaattaatgttatagaatctaaaaattcatgttgaaagggaatgattaaaacaatgtaaatctaaattgtatgtcatgcatgttttgagaatggtgaatgtttaatgctcatgaaaattgggggagggggttctattaacacaaagcttctgagatatttaaaataaataattattgcc

SEQ ID NO: 58188 - DNA, 3524 bp, Homo sapiens
gtcatctgtggaggagaaaagtcacatccagctccttcatgttgctgccgatgtgggattttcctggcttcgtcagccaagcaattggctgcctttgccggaggctttgagaaccaaggcttgaaggccggcaggagcatccagggggaagcttggcttcagggaggacctagcagacgttgggccggagcactagcctcacggagaaggatctgaaagaagccaaggcgcggagccagcagattgcagcccagctgaccacccctcccagctccaattcccgtggcgtccagctcttcaacaggcgccggcagagggtgaacgagttcaccttggagagccacggccagaggggacagaagcccagccaggagtccctcagagtgctcccttcaagcctcccaggccatgcaccggggctcagcctgagttccacctcgctgccggagccaggccctccacggcaccccagtccccagagccccgacagaggggtccctggccacagcatggaggggtactcagaggaggctagcttgctgcggcacctggagaaggtggccagtgaggaggaagaggtaccactggtggtttatctaaaggagaatgcagcactgctgacagccaatgggctgcacctgtcccaaaaccgagaggcccagcagtcctcaccggccccacctccagctgaggtccacagcccagctgcagatgtcaaccaaaaccttgcctcgcccagtgccacgctcaccacaccaacttctaacagcagccacaatccgccagccaccgatgtcaatcagaacccaccggcaactgttgtcccacagagcctgccactttctagcatccaacagaattcctcagaggcccaactcccatctaatggcacagggcctgcttccaaacccagcaccctgtgtgctgatgggcaaccccaggcaccggctgaggaggtgagatgcagcacactcctaattgacaaggtatcaactccagctaccaccaccagcaccttctccagagaagctacgctcatccccagctccaggcccccagcctcagatttcatgtccagctccctgctcattgacatccagcccaacaccctagtggtgtcagcagatcaagagatgtctgggcgagcagctgccaccacgcccaccaaggtctacagtgaggtccacttcacactggccaagcccccatcagtggtcaacaggacggccaggccttttgggatccaggcgccagggggcaccagccagatggagaggagccccatgctagagagacgacattttggggagaaggccccggctccccagccccccagtttgccagacaggagcccccggccacagagacacataatgtcccgcagccccatggtggaaaggaggatgatggggcagcgaagcccggcctcagagagacgccccttggggaacttcactgcaccccccacctacactgagaccttgtccacagcccctctggcttcctgggtgaggtctcctccctcatattctgtcctgtatcccagctccgaccccaagtcttctcatctgaagggccaggcggttcctgccagcaagacgggcattctggaggagtcgatggcccgccggggcagccgcaaatccatgtttactttcgtggagaagcccaaggtgaccccgaatccagacttgctggatctggtacagacagcggatgagaagcggcggcagagggaccagggggaggtaggcgtggaggaggagcccttcgcactgggggccgaggcctccaacttccagcaggagccagcacctcgtgacagggccagccccgcggcggcggaggaggtggtaccagagtgggcctcctgcctcaagtcaccccgcatccaggccaagccgaagcccaaacccaaccagaacctctccgaggcctctgggaagggagctgagctctacgcccgccgccagtcacggatggagaaatatgtcatcgagtcttcaagccacacgccagagctggcccgctgcccatcacctaccatgtccctgccttcctcctggaaataccccactaacgcccccggggccttccgagtggcatcccgaagcccagcccggaccccgcctgcctccctctaccatggctacctgcctgagaacggggtcctgcgcccagagcccaccaagcagccgccataccagctgcgcccctcgctctttgtcctctcacctatcaaggagcctgccaaggtctcaccaagagctgcctcgcccgccaagcccagctccttggacctggtgcccaacctgcccaagggggctctccctccatctcctgccctgcctcggccctcgcgctcctcaccgggcctctacacctcccccggccaggacagcctgcagcccactgccgtgagccctccttacggcggtgacatctcccccgtgtctccctccagggcgtggtctccccgagccaagcaggcccccaggccctccttctctacccggaacgccgggatcgaggctcaggaccgccgggagagcctgcccacctccccaccctggacgccgggcgcgtcccggccccccagcagcctagacggctgggtgagcccgggcccgtgggagccaggtcgcgggagcagcatgagcagccccccgccgctgccgccgccaccgcccatgtctccctcgtggagcgagcgctcggtgtccccgctgcgacctgagaccgaggcgcggccccccagccgccagctgcaggcgcttctggcgcgaaacatcatcaatgcggcccggcgcaagagcgcctccccgcggtcggcgggcgccgagaacccgcggcccttctccccgccgagggcgccaccgcccccgcccccgcccccgcccccgcccccgcgcatgcgctcgccacagcccgcccgccccggctcggctgctgtgccgggggcagccttcgcgcccatcccgcggagcccgttgcccgccggtccttcgtcctgcaccagtccccggagcccgctgcccgcgcctcccaggcccttcctctaccgccgctcgcccacggactccgacgtgtccctcgactccgaggactccggggctaagtctccaggcatcctgggctacaatatctgtccccgcgggtggaatggcagccttcggctcaagcgtggcagcctccccgccgaggcctcctgcaccacctagagccccacccccgaccccaccccgggagggcagagccagaagaaggctcattagacctgggggacccaaagggtctggcctctttgggcagccccagagatgaggggtcagcagaggagagctctggggttggggatgggttagggacgcaagcttgagttctagcccttgctctcattcagctgttgtgtgaccctgggtaagacccttccttgtttgaccctcagctttcccatctgtttaatggtggctttggccaaggcaatccacaaacgtcaaaattccccttcccatcagtacaca

SEQ ID NO: 58189 - DNA, 1665 bp, Homo sapiens
cgtgcatctgaggcatttgagatcctttttgaagtctgtccaggccttccttttattcctgtggggccagacaggggcttaggaagggccaaaggaccatcatgaggctaagttgccccagagccccaggatggatgggcccattttttccttattccctgctcagttttttcccctgctccttctctagtccttctttcatatttctccttctcatcttgaaaacaggatgttccctcttcccttgctgtcccatttctcccctgtgtccttatttctcccagtctctatcccctctcaagtccagggcaggccgatgctattggtgcttcttcactttgggacccagttccatatttgtctttagtgtatatcctcttcctgatacctccttcagtccctctctgggccccaaggctgagaatcagtgttaactgggtaaggatcatttgcttcctacccagctcaatctgccctggccatagggcttcccagggaaggaagaagagggaagaatccgaccactttccaatccagtgccaattggcccactaagcatcctaaaggtgaatgtgccctgtgccaatctctcctcaggactgagtcaacccccttcaacctcctcacctctctaaacaccatccatagtaacatgtgcattactggggtacctaggagtcaggacttttgacttcaggccagtcatttcctcccgatggggaaagggtgagatttacatccccaaatgcttgagtccctcagtgaaagaattagtttttgtttgtttgtttaagattttggggaagagatttgaggaggaaagaaaggagatggggtgagagggtttttaagtctgaaactctctgtcatgagctgtccccatggttactcaaggacaaggggggacagttttgcctacagctccagagacacagagaacaaaggggtgaccttcatttttcttcaagccggcctctgtgggggtctgtgagcagcttctactggatctttgtttggattctgtgtctgtatttataatttatttgaaatgtgctgggtagtgttctcatttgggggctgaagttagcaactgggccttcagctagggaaagcagttgcgggcagggggtggggggagattatattcactcctgccaaggactcccagcccaggactctctttagagcaaggaagcctcgttctctttcttctcaagaggctctcttgttctccatcaggagagccttgatttaggctacggcctcactctctatggccaccctaagaggaaaggctacttcacctcattacctccagagggctgggcagggccaagtgcctcataggactcatgttctctccaaccagggctggcatcactgctttgcaaagtggggcctgaggtagaagaaggtgtctggtttctccagctgctgtaggaggctaatgggcagggtacttgccctttgtcccactagactctaacccagcaccagggtgcccacctaggacctttcctggacatgagtttccttcactatcatagtcatgagcctcctacttctgggattgcagatcaggggtggggggagaatgttgcatgttgttttctggtgcttgttattatatatttgaataaacagtgctgcaagtacttgccatga

SEQ ID NO: 58190 - DNA, 1639 bp, Homo sapiens
agctgcgggggcgcagtcgccgggccgcgggcggcgggacggacgaggccggggccccgggtggcacccggcaggcgggcaggcgggcgccatggagctgctctcggcgctgagcctgggcgaactggcgctcagcttctcgcgggtgccgctcttccccgtcttcgacctcagttacttcatcgtctccatcctctacctcaagtatgagccaggagcagtcgaactgtcccggcgccaccccatcgcgtcctggctgtgcgccatgctgcattgcttcgggagctacatcctggctgatctgctccttggggagccactgatcgattacttcagcaacaactccagcatcctgctggcctcagctgtctggtacttgattttcttctgccccctggacctcttctacaagtgtgtctgcttcctgcctgtgaaactcatcttcgtggccatgaaggaggtggtgcgagtccgcaagatcgcggtgggcatccatcacgcccatcaccactaccaccacgggtggttcgtcatgattgcaactgggtgggtcaaaggttctggtgtcgccctcatgtccaactttgagcagctgctccgaggggtctggaagccagagaccaacgagatcctgcacatgtctttccccaccaaggccagcctgtatggagccatcctcttcaccctccagcagacccgctggctcccagtgtccaaagccagcctcatcttcatcttcaccttgttcatggtgtcctgtaaggtgtttctgacagccacccactcacacagctccccctttgatgccctggagggctacatctgccccgtgctgtttggttcggcctgcgggggtgaccatcaccacgacaaccatggtgggtcccacagcggtggtgggccaggagctcagcattcggccatgcccgccaagtccaaggaggagttgagcgagggctccaggaagaagaaggccaagaaggcggattagggggtggcccaaggggcaccggggagaggacccggacccaggaccctctgagctgggaggcttcctgcgctcagacctatcctttcctggccttgacttccccatctgcaaatcagggtcattggctcaccctccagggctgacgtgggggttgagatatggggatgaggatgaagaacttttgtagaaatcggggttccctctttctctctgccaggaccccatagagtcacagcttttggaggggttcacagaatcctggcagcagctccagtcaagaatgtcactggttggcatgatattcttagttctatttttccttctttaaaattgcatcttgaccaggcacagtggctcatgcctataatcctagcactttgggaggccgaggcgggcagatcacctgaggtcaggagttcaagaccagcttggccaacatggtgaaaccccatctctaccaaaaatacaaaaattagccagacgtggtggtgcacgcctttaatcccagctactcgggaggctgaggcaggagaatcacatgaatccaggaggtggaggttgcagtgagctgagatcttcccactgcactccagcctggccaataagacctgtctccagcaagaccctgtctcaaaaaaaaaaaaaaaa

SEQ ID NO: 58191 - DNA, 1235 bp, Homo sapiens
tgagaagggaggtgaccaccaggactggctctgtgagtaccacacagtgggagggggtgggggccacatgtcatcatatcagaaggaactggagaaatacagagacatagatgaagatgagatcctaaggaccttgagccccgaggagctagagcagctggactgcgaactacaggagatggatcctgagaacatgctcctgccagctggactaagacaacgtgaccagacaaagaagagcccaacggggccactggaccgagaggcccttttgcagtacttggagcaacaggcactagaagtcaaagagcgtgatgacttggtgcccttcacaggcgagaagaaggggaaaccctatattcagcccaagagggaaatcccagcagaggagcagatcaccctggagcctgagctggaggaggcactggcacatgccacagatgctgaaatgtgtgacattgcagcaattctggacatgtacacactgatgagtaacaagcaatactatgatgccctctgcagtggagaaatctgcaacactgaaggcattagcagtgtggtacagcctgacaagtataagccagtgccggatgaacccccaaatcccacaaacattgaggagatactaaagagggtccgaagcaatgacaaggagctggaggaggtgaacttgaataatatacaggacatcccaatacccatgctaagtgagctgtgtgaggcaatgaaggcaaatacctatgtgcggagcttcagtctggtagccacgaggagtggtgaccccattgccaatgcagtggctgacatgttgcgtgagaatcgtagcctccagagcctaaacatcgaatccaacttcattagcagcacaggactcatggctgtgctgaaggcagttcgggaaaatgccacactcattgagctccgtgtagacaatcagcgccagtggcctggtgatgcagtggagatggagatggccaccgtgctagagcagtgtccctctattgtccgctttggctaccactttacacagcaggggccacgagctcgggcagcccaggccatgacccgaaacaatgaactacgtcgccagcaaaagaagagataacactgcatttccctttaccaactagcgctgggagcactggacacttaaatcctcatctgtcctcctttcctgtaaataaaagcccttctatccaaaaaaaaaaaaaaaaaaaaaaaaaaaaaaaaaaaaa

SEQ ID NO: 58192 - DNA, 698 bp, Homo sapiens
tcatctttgggtggtggagtgcaaaggaggcgacctgcaacagaggagtcccggtcaccagcaaccatgacggaccagcaggctgaggccaggtcctacctcagcgaagagatgatcgctgagttcaaggctgcctttgacatgtttgatgctgatggtggtggggacatcagcgtcaaggagttgggcacggtgatgaggatgctgggccagacacccaccaaggaggagctggacgccatcatcgaggaggtggatgaggacggcagcggcaccatcgacttcgaggagttcttggtcatgatggtgcgccagatgaaagaggacgcgaaagggaagagcgaggaggagctggccgagtgcttccgcatcttcgacaggaatgcagacggctacatcgacccggaggagctggctgagattttcagggcctccggggagcacgtgacggacgaggagatcgaatctctgatgaaagacggcgacaagaacaacgacggccgcattgacttcgacgagttcctgaagatgatggagggcgtgcagtaaggagtggacagtcgcctctaccaagatcgcgtgtccctagggtgtgggagactccgccctgccgggtccccaccagggaggcgcgaccccttgtgggtctttgtctggaaggaataaaagcaaatgttccaaaaaaaaaaaaaaaaaaa

SEQ ID NO: 58193 - DNA, 6162 bp, Homo sapiens
ctcggctctgcccctcacagtctgcagtctacggcgaggcacaggccagcccagctccacgaggactgaacaaggtgctgtctcactgccaccatgccggaagtcgagagaaaacccaagatcactgcctcccgcaaactcttgctgaagagcctgatgctggccaaggccaaggaatgctgggagcaggagcacgaggagcgcgaggctgagaaggtgcgctacctggcagagcgcatccccacgctgcagacccgtggcctgtccctcagtgccctgcaggacctgtgccgggagctgcacgccaaggtggaggtggtggatgaggagcgatacgacattgaggccaaatgcctccacaacaccagggagattaaggacctgaagctgaaggtgatggacctccgtgggaagttcaagcgcccgcccctgcgtcgagtccgtgtctcggctgacgccatgctccgggccctgctgggctccaagcacaaggtgtccatggatctgcgggccaacctcaagtctgtgaagaaggaagacacagagaaggagcggcctgtggaggtgggtgactggaggaagaacgtggaggccatgtctggcatggaaggccggaagaagatgtttgatgccgccaagtctccgacctcacaatagaggccagcttgctgtgctgcgctctgagctcctgcttcatgcttcttctccaacccagctcactcacctctctgcctgtgtctggagcatcccttcccacctctcccccacttcttccctccagcctgcatgccctcctctggaactgggattaaacagatacccaagaggcaggaaaaacgcgagtgtctgaagacctcaccctggcagggtgggcttctatccacccatgaggcacctggggcttctcagccaccccgtggtgtaacaagtggaggaggaggagggggtgagaacacctttcctccagccctgtgccacactccttctatgtgtgtacagtgtccacaggcatcacaccttcttcattaaaaacccagtttcctggtcatttctgcagctctgactgtgagccctgagaagaaagggaagacttggggcttgggaagagagggctgtgctgggctccagtcaccctgtctgcagtccggagctcgggatctgaagggagggctaaggaattggtggctgcttgccagggtcccctggggccccttctgcccagtccctgtgacgtcacactgcacacactcaccacccaggatgctcagctcaccagagccctgacctccgagaaatgaccccgtcctgcccctgactctggccatcagaagaggcctctccattaagagccgcttctcctgccggctttcatactctccttcctctgcaaacctggattaactctccctgatgtgtgctgggttgagaggtcagggcactttcaatccctcacctagtcctgctgcacagggcaggaggcctcacagaagagatacttgcagttccaggcctggccaccaggtgacgccttccttctctcctgggctctcctgtccctccggcctctgctctccccacgttcacccaccctcctcccaattgtttccccttcacactcctgcactggtcctatcccccaggactgattctttcccggagatggggtggccacttatctgtcctctggatcaggtcctttctccatcccactacctcctgggtccaaagcctggtgagagcatagggccttctggggtggaaggggggtctggggcagcctctcttcccccaacatactcactagagtggctcctgtgaagcagagaccaaagttctgacttttctttttccttttttttttttttttgagatggagtctcgctgtgtcacccaggctggagtgcagtgacgcgatctcgactcactgcaacctccgcctcccaggttcaagcgattctcctgcttcaacctcctgagtagctgggattacaggtgcgtgccaccacaccccgctaatttttgtatttttagtagagacagggtttcaccatgttggtcaggctggtctcgaactcctgacctcgtaatctgcccacctcggcctcccaaagttctgggattacaggtgtgagcgaccacatccggtcaagttctgacttttcagggcagtgggatggtgacttctgagctaagcctgcaagggaagtggctgttcccagacctggggtcccttggcttttcgaccaccctagcactggccctaggaggggctgagttatcagagcagcaacccttctacccaccctactgagtccccattctaccttcgaatcccatgtattatcttccataagtgccagaaattggtacaaagtgcagtgccagctgctccccagggcatggtctggctctctgggctgctgggctgccagcccctttcagaaagcatggcagtgggaaccagcaacttgggctaccttaggggaagcagcactctgcccagggttcttgctataaataggtcagtgggcagagaggcagatgtgtgcaaaaagcacaaccccaatcacacacagaaacccgtaggcacggacacacccagtctcaatgcacgaagttggagaacctgacagggctggtccaggccacagaggatggggttaggcttcatgccttcatgcccaggcagccacagaaacccactcttccccgcctcacagggctcctccggttggcctggatccaaagcgatctccttgtttcacctctttccagctcttccctagagcctggccccaagttccagagtcaaatcccagttttgcagtcaactattaacctggggccctggcagattggggtatccacccagtcatgtaaaggcaggagacctgctctgggcctgactcaaagcaaacacgtgggtgcagaagacccatgggaggaggaggtggggcccactcaacacacctaagccagtggccctctaggaggggcagaagagccaaccagagggttcctggaggtcatcgggttcctccttctgcttccaggcagcaacagacctaattcatctcctgtgaggatggagcaagggcgaatataggcatagacatatctggagcgcaaggattgagaggccctgtggacaaggggaaggagagcttgggggtgggagagggatctatggaaggggctgttgtagccaagaatggggcctgggctgggggcctggcctctggagagccctgattctactccagtcttctctcaccatggagacaacaccagtagagctgggagctggggcctgccactgagtaacagctcacacatgtagcacacttatgcgtcaggcaccagcatgtacaccttaatttatttaactttcacaacaaccctaggagaaaggtacagctactattctcatggtacagtggggaaaactgaggcacagagaggttagggacttttcatgatcacacagctaataagtggtggtcccaggattcaacccaagaagtctgttagaatccatactcttatcgactattttaataacagcatttcaataatagtaatatgtgatgttaaatgctttatctgagttatatcattgcattctcacaaaaatggtacatttgttagctcaaatttacagatgaggaaatggaggcctggagagttcaagtagctcactctaagttacagggtttgctagctgcagactggagactagatctcaggtcactctgccttggggttgcccttttctgagatcagactggccttaacagagcccaactttcttggaaggacacagctgggggtcgagggtcctgcatatgcacctggggagtccccacacacccgcaccaaaggggaaacattcaaaggagatgcaggtgacatacagatgggctaaggtgaggccttcctccaacatggggccctggctgagagtggagggatagggtgctacttgggggatatctattactaatcagcacacaatagctgggtgggcaccccctctctctgcagctggtggagatgggcctggtgctcctctctgcttggtaggaatgaccagggcaggatgccacctgctacactcttgcctgtcccagagcccttgggagaccagctgttgctcccacctttccccacagggtgcccggtccccacggcgcaaggaggccaagctcagctgtgtgtctgagcccactcagcagcaggcatgatcagggcagggcccagcgctaagggctgctggggctaaagtgccttgctgaaggaggggcagagttaaacattagccacaatggccccccgcgaagtgagtcatactccccacaagtctctgggctgggcagccgggggcgggggggttagcttcgttccaggtgggtgaccaagctgcggaagcccaggacagttcgctgggaccagtgctaatggcagcttctgctcctgacccccatcaggtctctttcctcagacatccccaaagcttgtctgcctgtgggtctttcattaaaggtgacgggcaagggttttctcttccttccaagacacacttctaggctggcttgtgggtcccctgagacgaaggctgagcagggtgagcctcgaaaaccccatagcactggcccagagcactgcggtcaatgtccgaaggaccagagagggagggtgacttgctcaaggtcacaaacctaactggagctaggaagtaggtccccagactcccagtctgaggaaattggatgtggacagggctttggtctcctggccagaggcaaacgcccagggatctgaacaggctgcccatctctggcctcaactcagcaccccaactggctccagtgccaaccattggcctctctcactggttggcacaggctgggtgagcctggccctttgccctgggttcaggagagaggtatggctttgcctggcagtcaggggaggtgttccaacctgggagcccctgggggaggagcgtgtgtgtgaacgcttgtgcctgttcatcagaaggggtgagcatggtgtgtatgcgtgggcatgcagaatgcagggtgatgacctgtctgcccgccctgagtgtcacagacacctgtgtgtcccctgtactagtgcctcccagatgctcttctcctgactggctctttgtgacctaaatttcaactgctccaccccacaaggaggaaaccagggccacaaatgtagtgagattttcataaagctaaatgtattcagtggaaacgaccttcctctgatctaaaagcatgcatgcctttgttttattactggagtattaaattagcccttacttatggaataggaggacagtaggtggcaattgttttctaatgctcttacttcacaaaataaaatggtggcagcacaatgtcagtatttatattacacaatattattagtttgtaaaaaccgaaagccagggagcttactgccctggattctttagggcgtgggtcttatcacctcattcatttcttcccttcccctaagagtgccacaagcatggcagttgctcagctgagacacatgaatgggaacagaactgaaatatcaggatgtgacctcgagccagctggttggggctggggatccccctggatctccactctgtcctgtccgagaaaggggaagctgccctatgagtcttttttctgggggattccagaggttgaacgtctgttctgaggctcctcagaacctcgagggaggggacgagagagatgaccccttgcccaaccactggctgaaaaatcttgaaattccctgactttgaccagggaattcccagttgtgctaagccctgcctggtggaatgtccctggaggaagtaaccaggacacgcatacgtttttaatgtacgtataaagaatcgtaaagtgaacacccatctgccaaccactcattttaagaactaggatatggcacatacttttgaagcccttatgcgtccctccccaatcacaaccccttcctctccacaaaggtaaatacaatcctcaattttgtgtttgttattctcttggttctcttcataatgttactacgtatttatgaattcctaatacatcattcagttttggatctttttgtaaaccttaaaaaaaaaaaaaaaaaaaa

SEQ ID NO: 58194 - DNA, 700 bp, Homo sapiens
aggctccaagctcaggacctcaggatgggagatgaggagaagcggaacagggccatcacggcccgcaggcagcacctgaagagtgtgatgctgcagatagcggccacggagctggagaaggaggagagccgccgtgaggcagagaagcagaactacctggcggagcactgcccgccgctgcatatcccgggctccatgtctgaagtgcaggagctctgcaaacagctgcacgccaagatcgatgcggctgaagaggagaagtacgacatggaggtgagggtgcagaagaccagcaaggagctggaggacatgaaccagaagctatttgatctgcggggcaagttcaagcggcccccactgcggagggtgcgcatgtcggccgatgccatgctcaaggccctgctgggctcgaagcacaaggtgtgcatggacctgagggccaacctgaagcaggtcaagaaggaggacacagagaaggagcgggacctgcgagacgtgggtgactggaggaagaacatcgaggagaagtctggcatggagggccggaagaagatgtttgagtccgagtcctaggccactcgctgcccctacgcctgccccggtgcccggctcccagcagaacatactagggagatgcacccagagcctgccagggagggctggcctcaccaccaccgtcaataaaggatttgaatcccca

SEQ ID NO: 58195 - DNA, 980 bp, Homo sapiens
agcaaggctcagcctcaagattcacagcatctcagacgcagcctaggccgcaccaggatgtcggacaccgaggagcaggaatatgaggaggagcagccggaagaggaggctgcggacgaggaggaggaagcccccgaagagccggagccggtggcagagccagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggcccggtctgcctggctgcctccatcacagccctcctgccctgccagggagaaagcccaggagctgtcggactggatccaccagctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctgggagtgtttgtcccatcggtagcttgaaataaacgctcccctcagacacc

SEQ ID NO: 58196 - DNA, 1000 bp, Homo sapiens
cccaccttcaccatgtctgacgaggaagttgaacaggtggaggagcagtacgaagaagaagaggaagcccaggaggaagaggaagttcaagaagacaccgcagaggaggacgcggaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagcgctgtcctccatgggcgccaactacagcagctacctggccaaggctgaccagaagagaggcaagaagcagacagcccgagagatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacatcaccacgctcaggagccgcattgaccaggcccagaagcacagcaagaaggctgggaccccagccaagggcaaagtcggcgggcgctggaagtagagaggccagaaaggccctcgaggcagagaccctccgccctcttgcacaccagggccgctcgtgggactccacatcctccagcccccacaatcctgtcaggggtctccctgacgtcctgggggtggagaggccatcccggggcgtcccccgcgtctgtgtccttgctgccttcatcccctggggcctgtgaataaagctgcagaaccccctt

SEQ ID NO: 58197 - DNA, 1770 bp, Homo sapiens
atgaacttcacagtgggtttcaagccgctgctaggggatgcacacagcatggacaacctggagaagcagctcatctgccccatctgcctggagatgttctccaaaccagtggtgatcctgccctgccaacacaacctgtgccgcaaatgtgccaacgacgtcttccaggcctcgaatcctctatggcagtcccggggctccaccactgtgtcttcaggaggccgtttccgctgcccatcgtgcaggcatgaggttgtcctggacagacacggtgtctacggcctgcagcgaaacctgctagtggagaacattatcgacatttacaagcaggagtcatccaggccgctgcactccaaggctgagcagcacctcatgtgcgaggagcatgaagaagagaagatcaatatttactgcctgagctgtgaggtgcccacctgctctctctgcaaggtcttcggtgcccacaaggactgtgaggtggccccactgcccaccatttacaaacgccagaagaaacaggatctcactctgttgcccaggctggagtgcagtggcacaaacacaacttactgcagccttgatctcccgagctcaagtgatcctcccatcttagcctcgcagaacactaagattatagatagtgagctcagcgatggcatcgcgatgctggtggcaggcaatgaccgcgtgcaagcagtgatcacacagatggaggaggtgtgccagactatcgaggacaatagccggaggcagaagcagttgttaaaccagaggtttgagagcctgtgcgcagtgctggaggagcgcaagggtgagctgctgcaggcgctggcccgggagcaagaggagaagctgcagcgcgtccgcggcctcatccgtcagtatggcgaccacctggaggcctcctctaagctggtggagtctgccatccagtccatggaagagccacaaatggcgctgtatctccagcaggccaaggagctgatcaataaggtcggggccatgtcgaaggtggagctggcagggcggccggagccaggctatgagagcatggagcaattcaccgtaagggtggagcacgtggccgaaatgctgcggaccatcgacttccagccaggcgcttccggggaggaagaggaggtggccccagacggagaggagggcagcgcggggccggaggaagagcggccggatgggccttaaggcctgcgccgacccgaccctgctcgagagcccgcgctagagtcggggaggatctgcgcagagaccgcagcatcacccaaatcggcgccggccccgggaggatctcaataaagaactcgagcgtcccagacccgtatctcctttcgctgcccaaccccgcagcctgggcttcgaaggcgacccgcccaccatcctgcccttcccagaacctgagaccgtctggggggcggaagccaaatgaacccctattgggcacctctgtgatgccaggagcgaactggtgagcccagcgccctgggaagagggccgagggcggggcggtggtgccgggacctctgaggtcctggggatttggggacccttggggtccacatgcacctggctgacctggctgaaagccgctgtctcggagccccccacagcattttgttcccctcccgctggcccgggggccccaccttcccacgggttcccacgctgctgtgactgccctgcctctacgacaaaagccaacgggtcttcagtacttttattaaaaaatagtcacgcagacaaaaaaaaaaaaaa

SEQ ID NO: 58198 - DNA, 1644 bp, Homo sapiens
atgaacttcacagtgggtttcaagccgctgctaggggatgcacacagcatggacaacctggagaagcagctcatctgccccatctgcctggagatgttctccaaaccagtggtgatcctgccctgccaacacaacctgtgccgcaaatgtgccaacgacgtcttccaggcctcgaatcctctatggcagtcccggggctccaccactgtgtcttcaggaggccgtttccgctgcccatcgtgcaggcatgaggttgtcctggacagacacggtgtctacggcctgcagcgaaacctgctagtggagaacattatcgacatttacaagcaggagtcatccaggccgctgcactccaaggctgagcagcacctcatgtgcgaggagcatgaagaagagaagatcaatatttactgcctgagctgtgaggtgcccacctgctctctctgcaaggtcttcggtgcccacaaggactgtgaggtggccccactgcccaccatttacaaacgccagaagagtgagctcagcgatggcatcgcgatgctggtggcaggcaatgaccgcgtgcaagcagtgatcacacagatggaggaggtgtgccagactatcgaggacaatagccggaggcagaagcagttgttaaaccagaggtttgagagcctgtgcgcagtgctggaggagcgcaagggtgagctgctgcaggcgctggcccgggagcaagaggagaagctgcagcgcgtccgcggcctcatccgtcagtatggcgaccacctggaggcctcctctaagctggtggagtctgccatccagtccatggaagagccacaaatggcgctgtatctccagcaggccaaggagctgatcaataaggtcggggccatgtcgaaggtggagctggcagggcggccggagccaggctatgagagcatggagcaattcaccgtaagggtggagcacgtggccgaaatgctgcggaccatcgacttccagccaggcgcttccggggaggaagaggaggtggccccagacggagaggagggcagcgcggggccggaggaagagcggccggatgggccttaaggcctgcgccgacccgaccctgctcgagagcccgcgctagagtcggggaggatctgcgcagagaccgcagcatcacccaaatcggcgccggccccgggaggatctcaataaagaactcgagcgtcccagacccgtatctcctttcgctgcccaaccccgcagcctgggcttcgaaggcgacccgcccaccatcctgcccttcccagaacctgagaccgtctggggggcggaagccaaatgaacccctattgggcacctctgtgatgccaggagcgaactggtgagcccagcgccctgggaagagggccgagggcggggcggtggtgccgggacctctgaggtcctggggatttggggacccttggggtccacatgcacctggctgacctggctgaaagccgctgtctcggagccccccacagcattttgttcccctcccgctggcccgggggccccaccttcccacgggttcccacgctgctgtgactgccctgcctctacgacaaaagccaacgggtcttcagtacttttattaaaaaatagtcacgcagacaaaaaaaaaaaaaa

SEQ ID NO: 58199 - DNA, 1709 bp, Homo sapiens
gcttctgccctggagcgcggtcgggagtaaaatcgcaggagtgggagggtagcgagccagctggattccgagccgcggagcgcgctggctttgctccgcctgatgactccagagcgcgggtccaagcgccgcccatgcagcacccctgagctccggggaaggagagttaatgaaaaaacacttaaccgtctccgctgcggagagtcatgagctgtctggatgttatgtaccaagtctatggtcctccgcagccctacttcgcagccgcctacaccccctaccaccagaaactagcctattattccaaaatgcaggaagcgcaggagtgcaatgccagccccagcagcagtggcagcggcagctcctcattttccagccaaaccccagccagtataaaagaggaagaaggcagcccagagaaagagcgcccaccagaggcagagtacatcaactcccgctgcgtcctcttcacttatttccagggggacatcagctccgtggtggatgaacatttcagcagggccctgagccaacccagcagctactctcctagctgtaccagcagcaaagcaccaaggagctctgggccctggcgagctcgtcgttattccctctgtggtgcatccctcctgagctgatctgctgacccagggtttccccttccccttcccttctgaccagccttggaggctcagcatctgtgcctctcactccgtggatgaggacatgggggaaggcagagacttcagacttctcagtgtgttgggaaaaccaaaaaccacaactacagaaattcatctaaaaataagtcctgctgctgaaagagcaaatccaaagactgagttatgtttaatgacttttggccgaatcactggaaatatctgtggtgagattgctgagtcaggtgatgtgatatcataagctttcttggaacgggggaaagaaaatgaaactttttggtgtgaatattttttatgctgatgtgaattattttgttaggtagtgtgattatagcactactactgtcagattttaaattgtatgtgtacttgcatctaagactgtggtagagaagtaaagagaagtcaattccttcttcctcacctctcagcctccagatcccttcctgcccatcccttccctacaatgcccactccagacgcaaagatacacttttttcctttggactgtgaacatggaagcctcagcctgaatgtgagtggcaagtggcttatctggagccacctgcccaagtcttactaaaatgcagctgttgttagacaactgttgaaaactccagaaatacatcacccaaggtggcagttctcagtatttggcagaacaattgcaattgcactgggtatattatatatatatatgtatgcatatatatcatattttttacaaggaacattttatgatgaaagaagaaacccttctctgccttctctcccacgaattctgtccctgtatcctctggatgtaaaaagcaaggagagaccccaactgtctccatggagaagaactaggaatcaccacaaggggaagaaatgtacatgaagtctccattacctcgaatttttttctcagtctcactggttgtgatttggtcactttagtgttgggacaggggaaagggtctgtgcgtgggcaaagctgaaggtgatgaggaagaagagacgaacattaaagatgtctatttactatga

SEQ ID NO: 58200 - DNA, 2212 bp, Homo sapiens
gcggtcgggagtaaaatcgcaggagtgggagggtagcgagccagctggattccgagccgcggagcgcgctggctttgctccgcctgatgactccagagcgcgggtccaagcgccgcccatgcagcacccctgagctccggggaaggagagttaatgaaaaaacacttaaccgtctccgctgcggagagtcatgagctgtctggatgttatgtaccaagtctatggtcctccgcagccctacttcgcagccgcctacaccccctaccaccagaaactagcctattattccaaaatgcaggaagcgcaggagtgcaatgccagccccagcagcagtggcagcggcagctcctcattttccagccaaaccccagccagtataaaagaggaagaaggcagcccagagaaagagcgcccaccagaggcagagtacatcaactcccgctgcgtcctcttcacttatttccagggggacatcagctccgtggtggatgaacatttcagcagggccctgagccaacccagcagctactctcctagctgtaccagcagcaaagcaccaaggagctctgggccctggcgagactgctccttcccgatgagccagcgcagcttccccgcctccttctggaatagcgcgtaccaggcgccagtgcccccgccgctgggcagccctctggccaccgcgcactcggagctgcccttcgccgccgccgacccctactcgcccgccgcgctgcatggccacctgcaccagggcgccacggagccctggcaccacgcgcacccgcaccacgcgcacccgcatcacccctacgccctgggcggcgccctcggcgcccaggccgccccctacccgcgccccgccgccgtgcacgaagtctacgcgccgcacttcgacccgcgctatgggccgctgctgatgccagccgcctcggggcgcccggcccgcctcgcaaccgccccggcgcccgcgcccggcagtcctccctgcgagctctccggcaaaggcgagccggcgggcgccgcgtgggccgggcccgggggacccttcgcgagcccctcgggggacgtggcccagggtctgggcctcagcgtggactcagctcgtcgttattccctctgtggtgcatccctcctgagctgatctgctgacccagggtttccccttccccttcccttctgaccagccttggaggctcagcatctgtgcctctcactccgtggatgaggacatgggggaaggcagagacttcagacttctcagtgtgttgggaaaaccaaaaaccacaactacagaaattcatctaaaaataagtcctgctgctgaaagagcaaatccaaagactgagttatgtttaatgacttttggccgaatcactggaaatatctgtggtgagattgctgagtcaggtgatgtgatatcataagctttcttggaacgggggaaagaaaatgaaactttttggtgtgaatattttttatgctgatgtgaattattttgttaggtagtgtgattatagcactactactgtcagattttaaattgtatgtgtacttgcatctaagactgtggtagagaagtaaagagaagtcaattccttcttcctcacctctcagcctccagatcccttcctgcccatcccttccctacaatgcccactccagacgcaaagatacacttttttcctttggactgtgaacatggaagcctcagcctgaatgtgagtggcaagtggcttatctggagccacctgcccaagtcttactaaaatgcagctgttgttagacaactgttgaaaactccagaaatacatcacccaaggtggcagttctcagtatttggcagaacaattgcaattgcactgggtatattatatatatatatgtatgcatatatatcatattttttacaaggaacattttatgatgaaagaagaaacccttctctgccttctctcccacgaattctgtccctgtatcctctggatgtaaaaagcaaggagagaccccaactgtctccatggagaagaactaggaatcaccacaaggggaagaaatgtacatgaagtctccattacctcgaatttttttctcagtctcactggttgtgatttggtcactttagtgttgggacaggggaaagggtctgtgcgtgggcaaagctgaaggtgatgaggaagaagagacgaacattaaagatgtctatttacta

SEQ ID NO: 58201 - protein, 1532 aa, Homo sapiens
MGHSKQIRILLLNEMEKLEKTLFRLEQGYELQFRLGPTLQGKAVTVYTNYPFPGETFNREKFRSLDWENPTEREDDSDKYCKLNLQQSGSFQYYFLQGNEKSGGGYIVVDPILRVGADNHVLPLDCVTLQTFLAKCLGPFDEWESRLRVAKESGYNMIHFTPLQTLGLSRSCYSLANQLELNPDFSRPNRKYTWNDVGQLVEKLKKEWNVICITDVVYNHTAANSKWIQEHPECAYNLVNSPHLKPAWVLDRALWRFSCDVAEGKYKEKGIPALIENDHHMNSIRKIIWEDIFPKLKLWEFFQVDVNKAVEQFRRLLTQENRRVTKSDPNQHLTIIQDPEYRRFGCTVDMNIALTTFIPHDKGPAAIEECCNWFHKRMEELNSEKHRLINYHQEQAVNCLLGNVFYERLAGHGPKLGPVTRKHPLVTRYFTFPFEEIDFSMEESMIHLPNKACFLMAHNGWVMGDDPLRNFAEPGSEVYLRRELICWGDSVKLRYGNKPEDCPYLWAHMKKYTEITATYFQGVRLDNCHSTPLHVAEYMLDAARNLQPNLYVVAELFTGSEDLDNVFVTRLGISSLIREAMSAYNSHEEGRLVYRYGGEPVGSFVQPCLRPLMPAIAHALFMDITHDNECPIVHRSAYDALPSTTIVSMACCASGSTRGYDELVPHQISVVSEERFYTKWNPEALPSNTGEVNFQSGIIAARCAISKLHQELGAKGFIQVYVDQVDEDIVAVTRHSPSIHQSVVAVSRTAFRNPKTSFYSKEVPQMCIPGKIEEVVLEARTIERNTKPYRKDENSINGTPDITVEIREHIQLNESKIVKQAGVATKGPNEYIQEIEFENLSPGSVIIFRVSLDPHAQVAVGILRNHLTQFSPHFKSGSLAVDNADPILKIPFASLASRLTLAELNQILYRCESEEKEDGGGCYDIPNWSALKYAGLQGLMSVLAEIRPKNDLGHPFCNNLRSGDWMIDYVSNRLISRSGTIAEVGKWLQAMFFYLKQIPRYLIPCYFDAILIGAYTTLLDTAWKQMSSFVQNGSTFVKHLSLGSVQLCGVGKFPSLPILSPALMDVPYRLNEITKEKEQCCVSLAAGLPHFSSGIFRCWGRDTFIALRGILLITGRYVEARNIILAFAGTLRHGLIPNLLGEGIYARYNCRDAVWWWLQCIQDYCKMVPNGLDILKCPVSRMYPTDDSAPLPAGTLDQPLFEVIQEAMQKHMQGIQFRERNAGPQIDRNMKDEGFNITAGVDEETGFVYGGNRFNCGTWMDKMGESDRARNRGIPATPRDGSAVEIVGLSKSAVRWLLELSKKNIFPYHEVTVKRHGKAIKVSYDEWNRKIQDNFEKLFHVSEDPSDLNEKHPNLVHKRGIYKDSYGASSPWCDYQLRPNFTIAMVVAPELFTTEKAGKALEIAEKKLLGPLGMKTLDPDDMVYCGIYDNALDNDNYNLAKGFNYHQGPEWLWPIGYFLRAKLYFSRLMGPETTAKTIVLVKNVLSRHYVHLERSPWKGLPELTNENAQYCPFSCETQAWSIATILETLYDL

SEQ ID NO: 58202 - protein, 1532 aa, Homo sapiens; identical to SEQ ID NO: 58201

SEQ ID NO: 58203 - protein, 1532 aa, Homo sapiens; identical to SEQ ID NO: 58201

SEQ ID NO: 58204 - protein, 1532 aa, Homo sapiens; identical to SEQ ID NO: 58201

SEQ ID NO: 58205 - protein, 1515 aa, Homo sapiens
MSLLTCAFYLGYELQFRLGPTLQGKAVTVYTNYPFPGETFNREKFRSLDWENPTEREDDSDKYCKLNLQQSGSFQYYFLQGNEKSGGGYIVVDPILRVGADNHVLPLDCVTLQTFLAKCLGPFDEWESRLRVAKESGYNMIHFTPLQTLGLSRSCYSLANQLELNPDFSRPNRKYTWNDVGQLVEKLKKEWNVICITDVVYNHTAANSKWIQEHPECAYNLVNSPHLKPAWVLDRALWRFSCDVAEGKYKEKGIPALIENDHHMNSIRKIIWEDIFPKLKLWEFFQVDVNKAVEQFRRLLTQENRRVTKSDPNQHLTIIQDPEYRRFGCTVDMNIALTTFIPHDKGPAAIEECCNWFHKRMEELNSEKHRLINYHQEQAVNCLLGNVFYERLAGHGPKLGPVTRKHPLVTRYFTFPFEEIDFSMEESMIHLPNKACFLMAHNGWVMGDDPLRNFAEPGSEVYLRRELICWGDSVKLRYGNKPEDCPYLWAHMKKYTEITATYFQGVRLDNCHSTPLHVAEYMLDAARNLQPNLYVVAELFTGSEDLDNVFVTRLGISSLIREAMSAYNSHEEGRLVYRYGGEPVGSFVQPCLRPLMPAIAHALFMDITHDNECPIVHRSAYDALPSTTIVSMACCASGSTRGYDELVPHQISVVSEERFYTKWNPEALPSNTGEVNFQSGIIAARCAISKLHQELGAKGFIQVYVDQVDEDIVAVTRHSPSIHQSVVAVSRTAFRNPKTSFYSKEVPQMCIPGKIEEVVLEARTIERNTKPYRKDENSINGTPDITVEIREHIQLNESKIVKQAGVATKGPNEYIQEIEFENLSPGSVIIFRVSLDPHAQVAVGILRNHLTQFSPHFKSGSLAVDNADPILKIPFASLASRLTLAELNQILYRCESEEKEDGGGCYDIPNWSALKYAGLQGLMSVLAEIRPKNDLGHPFCNNLRSGDWMIDYVSNRLISRSGTIAEVGKWLQAMFFYLKQIPRYLIPCYFDAILIGAYTTLLDTAWKQMSSFVQNGSTFVKHLSLGSVQLCGVGKFPSLPILSPALMDVPYRLNEITKEKEQCCVSLAAGLPHFSSGIFRCWGRDTFIALRGILLITGRYVEARNIILAFAGTLRHGLIPNLLGEGIYARYNCRDAVWWWLQCIQDYCKMVPNGLDILKCPVSRMYPTDDSAPLPAGTLDQPLFEVIQEAMQKHMQGIQFRERNAGPQIDRNMKDEGFNITAGVDEETGFVYGGNRFNCGTWMDKMGESDRARNRGIPATPRDGSAVEIVGLSKSAVRWLLELSKKNIFPYHEVTVKRHGKAIKVSYDEWNRKIQDNFEKLFHVSEDPSDLNEKHPNLVHKRGIYKDSYGASSPWCDYQLRPNFTIAMVVAPELFTTEKAGKALEIAEKKLLGPLGMKTLDPDDMVYCGIYDNALDNDNYNLAKGFNYHQGPEWLWPIGYFLRAKLYFSRLMGPETTAKTIVLVKNVLSRHYVHLERSPWKGLPELTNENAQYCPFSCETQAWSIATILETLYDL

SEQ ID NO: 58206 - protein, 1516 aa, Homo sapiens
MAPLLSINLFIGYELQFRLGPTLQGKAVTVYTNYPFPGETFNREKFRSLDWENPTEREDDSDKYCKLNLQQSGSFQYYFLQGNEKSGGGYIVVDPILRVGADNHVLPLDCVTLQTFLAKCLGPFDEWESRLRVAKESGYNMIHFTPLQTLGLSRSCYSLANQLELNPDFSRPNRKYTWNDVGQLVEKLKKEWNVICITDVVYNHTAANSKWIQEHPECAYNLVNSPHLKPAWVLDRALWRFSCDVAEGKYKEKGIPALIENDHHMNSIRKIIWEDIFPKLKLWEFFQVDVNKAVEQFRRLLTQENRRVTKSDPNQHLTIIQDPEYRRFGCTVDMNIALTTFIPHDKGPAAIEECCNWFHKRMEELNSEKHRLINYHQEQAVNCLLGNVFYERLAGHGPKLGPVTRKHPLVTRYFTFPFEEIDFSMEESMIHLPNKACFLMAHNGWVMGDDPLRNFAEPGSEVYLRRELICWGDSVKLRYGNKPEDCPYLWAHMKKYTEITATYFQGVRLDNCHSTPLHVAEYMLDAARNLQPNLYVVAELFTGSEDLDNVFVTRLGISSLIREAMSAYNSHEEGRLVYRYGGEPVGSFVQPCLRPLMPAIAHALFMDITHDNECPIVHRSAYDALPSTTIVSMACCASGSTRGYDELVPHQISVVSEERFYTKWNPEALPSNTGEVNFQSGIIAARCAISKLHQELGAKGFIQVYVDQVDEDIVAVTRHSPSIHQSVVAVSRTAFRNPKTSFYSKEVPQMCIPGKIEEVVLEARTIERNTKPYRKDENSINGTPDITVEIREHIQLNESKIVKQAGVATKGPNEYIQEIEFENLSPGSVIIFRVSLDPHAQVAVGILRNHLTQFSPHFKSGSLAVDNADPILKIPFASLASRLTLAELNQILYRCESEEKEDGGGCYDIPNWSALKYAGLQGLMSVLAEIRPKNDLGHPFCNNLRSGDWMIDYVSNRLISRSGTIAEVGKWLQAMFFYLKQIPRYLIPCYFDAILIGAYTTLLDTAWKQMSSFVQNGSTFVKHLSLGSVQLCGVGKFPSLPILSPALMDVPYRLNEITKEKEQCCVSLAAGLPHFSSGIFRCWGRDTFIALRGILLITGRYVEARNIILAFAGTLRHGLIPNLLGEGIYARYNCRDAVWWWLQCIQDYCKMVPNGLDILKCPVSRMYPTDDSAPLPAGTLDQPLFEVIQEAMQKHMQGIQFRERNAGPQIDRNMKDEGFNITAGVDEETGFVYGGNRFNCGTWMDKMGESDRARNRGIPATPRDGSAVEIVGLSKSAVRWLLELSKKNIFPYHEVTVKRHGKAIKVSYDEWNRKIQDNFEKLFHVSEDPSDLNEKHPNLVHKRGIYKDSYGASSPWCDYQLRPNFTIAMVVAPELFTTEKAGKALEIAEKKLLGPLGMKTLDPDDMVYCGIYDNALDNDNYNLAKGFNYHQGPEWLWPIGYFLRAKLYFSRLMGPETTAKTIVLVKNVLSRHYVHLERSPWKGLPELTNENAQYCPFSCETQAWSIATILETLYDL

SEQ ID NO: 58207 - protein, 747 aa, Homo sapiens
MPLFKLPAEEKQIDDAMRNFAEKVFASEVKDEGGRQEISPFDVDEICPISHHEMQAHIFHLETLSTSTEARRKKRFQGRKTVNLSIPLSETSSTKLSHIDEYISSSPTYQTVPDFQRVQITGDYASGVTVEDFEIVCKGLYRALCIREKYMQKSFQRFPKTPSKYLRNIDGEAWVANESFYPVFTPPVKKGEDPFRTDNLPENLGYHLKMKDGVVYVYPNEAAVSKDEPKPLPYPNLDTFLDDMNFLLALIAQGPVKTYTHRRLKFLSSKFQVHQMLNEMDELKELKNNPHRDFYNCRKVDTHIHAAACMNQKHLLRFIKKSYQIDADRVVYSTKEKNLTLKELFAKLKMHPYDLTVDSLDVHAGRQTFQRFDKFNDKYNPVGASELRDLYLKTDNYINGEYFATIIKEVGADLVEAKYQHAEPRLSIYGRSPDEWSKLSSWFVCNRIHCPNMTWMIQVPRIYDVFRSKNFLPHFGKMLENIFMPVFEATINPQADPELSVFLKHITGFDSVDDESKHSGHMFSSKSPKPQEWTLEKNPSYTYYAYYMYANIMVLNSLRKERGMNTFLFRPHCGEAGALTHLMTAFMIADDISHGLNLKKSPVLQYLFFLAQIPIAMSPLSNNSLFLEYAKNPFLDFLQKGLMISLSTDDPMQFHFTKEPLMEEYAIAAQVFKLSTCDMCEVARNSVLQCGISHEEKVKFLGDNYLEEGPAGNDIRRTNVAQIRMAYRYETWCYELNLIAEGLKSTE

SEQ ID NO: 58208 - protein, 305 aa, Homo sapiens
MDFISIQQLVSGERVEGKVLGFGHGVPDPGAWPSDWRRGPQEAVAREKLKLEEEKKKKLERFNSTRFNLDNLADLENLVQRRKKRLRHRVPPRKPEPLVKPQSQAQVEPVGLEMFLKAAAENQEYLIDKYLTDGGDPNAHDKLHRTALHWACLKGHSQLVNKLLVAGATVDARDLLDRTPVFWACRGGHLVILKQLLNQGARVNARDKIGSTPLHVAVRTRHPDCLEHLIECGAHLNAQDKEGDTALHEAVRHGSYKAMKLLLLYGAELGVRNAASVTPVQLARDWQRGIREALQAHVAHPRTRC

SEQ ID NO: 58209 - protein, 224 aa, Homo sapiens
MAQKEEAAVATEAASQNGEDLENLDDPEKLKELIELPPFEIVTGERLPANFFKFQFRNVEYSSGRNKTFLCYVVEAQGKGGQVQASRGYLEDEHAAAHAEEAFFNTILPAFDPALRYNVTWYVSSSPCAACADRIIKTLSKTKNLRLLILVGRLFMWEEPEIQAALKKLKEAGCKLRIMKPQDFEYVWQNFVEQEEGESKAFQPWEDIQENFLYYEEKLADILK

SEQ ID NO: 58210 - protein, 309 aa, Homo sapiens
MNLMDITKIFSLLQPDKEEEDTDTEEKQALNQAVYDNDSYTLDQLLRQERYKRFINSRSGWGVPGTPLRLAASYGHLSCLQVLLAHGADVDSLDVKAQTPLFTAVSHGHLDCVRVLLEAGASPGGSIYNNCSPVLTAARDGAVAILQELLDHGAEANVKAKLPVWASNIASCSGPLYLAAVYGHLDCFRLLLLHGADPDYNCTDQGLLARVPRPRTLLEICLHHNCEPEYIQLLIDFGANIYLPSLSLDLTSQDDKGIALLLQARATPRSLLSQVRLVVRRALCQAGQPQAINQLDIPPMLISYLKHQL

SEQ ID NO: 58211 - protein, 117 aa, Homo sapiens
MPSCSCALMAPCGPAAGPAAVERTQQVARGEPGSARGQLQVSPEMSITHKEKENAHLKEILLFVNAEAFSQPQPHSAPVCEGQQLTGKFSTSVLTRAGGDASPCSWERLLCYGWSHC

SEQ ID NO: 58212 - protein, 206 aa, Homo sapiens
MGLLFWEDGVDHKLQALETQFKELDFTKDNLMQKFEHHSKALASQAAQDEMWTAVRALQLTSMELNILYSYVIEVLICLHTRVLEKLPDLVRGLPTLASVLRRKVKNKRVRVVWESILEECGLQEGDITALCTFFIARGNKAEHYTAKVRQMYIRDVTFLITNMVKNQALQDSLLRAVQVIEKGKAVRTPEKQKSSLEELIPSVKN

SEQ ID NO: 58213 - protein, 214 aa, Homo sapiens
MNNETTTLISLKEAMKRVDHKLQALETQFKELDFTKDNLMQKFEHHSKALASQAAQDEMWTAVRALQLTSMELNILYSYVIEVLICLHTRVLEKLPDLVRGLPTLASVLRRKVKNKRVRVVWESILEECGLQEGDITALCTFFIARGNKAEHYTAKVRQMYIRDVTFLITNMVKNQALQDSLLRAVQVIEKGKAVRTPEKQKSSLEELIPSVKN

SEQ ID NO: 58214 - protein, 206 aa, Homo sapiens; identical to SEQ ID NO: 58212

SEQ ID NO: 58215 - protein, 214 aa, Homo sapiens; identical to SEQ ID NO: 58213

SEQ ID NO: 58216 - protein, 205 aa, Homo sapiens
MSAQRLISNRTSQQSASNSDYTWEYEYYEIGPVSFEGLKAHKYSIVIGFWVGLAVFVIFMFIVLTLLTKTGAPHQDNAESSEKRFRMNSFVSDFGRPLEPDKVFSRQGNEESRSLFHCYINEVERLDRAKACHQTTALDSDVQLQEAIRSSGQPEEELNRLMKFDIPNFVNTDQNYFGEDDLLISEPPIVLETKPLSQTSHKDLD

SEQ ID NO: 58217 - protein, 81 aa, Homo sapiens
MASVPSIGCLLARNQYYRKSSVSSVSSLTSSDSVNFIDDDKPQQGLPEVAESTWWFKSFFHSEPVLSNVRIKDLSATGMNS

SEQ ID NO: 58218 - protein, 1873 aa, Homo sapiens
MEPSSPQDEGLRKKQPKKPVPEILPRPPRALFCLTLENPLRKACISIVEWKPFETIILLTIFANCVALAVYLPMPEDDNNSLNLGLEKLEYFFLIVFSIEAAMKIIAYGFLFHQDAYLRSGWNVLDFTIVFLGVFTVILEQVNVIQSHTAPMSSKGAGLDVKALRAFRVLRPLRLVSGVPSLQVVLNSIFKAMLPLFHIALLVLFMVIIYAIIGLELFKGKMHKTCYFIGTDIVATVENEEPSPCARTGSGRRCTINGSECRGGCPGPNHGITHFDNFGFSMLTVYQCITMEGWTDVLYWVNDAIGNEWPWIYFVTLILLGSFFILNLVLGVLSGEFTKEREKAKSRGTFQKLREKQQLDEDLRGYMSWITQGEVMDVEDFREGKLSLDEGGSDTESLYEIAGLNKIIQFIRHWRQWNRIFRWKCHDIVKSKVFYWLVILIVALNTLSIASEHHNQPHWLTRLQDIANRVLLSLFTTEMLMKMYGLGLRQYFMSIFNRFDCFVVCSGILEILLVESGAMTPLGISVLRCIRLLRIFKITKYWTSLSNLVASLLNSIRSIASLLLLLFLFIVIFRLLGMQLFGGRYDFEDTEVRRSNFDNFPQALISVFQVLTGEDWTSMMYNGIMASSGPSYPGMLVCIYFIILFVCGNYILLNVFLAIAVDNLAEAESLTSAQKAKAEEKKRRKMSKGLPDKSEEEKSTMAKKLEQKPKGEGIPTTAKLKIDEFESNVNEVKDPYPSADFPGDDEEDEPEIPLSPRPRPLAELQLKEKAVPIPEASSFFIFSPTNKIRVLCHRIVNATWFTNFILLFILLSSAALAAEDPIRADSMRNQILKHFDIGFTSVFTVEIVLKMTTYGAFLHKGSFCRNYFNMLDLLVVAVSLISMGLESSAISVVKILRVLRVLRPLRAINRAKGLKHVARCMFVAISTIGNIVLVTTLLQFMFACIGVQLFKGKFFRCTDLSKMTEEECRGYYYVYKDGDPMQIELRHREWVHSDFHFDNVLSAMMSLFTVSTFEGWPQLLYKAIDSNAEDVGPIYNNRVEMAIFFIIYIILIAFFMMNIFVGFVIVTFQEQGETEYKNCELDKNQRQCVQYALKARPLRCYIPKNPYQYQVWYIVTSSYFEYLMFALIMLNTICLGMQHYNQSEQMNHISDILNVAFTIIFTLEMILKLMAFKARGYFGNPWNVFDFLIVIGSIIDVILSEIDTFLASSGGLYCLGGGCGNVDPDESARISSAFFRLFRVMRLIKLLSRAEGVRTLLWTFIKSFQALPYVALLIVMLFFIYAVIGMQMFGKIALVDGTQINRNNNFQTFPQAVLLLFRCATGEAWQEILLACSYGKLCDPESDYAPGEEYTCGTNFAYYYFISFYMLCAFLVINLFVAVIMDNFDYLTRDWSILGPHHLDEFKAIWAEYDPEAKGRIKHLDVVTLLRRIQPPLGFGKFCPHRVACKRLVGMNMPLNSDGTVTFNATLFALVRTALKIKTEGNFEQANEELRAIIKKIWKRTSMKLLDQVIPPIGDDEVTVGKFYATFLIQEHFRKFMKRQEEYYGYRPKKDIVQIQAGLRTIEEEAAPEICRTVSGDLAAEEELERAMVEAAMEEGIFRRTGGLFGQVDNFLERTNSLPPVMANQRPLQFAEIEMEEMESPVFLEDFPQDPRTNPLARANTNNANANVAYANSNHSNSHVFSSVHYEREFPEETETPATRGRALGQPCRSLGPHSKPCVEMLKGLLTQRAMPRGQAPPAPCQCPRVESSMPEDRKSSTPGSLHEETPHSRSTRENTSRCSAPATALLIQKALVRGGLGTLAADANFIMATGQALGDACQMEPEEVEIMATELLKGREAPDGMASSLGCLNLGSSLGSLDQHQGSQETLIPPRL

SEQ ID NO: 58219 - protein, 523 aa, Homo sapiens
MVQKTSMSRGPYPPSQEIPMEVFDPSPQGKYSKRKGRFKRSDGSTSSDTTSNSFVRQGSAESYTSRPSDSDVSLEEDREALRKEAERQALAQLEKAKTKPVAFAVRTNVGYNPSPGDEVPVQGVAITFEPKDFLHIKEKYNNDWWIGRLVKEGCEVGFIPSPVKLDSLRLLQEQKLRQNRLGSSKSGDNSSSSLGDVVTGTRRPTPPASGNEMTNLAFELDPLELEEEEAELGEQSGSAKTSVSSVTTPPPHGKRIPFFKKTEHVPPYDVVPSMRPIILVGPSLKGYEVTDMMQKALFDFLKHRFDGRISITRVTADISLAKRSVLNNPSKHIIIERSNTRSSLAEVQSEIERIFELARTLQLVALDADTINHPAQLSKTSLAPIIVYIKITSPKVLQRLIKSRGKSQSKHLNVQIAASEKLAQCPPEMFDIILDENQLEDACEHLAEYLEAYWKATHPPSSTPPNPLLNRTMATAALAASPAPVSNLQVQVLTSLRRNLGFWGGLESSQRGSVVPQEQEHAM

SEQ ID NO: 58220 - protein, 478 aa, Homo sapiens
MVQKTSMSRGPYPPSQEIPMEVFDPSPQGKYSKRKGRFKRSDGSTSSDTTSNSFVRQGSAESYTSRPSDSDVSLEEDREALRKEAERQALAQLEKAKTKPVAFAVRTNVGYNPSPGDEVPVQGVAITFEPKDFLHIKEKYNNDWWIGRLVKEGCEVGFIPSPVKLDSLRLLQEQKLRQNRLGSSKSGDNSSSSLGDVVTGTRRPTPPASAKQKQKSTEHVPPYDVVPSMRPIILVGPSLKGYEVTDMMQKALFDFLKHRFDGRISITRVTADISLAKRSVLNNPSKHIIIERSNTRSSLAEVQSEIERIFELARTLQLVALDADTINHPAQLSKTSLAPIIVYIKITSPKVLQRLIKSRGKSQSKHLNVQIAASEKLAQCPPEMFDIILDENQLEDACEHLAEYLEAYWKATHPPSSTPPNPLLNRTMATAALAASPAPVSNLQVQVLTSLRRNLGFWGGLESSQRGSVVPQEQEHAM

SEQ ID NO: 58221 - protein, 222 aa, Homo sapiens
MSQTKMLKVRVTLFCILAGIVLAMTAVVTDHWAVLSPHMEHHNTTCEAAHFGLWRICTKRIPMDDSKTCGPITLPGEKNCSYFRHFNPGESSEIFEFTTQKEYSISAAAIAIFSLGFIILGSLCVLLSLGKKRDYLLRPASMFYAFAGLCILVSVEVMRQSVKRMIDSEDTVWIEYYYSWSFACACAAFILLFLGGLALLLFSLPRMPRNPWESCMDAEPEH

SEQ ID NO: 58222 - protein, 189 aa, Homo sapiens
MMWSNFFLQEENRRRGAAGRRRAHGQGRSGLTPEREGKVKLALLLAAVGATLAVLSVGTEFWVELNTYKANGSAVCEAAHLGLWKACTKRLWQADVPVDRDTCGPAELPGGLLLLVSLEVFRHSVRALLQRVSPEPPPAPRLTYEYSWSLGCGVGAGLILLLGAGCFLLLTLPSWPWGSLCPKRGHRAT

SEQ ID NO: 58223 - protein, 260 aa, Homo sapiens
MMWSNFFLQEENRRRGAAGRRRAHGQGRSGLTPEREGKVKLALLLAAVGATLAVLSVGTEFWVELNTYKANGSAVCEAAHLGLWKACTKRLWQADVPVDRDTCGPAELPGEANCTYFKFFTTGENARIFQRTTKKEVNLAAAVIAVLGLAVMALGCLCIIMVLSKGAEFLLRVGAVCFGLSGLLLLVSLEVFRHSVRALLQRVSPEPPPAPRLTYEYSWSLGCGVGAGLILLLGAGCFLLLTLPSWPWGSLCPKRGHRAT

SEQ ID NO: 58224 - protein, 214 aa, Homo sapiens
MMWSNFFLQEENRRRGAAGRRRAHGQGRSGLTPEREGKVKLALLLAAVGATLAVLSVGTEFWVELNTYKANGSAVCEAAHLGLWKACTKRLWQADVPVDRDTCGPAELPGEANCTYFKFFTTGENARIFQRTTKKGLLLLVSLEVFRHSVRALLQRVSPEPPPAPRLTYEYSWSLGCGVGAGLILLLGAGCFLLLTLPSWPWGSLCPKRGHRAT

SEQ ID NO: 58225 - protein, 181 aa, Homo sapiens
MGLQQEISLQPWCHHPAESCQTTTDMTERLSAEQIKEYKGVFEMFDEEGNGEVKTGELEWLMSLLGINPTKSELASMAKDVDRDNKGFFNCDGFLALMGVYHEKAQNQESELRAAFRVFDKEGKGYIDWNTLKYVLMNAGEPLNEVEAEQMMKEADKDGDRTIDYEEFVAMMTGESFKLIQ

SEQ ID NO: 58226 - protein, 390 aa, Homo sapiens
MGPRAVPGLRLALLLLLVLGTPKSGVQGQEGLDFPEYDGVDRVINVNAKNYKNVFKKYEVLALLYHEPPEDDKASQRQFEMEELILELAAQVLEDKGVGFGLVDSEKDAAVAKKLGLTEVDSMYVFKGDEVIEYDGEFSADTIVEFLLDVLEDPVELIEGERELQAFENIEDEIKLIGYFKSKDSEHYKAFEDAAEEFHPYIPFFATFDSKVAKKLTLKLNEIDFYEAFMEEPVTIPDKPNSEEEIVNFVEEHRRSTLRKLKPESMYETWEDDMDGIHIVAFAEEADPDGFEFLETLKAVAQDNTENPDLSIIWIDPDDFPLLVPYWEKTFDIDLSAPQIGVVNVTDADSVWMEMDDEEDLPSAEELEDWLEDVLEGEINTEDDDDDDDD

SEQ ID NO: 58227 - protein, 457 aa, Homo sapiens
MEPWPLLLLFSLCSAGLVLGSEHETRLVAKLFKDYSSVVRPVEDHRQVVEVTVGLQLIQLINVDEVNQIVTTNVRLKQQWVDYNLKWNPDDYGGVKKIHIPSEKIWRPDLVLYNNADGDFAIVKFTKVLLQYTGHITWTPPAIFKSYCEIIVTHFPFDEQNCSMKLGTWTYDGSVVAINPESDQPDLSNFMESGEWVIKESRGWKHSVTYSCCPDTPYLDITYHFVMQRLPLYFIVNVIIPCLLFSFLTGLVFYLPTDSGEKMTLSISVLLSLTVFLLVIVELIPSTSSAVPLIGKYMLFTMVFVIASIIITVIVINTHHRSPSTHVMPNWVRKVFIDTIPNIMFFSTMKRPSREKQDKKIFTEDIDISDISGKPGPPPMGFHSPLIKHPEVKSAIEGIKYIAETMKSDQESNNAAAEWKYVAMVMDHILLGVFMLVCIIGTLAVFAGRLIELNQQG

SEQ ID NO: 58228 - protein, 482 aa, Homo sapiens
MEPWPLLLLFSLCSAGLVLGSEHETRLVAKLFKDYSSVVRPVEDHRQVVEVTVGLQLIQLINVDEVNQIVTTNVRLKQGDMVDLPRPSCVTLGVPLFSHLQNEQWVDYNLKWNPDDYGGVKKIHIPSEKIWRPDLVLYNNADGDFAIVKFTKVLLQYTGHITWTPPAIFKSYCEIIVTHFPFDEQNCSMKLGTWTYDGSVVAINPESDQPDLSNFMESGEWVIKESRGWKHSVTYSCCPDTPYLDITYHFVMQRLPLYFIVNVIIPCLLFSFLTGLVFYLPTDSGEKMTLSISVLLSLTVFLLVIVELIPSTSSAVPLIGKYMLFTMVFVIASIIITVIVINTHHRSPSTHVMPNWVRKVFIDTIPNIMFFSTMKRPSREKQDKKIFTEDIDISDISGKPGPPPMGFHSPLIKHPEVKSAIEGIKYIAETMKSDQESNNAAAEWKYVAMVMDHILLGVFMLVCIIGTLAVFAGRLIELNQQG

SEQ ID NO: 58229 - protein, 988 aa, Homo sapiens
MEQSRSQQRGGEQSWWGSDPQYQYMPFEHCTSYGLPSENGGLQHRLRKDAGPRHNVHPTQIYGHHKEQFSDREQDIGMPKKTGSSSTVDSKDEDHYSKCQDCIHRLGQVVRRKLGEDWIFLVLLGLLMALVSWSMDYVSAKSLQAYKWSYAQMQPSLPLQFLVWVTFPLVLILFSALFCHLISPQAVGSGIPEMKTILRGVVLKEYLTMKAFVAKVVALTAGLGSGIPVGKEGPFVHIASICAAVLSKFMSVFCGVYEQPYYYSDILTVGCAVGVGCCFGTPLGGVLFSIEVTSTYFAVRNYWRGFFAATFSAFVFRVLAVWNKDAVTITALFRTNFRMDFPFDLKELPAFAAIGICCGLLGAVFVYLHRQVMLGVRKHKALSQFLAKHRLLYPGIVTFVIASFTFPPGMGQFMAGELMPREAISTLFDNNTWVKHAGDPESLGQSAVWIHPRVNVVIIIFLFFVMKFWMSIVATTMPIPCGGFMPVFVLGAAFGRLVGEIMAMLFPDGILFDDIIYKILPGGYAVIGAAALTGAVSHTVSTAVICFELTGQIAHILPMMVAVILANMVAQSLQPSLYDSIIQVKKLPYLPDLGWNQLSKYTIFVEDIMVRDVKFVSASYTYGELRTLLQTTTVKTLPLVDSKDSMILLGSVERSELQALLQRHLCPERRLRAAQEMARKLSELPYDGKARLAGEGPPGAPPGRPESFAFVDEDEDEDLSGKSELPPSLALHPSTTAPLSPEEPNGPLPGHKQQPEAPEPAGQRPSIFQSLLHCLLGRARPTKKKTTQDSTDLVDNMSPEEIEAWEQEQLSQPVCFDSCCIDQSPFQLVEQTTLHKTHTLFSLLGLHLAYVTSMGKLRGVLALEELQKAIEGHTKSGVQLRPPLASFRNTTSTRKSTGAPPSSAENWNLPEDRPGATGTGDVIAASPETPVPSPSPEPPLSLAPGKVEGELEELELVESPGLEEELADILQGPSLRSTDEEDEDELIL

SEQ ID NO: 58230 - protein, 500 aa, Homo sapiens
MKCTAREWLRVTTVLFMARAIPAMVVPNATLLEKLLEKYMDEDGEWWIAKQRGKRAITDNDMQSILDLHNKLRSQVYPTASNMEYMTWDVELERSAESWAESCLWEHGPASLLPSIGQNLGAHWGRYRPPTFHVQSWYDEVKDFSYPYEHECNPYCPFRCSGPVCTHYTQVVWATSNRIGCAINLCHNMNIWGQIWPKAVYLVCNYSPKGNWWGHAPYKHGRPCSACPPSFGGGCRENLCYKEGSDRYYPPREEETNEIERQQSQVHDTHVRTRSDDSSRNEVISAQQMSQIVSCEVRLRDQCKGTTCNRYECPAGCLDSKAKVIGSVHYEMQSSICRAAIHYGIIDNDGGWVDITRQGRKHYFIKSNRNGIQTIGKYQSANSFTVSKVTVQAVTCETTVEQLCPFHKPASHCPRVYCPRNCMQANPHYARVIGTRVYSDLSSICRAAVHAGVVRNHGGYVDVMPVDKRKTYIASFQNGIFSESLQNPPGGKAFRVFAVV

SEQ ID NO: 58231 - protein, 308 aa, Homo sapiens
MAMLMLPLLLLGISGLLFIYQEVSRLWSKSAVQNKVVVITDAISGLGKECARVFHTGGARLVLCGKNWERLENLYDALISVADPSKTFTPKLVLLDLSDISCVPDVAKEVLDCYGCVDILINNASVKVKGPAHKISLELDKKIMDANYFGPITLTKALLPNMISRRTGQIVLVNNIQGKFGIPFRTTYAASKHAALGFFDCLRAEVEEYDVVISTVSPTFIRSYHVYPEQGNWEASIWKFFFRKLTYGVHPVEVAEEVMRTVRRKKQEVFMANPIPKAAVYVRTFFPEFFFAVVACGVKEKLNVPEEG

SEQ ID NO: 58232 - protein, 308 aa, Homo sapiens; identical to SEQ ID NO: 58231

SEQ ID NO: 58233 - protein, 220 aa, Homo sapiens
MTSGEVKTSLKNAYSSAKRLSPKMEEEGEEEDYCTPGAFELERLFWKGSPQYTHVNEVWPKLYIGDEATALDRYRLQKAGFTHVLNAAHGRWNVDTGPDYYRDMDIQYHGVEADDLPTFDLSVFFYPAAAFIDRALSDDHSKILVHCVMGRSRSATLVLAYLMIHKDMTLVDAIQQVAKNRCVLPNRGFLKQLRELDKQLVQQRRRSQRQDGEEEDGREL

SEQ ID NO: 58234 - protein, 154 aa, Homo sapiens
MPSRTARYARYSPRQRRRRMLADRSVRFPNDVLFLDHIRQGDLEQVGRFIRTRKVSLATIHPSGLAALHEAVLSGNLECVKLLVKYGADIHQRDEAGWTPLHIACSDGYPDIARYLISLGADRDATNDDGDLPSDLIDPDYKELVELFKGTTMD

SEQ ID NO: 58235 - protein, 339 aa, Homo sapiens
MTDRSPFETDMLTLTRYVMEKGRQAKGTGELTQLLNSMLTAIKAISSAVRKAGLAHLYGIAGSVNVTGDEVKKLDVLSNSLVINMVQSSYSTCVLVSEENKDAIITAKEKRGKYVVCFDPLDGSSNIDCLASIGTIFAIYRKTSEDEPSEKDALQCGRNIVAAGYALYGSATLVALSTGQGVDLFMLDPALGEFVLVEKDVKIKKKGKIYSLNEGYAKYFDAATTEYVQKKKFPEDGSAPYGARYVGSMVADVHRTLVYGGIFLYPANQKSPKGKLRLLYECNPVAYIIEQAGGLATTGTQPVLDVKPEAIHQRVPLILGSPEDVQEYLTCVQKNQAGS

SEQ ID NO: 58236 - protein, 280 aa, Homo sapiens
MSESFDCAKCNESLYGRKYIQTDSGPYCVPCYDNTFANTCAECQQLIGHDSRELFYEDRHFHEGCFRCCRCQRSLADEPFTCQDSELLCNDCYCSAFSSQCSACGETVMPGSRKLEYGGQTWHEHCFLCSGCEQPLGSRSFVPDKGAHYCVPCYENKFAPRCARCSKTLTQGGVTYRDQPWHRECLVCTGCQTPLAGQQFTSRDEDPYCVACFGELFAPKCSSCKRPIVGLGGGKYVSFEDRHWHHNCFSCARCSTSLVGQGFVPDGDQVLCQGCSQAGP

SEQ ID NO: 58237 - protein, 317 aa, Homo sapiens
MRKTSNSCIMENGHQPGTGPGDGPPEIAQNFSAPDPPRPRPVSLSLRLPHQPVTAITRVSDRFSGETSAAALSPMSAATLGGLNPSPSEVITPWTPSPSEKNSSFTWSVPSSGYGAVTASKHSNSPPLVTPPQSPVSPQPPAITQVHRQGERRRELVRSQTLPRTSEAQARKALFEKWEQETAAGKGKGEARARLKRSQSFGVASASSIKQILLEWCRSKTLGYQHVDLQNFSSSWSDGMAFCALVHSFFPDAFDYNSLSPTQRQKNFELAFTMAENLANCERLIEVEDMMVMGRKPDPMCVFTYVQSLYNHLRRFE

SEQ ID NO: 58238 - protein, 337 aa, Homo sapiens
MYAMNLARYKYCPDIKEKGLSGSPRLILFTSAECHYSMKKAASFLGIGTENVCFVETDGRGKMIPEELEKQVWQARKEGAAPFLVCATSGTTVLGAFDPLDEIADICERHSLWLHVDASWGGSALMSRKHRKLLHGIHRADSVAWNPHKMLMAGIQCCALLVKDKSDLLKKCYSAKASYLFQQDKFYDVSYDTGDKSIQCSRRPDAFKFWMTWKALGTLGLEERVNRALALSRYLVDEIKKREGFKLLMEPEYANICFWYIPPSLREMEEGPEFWAKLNLVAPAIKERMMKKGSLMLGYQPHRGKVNFFRQVVISPQVSREDMDFLLDEIDLLGKDM

SEQ ID NO: 58239 - protein, 342 aa, Homo sapiens
MTCPRNVTPNSYAEPLAAPGGGERYSRSAGMYMQSGSDFNCGVMRGCGLAPSLSKRDEGSSPSLALNTYPSYLSQLDSWGDPKAAYRLEQPVGRPLSSCSYPPSVKEENVCCMYSAEKRAKSGPEAALYSHPLPESCLGEHEVPVPSYYRASPSYSALDKTPHCSGANDFEAPFEQRASLNPRAEHLESPQLGGKVSFPETPKSDSQTPSPNEIKTEQSLAGPKGSPSESEKERAKAADSSPDTSDNEAKEEIKAENTTGNWLTAKSGRKKRCPYTKHQTLELEKEFLFNMYLTRERRLEISKTINLTDRQVKIWFQNRRMKLKKMNRENRIRELTSNFNFT

SEQ ID NO: 58240 - protein, 227 aa, Homo sapiens
MSDINLDWVDRRQLQRLEEMLIVVDENDKVIGADTKRNCHLNENIEKGLLHRAFSVVLFNTKNRILIQQRSDTKVTFPGYFTDSCSSHPLYNPAELEEKDAIGVRRAAQRRLQAELGIPGEQISPEDIVFMTIYHHKAKSDRIWGEHEICYLLLVRKNVTLNPDPSETKSILYLSQEELWELLEREARGEVKVTPWLRTIAERFLYRWWPHLDDVTPFVELHKIHRV

SEQ ID NO: 58241 - protein, 661 aa, Homo sapiens
MTGGRFDFDDGGTYCGGWEEGKAHGHGICTGPKGQGEYSGSWSHGFEVVGGYTWPSGNTYQGYWAQGKRHGLGVETKGKWMYRGEWSHGFKGRYGVRQSLCTPARYEGTWSNGLQDGYGVETYGDGGTYQGQWAGGMRHGYGVRQSVPYGMATVIRSPLRTSLASLRSEQSNGSVLHDAAAAADSPAGTRGGFVLNFHADAELAGKKKGGLFRRGSLLGSMKLRKSESKSSISSKRSSVRSDAAMSRISSSDANSTISFGDVDCDFCPVEDHVDATTTETYMGEWKNDKRNGFGVSERSNGMKYEGEWANNKRHGYGCTVFPDGSKEEGKYKNNILVRGIRKQLIPIRHTKTREKVDRAIEGAQRAAAMARTKVEIANSRTAHARAKADAADQAALAARQECDIARAVARELSPDFYQPGPDYVKQRFQEGVDAKENPEEKVPEKPPTPKESPHFYRKGTTPPRSPEASPKHSHSPASSPKPLKKQNPSSGARLNQDKRSVADEQVTAIVNKPLMSKAPTKEAGAVVPQSKYSGRHHIPNPSNGELHSQYHGYYVKLNAPQHPPVDVEDGDGSSQSSSALVHKPSANKWSPSKSVTKPVAKESKAEPKAKKSELAIPKNPASNDSCPALEKEANSGPNSIMIVLVMLLNIGLAILFVHFLT

SEQ ID NO: 58242 - protein, 606 aa, Homo sapiens
MDSQRELAEELRLYQSTLLQDGLKDLLDEKKFIDCTLKAGDKSLPCHRLILSACSPYFREYFLSEIDEAKKKEVVLDNVDPAILDLIIKYLYSASIDLNDGNVQDIFALASRFQIPSVFTVCVSYLQKRLAPGNCLAILRLGLLLDCPRLAISAREFVSDRFVQICKEEDFMQLSPQELISVISNDSLNVEKEEAVFEAVMKWVRTDKENRVKNLSEVFDCIRFRLMTEKYFKDHVEKDDIIKSNPDLQKKIKVLKDAFAGKLPEPSKNAAKTGAGEVNGDVGDEDLLPGYLNDIPRHGMFVKDLILLVNDTAAVAYDPTENECYLTALAEQIPRNHSSIVTQQNQIYVVGGLYVDEENKDQPLQSYFFQLDSIASEWVGLPPLPSARCLFGLGEVDDKIYVVAGKDLQTEASLDSVLCYDPVAAKWNEVKKLPIKVYGHNVISHKGMIYCLGGKTDDKKCTNRVFIFNPKKGDWKDLAPMKIPRSMFGVAVHKGKIVIAGGVTEDGLSASVEAFDLTTNKWDVMTEFPQERSSISLVSLAGSLYAIGGFAMIQLESKEFAPTEVNDIWKYEDDKKEWAGMLKEIRYASGASCLATRLNLFKLSKL

SEQ ID NO: 58243 - protein, 621 aa, Homo sapiens
MALGLEQAEEQRLYQQTLLQDGLKDMLDHGKFLDCVVRAGEREFPCHRLVLAACSPYFRARFLAEPERAGELHLEEVSPDVVAQVLHYLYTSEIALDEASVQDLFAAAHRFQIPSIFTICVSFLQKRLCLSNCLAVFRLGLLLDCARLAVAARDFICAHFTLVARDADFLGLSADELIAIISSDGLNVEKEEAVFEAVMRWAGSGDAEAQAERQRALPTVFESVRCRLLPRAFLESRVERHPLVRAQPELLRKVQMVKDAHEGRITTLRKKKKGKDGAGAKEADKGTSKAKAEEDEEAERILPGILNDTLRFGMFLQDLIFMISEEGAVAYDPAANECYCASLSNQVPKNHVSLVTKENQVFVAGGLFYNEDNKEDPMSAYFLQFDHLDSEWLGMPPLPSPRCLFGLGEALNSIYVVGGREIKDGERCLDSVMCYDRLSFKWGESDPLPYVVYGHTVLSHMDLVYVIGGKGSDRKCLNKMCVYDPKKFEWKELAPMQTARSLFGATVHDGRIIVAAGVTDTGLTSSAEVYSITDNKWAPFEAFPQERSSLSLVSLVGTLYAIGGFATLETESGELVPTELNDIWRYNEEEKKWEGVLREIAYAAGATFLPVRLNVLCLTKM

SEQ ID NO: 58244 - protein, 198 aa, Homo sapiens
MIEETSFGKSYAQLNFENSMLWMDLPDEEPDRLSNKLLQYDPSQDQWSVRAPMKYSKYRFSTAVVNSEIYVLGGIGCVGQDKGQVRKCLDVVEIYNPDGDFWREGPPMPSPLLSLRTNSTNAGAVDGKLYVCGGFHGADRHEVISKEILELDPWENQWNVVAINVLMHDSYDVCLVARMNPRDLIPPPSDLVEEGNEH

SEQ ID NO: 58245 - protein, 236 aa, Homo sapiens
MDSEAQEDTREAYDDKQVVTEIMARCFIPTLITTTSWESFHFIGHEIRITEAMDCYGAVVWPSALVLCYFLETNAKQYNMVDKNVIEIGAGTGLVSIVASLLGAHVTATDLPELLGNLQYNISRNTKMKSKHLPQVKELSWGVALDTNFPRSSNNFDYILAADVVYAHPFLEELLITFDHLCKETTIILWAMKFRLEKENKFVDRFKELFDLEEISSFPSLNIKLYKAVKKNRRSV

SEQ ID NO: 58246 - protein, 236 aa, Homo sapiens; identical to SEQ ID NO: 58245

SEQ ID NO: 58247 - protein, 142 aa, Homo sapiens
MDTAAKAIILEQSGKNQGYRDADIRSFWPEGGVCLPGSPDVLESGVCMKAVCKRVAVEGVDVIFSRDAGRYVCDYTYYLSLHHGKGCAALIHVPPLSRGLPASLLGRALRVIIQEMLEEVGKPKHRAQFEENSTMVLPAKGN

SEQ ID NO: 58248 - protein, 196 aa, Homo sapiens
MKPRTLVELSKLGLGNETVVQLRTLELPVDYREAKRRVTGIWEDHQPQLVVHVGMDTAAKAIILEQSGKNQGYRDADIRSFWPEGGVCLPGSPDVLESGVCMKAVCKRVAVEGVDVIFSRDAGRYVCDYTYYLSLHHGKGCAALIHVPPLSRGLPASLLGRALRVIIQEMLEEVGKPKHRAQFEENSTMVLPAKGN

SEQ ID NO: 58249 - protein, 196 aa, Homo sapiens
MKLRTLVELSKLGLGNETVVQLRTLELPVDYREAKRRVTGIWEDHQPQLVVHVGMDTAAKAIILEQSGKNQGYRDADIRSFWPEGGVCLPGSPDVLESGVCMKAVCKRVAVEGVDVIFSRDAGRYVCDYTYYLSLHHGKGCAALIHVPPLSRGLPASLLGRALRVIIQEMLEEVGKPKHRAQFEENSTMVLPAKGN

SEQ ID NO: 58250 - protein, 142 aa, Homo sapiens; identical to SEQ ID NO: 58247

SEQ ID NO: 58251 - protein, 303 aa, Homo sapiens
MEPPGGAYLHLGAVTSPVGTARVLQLAFGCTTFSLVAHRGGFAGVQGTFCMAAWGFCFAVSALVVACEFTRLHGCLRLSWGNFTAAFAMLATLLCATAAVLYPLYFARRECSPEPAGCAARDFRLAASVFAGLLFLAYAVEVALTRARPGQVSSYMATVSGLLKIVQAFVACIIFGALVHDSRYGRYVATQWCVAVYSLCFLATVAVVALSVMGHTGGLGCPFDWLVVVYTFLAVLLYLSAAVIWPVFCFDPKYGEPKRPPNCARGSCPWDSQLVVAIFTYVNLLLYVVDLAYSQRIRFVPSL

SEQ ID NO: 58252 - protein, 210 aa, Homo sapiens
MAGIATMEEVKCKIQVLQQQADDAEERAERLQFEEELDHAQERLTTALQKLEEEEKAADESERDMKMELQEIQLKEAKHIAEEADRKYEEVPRKLVIIEGDLECTEERAELAESRCQETDEQIRLMDQNLKCLSDAEEKYSQKEDIYEEEIKILTDKLKEAETRAEFTERLVAKLEKTTDDLEYKLKCNKEENLCTQRMLYQTLLDLNEM

SEQ ID NO: 58253 - protein, 210 aa, Homo sapiens; identical to SEQ ID NO: 58252

SEQ ID NO: 58254 - protein, 210 aa, Homo sapiens; identical to SEQ ID NO: 58252

SEQ ID NO: 58255 - protein, 503 aa, Homo sapiens [sequence omitted]

SEQ ID NO: 58256 - protein, 503 aa, Homo sapiens [sequence omitted]

SEQ ID NO: 58257 - protein, 503 aa, Homo sapiens
MVLGVQLHSQTASRAFAGRRGPRATVPEQTQAAPVSSSPAAFQQRGDPHPRQPHLTVPLRSEETVEDRVAPGAARNQGDLEESGNLASRGDAAPGKGLPPPASELSSARASPPQRGPDPCLAPGARTVPSAKRLRSRKWPPQCTSRQHGVGSGSVSIRLCGAGCERDSPIPLSSRSGTSHPEDFAEDAAPWSGAENRSRPPRSCWVVEKVEGGQVLSATVKIKIIIIKNEWVSNLSSEVLSSLCEATELTGGRTPIETGTSDEGAPSSGWRVGQQQQQPGFREWGEMRAPGAPQVEEAQVWMQVLDSHKGEEPVTHPTTPLKWVKGNPGAGHPAQKKRSKSPTPTHVHKGPLVHQEGETCHQATVAYTDTRAKAHRSRQVSRDWRMRIREAGAGARLSGLSGLASSGRLISRVPLEEKAIRECEVGAGNFSLDSIPERVCVQESGPREKGIQSGELLRDLRVMESYLRPQRRVSVEDCEAFELTASVHPGPPRESCFSARLSG

SEQ ID NO: 58258 - protein, 552 aa, Homo sapiens; identical to SEQ ID NO: 14649

SEQ ID NO: 58259 - protein, 552 aa, Homo sapiens; identical to SEQ ID NO: 14649

SEQ ID NO: 58260 - protein, 1199 aa, Homo sapiens [sequence omitted]

SEQ ID NO: 58261 - protein, 183 aa, Homo sapiens
MAGITTIEAVKRKIQVLQQQADDAEERAERLQREVEGERMELQEIQLREAKHIAEEADRKYEEVARKLVIIEGDLERTEERAELAESLCREMDEQIRLMDQNLKCLSAAEEKYSQKEDKYEEEIKILTDKIKEAETHAEFAERSVAKLEKTIDDLEDKLKCTKGEHLCTQRMLDQTLLDLNEM

SEQ ID NO: 58262 - protein, 144 aa, Homo sapiens [sequence omitted]

SEQ ID NO: 58263 - protein, 71 aa, Homo sapiens
MPEDKNMECSLHNIVCENLQIYFIEQGYKSIYRGEGKRAQWRDALGESCYWPWCHSSSTGRSRSKLRREKM

SEQ ID NO: 58264 - protein, 71 aa, Homo sapiens; identical to SEQ ID NO: 58263

SEQ ID NO: 58265 - protein, 119 aa, Homo sapiens
MALQSTLGAVWLGLLLNSLWKVAESKDQVFQPSTVASSEGAVVEIFCNHSVSNAYNFFWYLHFPGCAPRLLVKGSKPSQQGRYNMTYERFSSSLLILQVREADAAVYYCAVEDTEAGNP

SEQ ID NO: 58266 - protein, 183 aa, Homo sapiens; identical to SEQ ID NO: 58261

SEQ ID NO: 58267 - protein, 144 aa, Homo sapiens [sequence omitted]

SEQ ID NO: 58268 - protein, 303 aa, Homo sapiens [sequence omitted]

SEQ ID NO: 58269 - protein, 40 aa, Homo sapiens [sequence omitted]

SEQ ID NO: 58270 - protein, 376 aa, Homo sapiens
MLDPPRKEVTGSIQLCRDAGIRVIMITGDNKGTAIAICRRIGIFGENEEVADRAYTGREFDDLPLAEQREACRRACCFARVEPSHKSKIVEYLQSYDEITAMTGDGVNDAPALKKAEIGIAMGSGTAVAKTASEMVLADDNFSTIVAAVEEGRAIYNNMKQFIRYLISSNVGEVVCIFLTAALGLPEALIPVQLLWVNLVTDGLPATALGFNPPDLDIMDRPPRSPKEPLISGWLFFRYMAIGGYVGAATVGAAAWWFLYAEDGPHVNYSQLTHFMQCTEDNTHFEGIDCEVFEAPEPMTMALSVLVTIEMCNALNSLSENQSLLRMPPWVNIWLLGSICLSMSLHFLILYVDPLPVRFLPPRAAHPSTGEPTAGP

SEQ ID NO: 58271 - protein, 65 aa, Homo sapiens
MKPAGPHGLVAWTNKLREEMRRRRLQRNATLLGTDHAIWGWPWGQLGPVLHLLNRASTNQRKPIY

SEQ ID NO: 58272 - protein, 65 aa, Homo sapiens; identical to SEQ ID NO: 58271

SEQ ID NO: 58273 - protein, 128 aa, Homo sapiens
MLKKMGEAVARVARKVNETVESGSDTLDLAECKLVSFPIGIYKVLRNVSGQIHLITLANNELKSLTSKFMTTFSQLRDVPVEKLAAMPALRSINLRFNPLNAEVRVIAPPLIKFDMLMSPEGARAPLP

SEQ ID NO: 58274 - protein, 134 aa, Homo sapiens
MLKKMGEAVARVARKVNETVESGSDTLELHLEGNFLHRLPSEVSALQHLKAIDLSRNQFQDFPEQLTALPALETINLEENEIVDVPVEKLAAMPALRSINLRFNPLNAEVRVIAPPLIKFDMLMSPEGARAPLP

SEQ ID NO: 58275 - protein, 184 aa, Homo sapiens
MLKKMGEAVARVARKVNETVESGSDTLDLAECKLVSFPIGIYKVLRNVSGQIHLITLANNELKSLTSKFMTTFSQLRELHLEGNFLHRLPSEVSALQHLKAIDLSRNQFQDFPEQLTALPALETINLEENEIVDVPVEKLAAMPALRSINLRFNPLNAEVRVIAPPLIKFDMLMSPEGARAPLP

SEQ ID NO: 58276 - protein, 409 aa, Homo sapiens
  VARIANT 248,251,307,327,328,344,354,402,408: Xaa = Any Amino Acid
MELLLQPVNGLVTKSQLCLWSREPVPSRQAAPSKRLESVSFPGAHEMSSRSLARPVSPSAPRSIAPARPGARPPRPGRPLAPRARQPVPHRAVPRQGSLREPLPSRRGRRGPPGHAPPSPSLRRRGARALQPSAAARARARVPRGLRLHRPAHRGLPRPRAAQRARPFPPGRAQAAGGRQPHPADPRGLLHLLRRPGLPGLQEQLAALAGGGHVQRLGQARVPRPQLQQLDPAGRRRLPLGREAGEAXPGXQQPGGRARGRLRDPGVAAGAGAQRQQPAQPQRGRPGRAARAALPASGREPLAVRLXLRPPLLLDPGERIQTAQRPXXNPVLPAHGEQEDIPAXAVGGQLQRVXVQPVTHRPLHHHFLRCGRVHCGHHLQLLPGHCGAVPPEVRTQQRCGGXRRGQGXL

SEQ ID NO: 58277 - protein, 409 aa, Homo sapiens; identical to SEQ ID NO: 58276
  VARIANT 248,251,307,327,328,344,354,402,408: Xaa = Any Amino Acid

SEQ ID NO: 58278 - protein, 1396 aa, Homo sapiens
MDTKLMCLLFFFSLPPLLVSNHTGRIKVVFTPSICKVTCTKGSCQNSCEKGNTTTLISENGHAADTLTATNFRVVICHLPCMNGGQCSSRDKCQCPPNFTGKLCQIPVHGASVPKLYQHSQQPGKALGTHVIHSTHTLPLTVTSQQGVKVKFPPNIVNIHVKHPPEASVQIHQVSRIDGPTGQKTKEAQPGQSQVSYQGLPVQKTQTIHSTYSHQQVIPHVYPVAAKTQLGRCFQETIGSQCGKALPGLSKQEDCCGTVGTSWGFNKCQKCPKKPSYHGYNQMMECLPGYKRVNNTFCQDINECQLQGVCPNGECLNTMGSYRCTCKIGFGPDPTFSSCVPDPPVISEEKGPCYRLVSSGRQCMHPLSVHLTKQLCCCSVGKAWGPHCEKCPLPGTAAFKEICPGGMGYTVSGVHRRRPIHHHVGKGPVFVKPKNTQPVAKSTHPPPLPAKEEPVEALTFSREHGPGVAEPEVATAPPEKEIPSLDQEKTKLEPGQPQLSPGISTIHLHPQFPGIVIEKTSPPVPVEVAPEASTSSASQVIAPTQVTEINECTVNPDICGAGHCINLPVRYTCICYEGYRFSEQQRKCVDIDECTQVQHLCSQGRCENTEGSFLCICPAGFMASEEGTNCIDVDECLRPDVCGEGHCVNTVGAFRCEYCDSGYRMTQRGRCEDIDECLNPSTCPDEQCVNSPGSYQCVPCTEGFRGWNGQCLDVDECLEPNVCANGDCSNLEGSYMCSCHKGYTRTPDHKHCRDIDECQQGNLCVNGQCKNTEGSFRCTCGQGYQLSAAKDQCEDIDECQHRHLCAHGQCRNTEGSFQCVCDQGYRASGLGDHCEDINECLEDKSVCQRGDCINTAGSYDCTCPDGFQLDDNKTCQDINECEHPGLCGPQGECLNTEGSFHCVCQQGFSISADGRTCEDIDECVNNTVCDSHGFCDNTAGSFRCLCYQGFQAPQDGQGCVDVNECELLSGVCGEAFCENVEGSFLCVCADENQEYSPMTGQCRSRTSTDLDVDVDQPKEEKKECYYNLNDASLCDNVLAPNVTKQECCCTSGAGWGDNCEIFPCPVLGTAEFTEMCPKGKGFVPAGESSSEAGGENYKDADECLLFGQEICKNGFCLNTRPGYECYCKQGTYYDPVKLQCFDMDECQDPSSCIDGQCVNTEGSYNCFCTHPMVLDASEKRCIRPAESNEQIEETDVYQDLCWEHLSDEYVCSRPLVGKQTTYTECCCLYGEAWGMQCALCPLKDSDDYAQLCNIPVTGRRQPYGRDALVDFSEQYTPEADPYFIQDRFLNSFEELQAEECGILNGCENGRCVRVQEGYTCDCFDGYHLDTAKMTCVDVNECDELNNRMSLCKNAKCINTDGSYKCLCLPGYVPSDKPNYCTPLNTALNLEKDSDLE

SEQ ID NO: 58279 - protein, 1722 aa, Homo sapiens
MAGAWLRWGLLLWAGLLASSAHGRLRRITYVVHPGPGLAAGALPLSGPPRSRTFNVALNARYSRSSAAAGAPSRASPGVPSERTRRTSKPGGAALQGLRPPPPPPPEPARPAVPGGQLHPNPGGHPAAAPFTKQGRQVVRSKVPQETQSGGGSRLQVHQKQQLQGVNVCGGRCCHGWSKAPGSQRCTKPSCVPPCQNGGMCLRPQLCVCKPGTKGKACETIAAQDTSSPVFGGQSPGAASSWGPPEQAAKHTSSKKADTLPRVSPVAQMTLTLKPKPSVGLPQQIHSQVTPLSSQSVVIHHGQTQEYVLKPKYFPAQKGISGEQSTEGSFPLRYVQDQVAAPFQLSNHTGRIKVVFTPSICKVTCTKGSCQNSCEKGNTTTLISENGHAADTLTATNFRVVICHLPCMNGGQCSSRDKCQCPPNFTGKLCQIPVHGASVPKLYQHSQQPGKALGTHVIHSTHTLPLTVTSQQGVKVKFPPNIVNIHVKHPPEASVQIHQVSRIDGPTGQKTKEAQPGQSQVSYQGLPVQKTQTIHSTYSHQQVIPHVYPVAAKTQLGRCFQETIGSQCGKALPGLSKQEDCCGTVGTSWGFNKCQKCPKKPSYHGYNQMMECLPGYKRVNNTFCQDINECQLQGVCPNGECLNTMGSYRCTCKIGFGPDPTFSSCVPDPPVISEEKGPCYRLVSSGRQCMHPLSVHLTKQLCCCSVGKAWGPHCEKCPLPGTAAFKEICPGGMGYTVSGVHRRRPIHHHVGKGPVFVKPKNTQPVAKSTHPPPLPAKEEPVEALTFSREHGPGVAEPEVATAPPEKEIPSLDQEKTKLEPGQPQLSPGISTIHLHPQFPGIVIEKTSPPVPVEVAPEASTSSASQVIAPTQVTEINECTVNPDICGAGHCINLPVRYTCICYEGYRFSEQQRKCVDIDECTQVQHLCSQGRCENTEGSFLCICPAGFMASEEGTNCIDVDECLRPDVCGEGHCVNTVGAFRCEYCDSGYRMTQRGRCEDIDECLNPSTCPDEQCVNSPGSYQCVPCTEGFRGWNGQCLDVDECLEPNVCANGDCSNLEGSYMCSCHKGYTRTPDHKHCRDIDECQQGNLCVNGQCKNTEGSFRCTCGQGYQLSAAKDQCEDIDECQHRHLCAHGQCRNTEGSFQCVCDQGYRASGLGDHCEDINECLEDKSVCQRGDCINTAGSYDCTCPDGFQLDDNKTCQDINECEHPGLCGPQGECLNTEGSFHCVCQQGFSISADGRTCEDIDECVNNTVCDSHGFCDNTAGSFRCLCYQGFQAPQDGQGCVDVNECELLSGVCGEAFCENVEGSFLCVCADENQEYSPMTGQCRSRTSTDLDVDVDQPKEEKKECYYNLNDASLCDNVLAPNVTKQECCCTSGAGWGDNCEIFPCPVLGTAEFTEMCPKGKGFVPAGESSSEAGGENYKDADECLLFGQEICKNGFCLNTRPGYECYCKQGTYYDPVKLQCFDMDECQDPSSCIDGQCVNTEGSYNCFCTHPMVLDASEKRCIRPAESNEQIEETDVYQDLCWEHLSDEYVCSRPLVGKQTTYTECCCLYGEAWGMQCALCPLKDSDDYAQLCNIPVTGRRQPYGRDALVDFSEQYTPEADPYFIQDRFLNSFEELQAEECGILNGCENGRCVRVQEGYTCDCFDGYHLDTAKMTCVDVNECDELNNRMSLCKNAKCINTDGSYKCLCLPGYVPSDKPNYCTPLNTALNLEKDSDLE

SEQ ID NO: 58280 - protein, 688 aa, Homo sapiens
MSSRTVLAPGNDRNSDTHGTLGSGRSSDKGPSWSSRSLGARCRNSIASCPEEQPHVGNYRLLRTIGKGNFAKVKLARHILTGREVAIKIIDKTQLNPSSLQKLFREVRIMKGLNHPNIVKLFEVIETEKTLYLVMEYASAGEVFDYLVSHGRMKEKEARAKFRQIVSAVHYCHQKNIVHRDLKAENLLLDAEANIKIADFGFSNEFTLGSKLDTFCGSPPYAAPELFQGKKYDGPEVDIWSLGVILYTLVSGSLPFDGHNLKELRERVLRGKYRVPFYMSTDCESILRRFLVLNPAKRCTLEQIMKDKWINIGYEGEELKPYTEPEEDFGDTKRIEVMVGMGYTREEIKESLTSQKYNEVTATYLLLGRKTEEGGDRGAPGLALARVRAPSDTTNGTSSSKGTSHSKGQRSSSSTYHRQRRHSDFCGPSPAPLHPKRSPTSTGEAELKEERLPGRKASCSTAGSGSRGLPPSSPMVSSAHNPNKAEIPERRKDSTSTPNNLPPSMMTRRNTYVCTERPGAERPSLLPNGKENSSGTPRVPPASPSSHSLAPPSGERSRLARGSTIRSTFHGGQVRDRRAGGGGGGGVQNGPPASPTLAHEAAPLPAGRPRPTTNLFTKLTSKLTRRVTLDPSKRQNSNRCVSGASLPQGSKIRSQTNLRESGDLRSQVAIYLGIKRKPPPGCSDSPGV

SEQ ID NO: 58281 - protein, 1141 aa, Homo sapiens
MPEAKPAAKKAPKGKDAPKGAPKEAPPKEAPAEAPKEAPPEDQSPTAEEPTGVFLKKPDSVSVETGKDAVVVAKVNGKELPDKPTIKWFKGKWLELGSKSGARFSFKESHNSASNVYTVELHIGKVVLGDRGYYRLEVKAKDTCDSCGFNIDVEAPRQDASGQSLESFKRTSEKKSDTAGELDFSGLLKKREVVEEEKKKKKKDDDDLGIPPEIWELLKGAKKSEYEKIAFQYGITDLRGMLKRLKKAKVEVKKSAAFTKKLDPAYQVDRGNKIKLMVEISDPDLTLKWFKNGQEIKPSSKYVFENVGKKRILTINKCTLADDAAYEVAVKDEKCFTELFVKEPPVLIVTPLEDQQVFVGDRVEMAVEVSEEGAQVMWMKDGVELTREDSFKARYRFKKDGKRHILIFSDVVQEDRGRYQVITNGGQCEAELIVEEKQLEVLQDIADLTVKASEQAVFKCEVSDEKVTGKWYKNGVEVRPSKRITISHVGRFHKLVIDDVRPEDEGDYTFVPDGYALSLSAKLNFLEIKVEYVPKQEPPKIHLDCSGKTSENAIVVVAGNKLRLDVSITGEPPPVATWLKGDEVFTTTEGRTRIEKRVDCSSFVIESAQREDEGRYTIKVTNPVGEDVASIFLQVVDVPDPPEAVRITSVGEDWAILVWEPPMYDGGKPVTGYLVERKKKGSQRWMKLNFEVFTETTYESTKMIEGILYEMRVFAVNAIGVSQPSMNTKPFMPIAPTSEPLHLIVEDVTDTTTTLKWRPPNRIGAGGIDGYLVEYCLEGSEEWVPANTEPVERCGFTVKNLPTGARILFRVVGVNIAGRTEPATLAQPVTIREIAEPPKIRLPRHLRQTYIRKVGEQLNLVVPFQGKPRPQVVWTKGGAPLDTSRVHVRTSDFDTVFFVRQAARSDSGEYELSVQIENMKDTATIRIRVVEKAGPPINVMVKEVWGTNALVEWQAPKDDGNSEIMGYFVQKADKKTMEWFNVYERNRHTSCTVSDLIVGNEYYFRVYTENICGLSDSPGVSKNTARILKTGITFKPFEYKEHDFRMAPKFLTPLIDRVVVAGYSAALNCAVRGHPKPKVVWMKNKMEIREDPKFLITNYQGVLTLNIRRPSPFDAGTYTCRAVNELGEALAECKLEVRVPQ

SEQ ID NO: 58282 - protein, 255 aa, Homo sapiens
MDVMDGCQFSPSEYFYDGSCIPSPEGEFGDEFVPRVAAFGAHKAELQGSDEDEHVRAPTGHHQAGHCLMWACKACKRKSTTMDRRKAATMRERRRLKKVNQAFETLKRCTTTNPNQRLPKVEILRNAIRYIESLQELLREQVENYYSLPGQSCSEPTSPTSNCSDGMPECNSPVWSRKSSTFDSIYCPDVSNVYATDKNSLSSLDCLSNIVDRITSSEQPGLPLQDLASLSPVASTDSQPRTPGASSSRLIYHVL

SEQ ID NO: 58283 - protein, 242 aa, Homo sapiens
MMMDLFETGSYFFYLDGENVTLQPLEVAEGSPLYPGSDGTLSPCQDQMPPEAGSDSSGEEHVLAPPGLQPPHCPGQCLIWACKTCKRKSAPTDRRKAATLRERRRLKKINEAFEALKRRTVANPNQRLPKVEILRSAISYIERLQDLLHRLDQQEKMQELGVDPFSYRPKQENLEGADFLRTCSSQWPSVSDHSRGLVITAKEGGASIDSSASSSLRCLSSIVDSISSEERKLPCVEEVVEK

SEQ ID NO: 58284 - protein, 194 aa, Homo sapiens
MAPKKDVKKPVAAAAAAPAPAPAPAPAPAPAKPKEEKIDLSAIKIEFSKEQQDEFKEAFLLFDRTGDSKITLSQVGDVLRALGTNPTNAEVRKVLGNPSNEELNAKKIEFEQFLPMMQAISNNKDQATYEDFVEGLRVFDKEGNGTVMGAELRHVLATLGEKMKEEEVEALMAGQEDSNGCINYEAFVKHIMSI

SEQ ID NO: 58285 - protein, 150 aa, Homo sapiens
MSFSADQIAEFKEAFLLFDRTGDSKITLSQVGDVLRALGTNPTNAEVRKVLGNPSNEELNAKKIEFEQFLPMMQAISNNKDQATYEDFVEGLRVFDKEGNGTVMGAELRHVLATLGEKMKEEEVEALMAGQEDSNGCINYEAFVKHIMSI

SEQ ID NO: 58286 - protein, 596 aa, Homo sapiens
MATENGAVELGIQNPSTDKAPKGPTGERPLAAGKDPGPPDPKKAPDPPTLKKDAKAPASEKGDGTLAQPSTSSQGPKGEGDRGGGPAEGSAGPPAALPQQTATPETSVKKPKAEQGASGSQDPGKPRVGKKAAEGQAAARRGSPAFLHSPSCPAIISSSEKLLAKKPPSEASELTFEGVPMTHSPTDPRPAKAEEGKNILAESQKEVGEKTPGQAGQAKMQGDTSRGIEFQAVPSEKSEVGQALCLTAREEDCFQILDDCPPPPAPFPHRMVELRTGNVSSEFSMNSKEALGGGKFGAVCTCMEKATGLKLAAKVIKKQTPKDKEMVLLEIEVMNQLNHRNLIQLYAAIETPHEIVLFMEYIEGGELFERIVDEDYHLTEVDTMVFVRQICDGILFMHKMRVLHLDLKPENILCVNTTGHLVKIIDFGLARRYNPNEKLKVNFGTPEFLSPEVVNYDQISDKTDMWSMGVITYMLLSGLSPFLGDDDTETLNNVLSGNWYFDEETFEAVSDEAKDFVSNLIVKDQRARMNAAQCLAHPWLNNLAEKAKRCNRRLKSQILLKKYLMKRRWKKNFIAVSAANRFKKISSSGALMALGV

SEQ ID NO: 58287 - protein, 320 aa, Homo sapiens
MELLSPPLRDVDLTAPDGSLCSFATTDDFYDDPCFDSPDLRFFEDLDPRLMHVGALLKPEEHSHFPAAVHPAPGAREDEHVRAPSGHHQAGRCLLWACKACKRKTTNADRRKAATMRERRRLSKVNEAFETLKRCTSSNPNQRLPKVEILRNAIRYIEGLQALLRDQDAAPPGAAAAFYAPGPLPPGRGGEHYSGDSDASSPRSNCSDGMMDYSGPPSGARRRNCYEGAYYNEAPSEPRPGKSAAVSSLDCLSSIVERISTESPAAPALLLADVPSESPPRRQEAAAPSEGESSGDPTQSPDAAPQCPAGANPNPIYQVL

SEQ ID NO: 58288 - protein, 224 aa, Homo sapiens
MELYETSPYFYQEPRFYDGENYLPVHLQGFEPPGYERTELTLSPEAPGPLEDKGLGTPEHCPGQCLPWACKVCKRKSVSVDRRRAATLREKRRLKKVNEAFEALKRSTLLNPNQRLPKVEILRSAIQYIERLQALLSSLNQEERDLRYRGGGGPQPGVPSECSSHSASCSPEWGSALEFSANPGDHLLTADPTDAHNLHSLTSIVDSITVEDVSVAFPDETMPN

SEQ ID NO: 58289 - protein, 498 aa, Homo sapiens
MFNYERPKHFIQSQNPCGSRLQPPGPETSSFSSQTKQSSIIIQPRQCTEQRFSASSTLSSHITMSSSAFPASPQQHAGSNPGQRVTTTYNQSPASFLSSILPSQPDYNSSKIPSAMDSNYQQSSAGQPINAKPSQTANAKPIPRTPDHEIQGSKEALIQDLERKLKCKDTLLHNGNQRLTYEEKMARRLLGPQNAAAVFQAQDDSGAQDSQQHNSEHARLQVPTSQVRSRSTSRGDVNDQDAIQEKFYPPRFIQVPENMSIDEGRFCRMDFKVSGLPAPDVSWYLNGRTVQSDDLHKMIVSEKGLHSLIFEVVRASDAGAYACVAKNRAGEATFTVQLDVLAKEHKRAPMFIYKPQSKKVLEGDSVKLECQISAIPPPKLFWKRNNEMVQFNTDRISLYQDNTGRVTLLIKDVNKKDAGWYTVSAVNEAGVTTCNTRLDVTARPNQTLPAPKQLRVRPTFSKYLALNGKGLNVKQAFNPEGEFQRLAAQSGLYESEEL

SEQ ID NO: 58290 - protein, 299 aa, Homo sapiens
MPLSGTPAPNKKRKSSKLIMELTGGGQESSGLNLGKKISVPRDVMLEELSLLTNRGSKMFKLRQMRVEKFIYENHPDVFSDSSMDHFQKFLPTVGGQLGTAGQGFSYSKSNGRGGSQAGGSGSAGQYGSDQQHHLGSGSGAGGTGGPAGQAGRGGAAGTAGVGETGSGDQAGGEGKHITVFKTYISPWERAMGVDPQQKMELGIDLLAYGAKAELPKYKSFNRTAMPYGGYEKASKRMTFQMPKFDLGPLLSEPLVLYNQNLSNRPSFNRTPIPWLSSGEPVDYNVDIGIPLDGETEEL

SEQ ID NO: 58291 - protein, 6620 aa, Homo sapiens
MDQPQFSGAPRFLTRPKAFVVSVGKDATLSCQIVGNPTPQVSWEKDQQPVAAGARFRLAQDGDLYRLTILDLALGDSGQYVCRARNAIGEAFAAVGLQVDAEAACAEQAPHFLLRPTSIRVREGSEATFRCRVGGSPRPAVSWSKDGRRLGEPDGPRVRVEELGEASALRIRAARPRDGGTYEVRAENPLGAASAAAALVVDSDAADTASRPGTSTAALLAHLQRRREAMRAEGAPASPPSTGTRTCTVTEGKHARLSCYVTGEPKPETVWKKDGQLVTEGRRHVVYEDAQENFVLKILFCKQSDRGLYTCTASNLVGQTYSSVLVVVREPAVPFKKRLQDLEVREKESATFLCEVPQPSTEAAWFKEETRLWASAKYGIEEEGTERRLTVRNVSADDDAVYICETPEGSRTVAELAVQGNLLRKLPRKTAVRVGDTAMFCVELAVPVGPVHWLRNQEEVVAGGRVAISAEGTRHTLTISQCCLEDVGQVAFMAGDCQTSTQFCVSAPRKPPLQPPVDPVVKARMESSVILSWSPPPHGERPVTIDGYLVEKKKLGTYTWIRCHEAEWVATPELTVADVAEEGNFQFRVSALNSFGQSPYLEFPGTVHLAPKLAVRTPLKAVQAVEGGEVTFSVDLTVASAGEWFLDGQALKASSVYEIHCDRTRHTLTIREVPASLHGAQLKFVANGIESSIRMEVRAAPGLTANKPPAAAAREVLARLHEEAQLLAELSDQAAAVTWLKDGRTLSPGPKYEVQASAGRRVLLVRDVARDDAGLYECVSRGGRIAYQLSVQGLARFLHKDMAGSCVDAVAGGPAQFECETSEAHVHVHWYKDGMELGHSGERFLQEDVGTRHRLVAATVTRQDEGTYSCRVGEDSVDFRLRVSEPKVVFAKEQLARRKLQAEAGASATLSCEVAQAQTEVTWYKDGKKLSSSSKVCMEATGCTRRLVVQQAGQADAGEYSCEAGGQRLSFHLDVKEPKVVFAKDQVAHSEVQAEAGASATLSCEVAQAQTEVMWYKDGKKLSSSLKVHVEAKGCRRRLVVQQAGKTDAGDYSCEARGQRVSFRLHITEPKMMFAKEQSVHNEVQAEAGASAMLSCEVAQAQTEVTWYKDGKKLSSSSKVGMEVKGCTRRLVLPQAGKADAGEYSCEAGGQRVSFHLHITEPKGVFAKEQSVHNEVQAEAGTTAMLSCEVAQPQTEVTWYKDGKKLSSSSKVRMEVKGCTRRLVVQQVGKADAGEYSCEAGGQRVSFQLHITEPKAVFAKEQLVHNEVRTEAGASATLSCEVAQAQTEVTWYKDGKKLSSSSKVRIEAAGCMRQLVVQQAGQADAGEYTCEAGGQRLSFHLDVSEPKAVFAKEQLAHRKVQAEAGAIATLSCEVAQAQTEVTWYKDGKKLSSSSKVRMEAVGCTRRLVVQQACQADTGEYSCEAGGQRLSFSLDVAEPKVVFAKEQPVHREVQAQAGASTTLSCEVAQAQTEVMWYKDGKKLSFSSKVRMEAVGCTRRLVVQQAGQAVAGEYSCEAGSQRLSFHLHVAEPKAVFAKEQPASREVQAEAGTSATLSCEVAQAQTEVTWYKDGKKLSSSSKVRMEAVGCTRRLVVQEAGQADAGEYSCKAGDQRLSFHLHVAEPKVVFAKEQPAHREVQAEAGASATLSCEVAQAQTEVTWYKDGKKLSSSSKVRVEAVGCTRRLVVQQAGQADAGEYSCEAGGQRLSFRLHVAELEPQISERPCRREPLVVKEHEDIILTATLATPSAATVTWLKDGVEIRRSKRHETASQGDTHTLTVHGAQVLDSAIYSCRVGAEGQDFPVQVEEVAAKFCRLLEPVCGELGGTVTLACELSPACAEVVWRCGNTQLRVGKRFQMVAEGPVRSLTVLGLRAEDAGEYVCESRDDHTSAQLTVSVPRVVKFMSGLSTVVAEEGGEATFQCVVSPSDVAVVWFRDGALLQPSEKFAISQSGASHSLTISDLVLEDAGQITVEAEGASSSAALRVREAPVLFKKKLEPQTVEERSSVTLEVELTRPWPELRWTRNATALAPGKNVEIHAEGARHRLVLHNVGFADRGFFGCETPDDKTQAKLTVEMRQVRLVRGLQAVEAREQGTATMEVQLSHADVDGSWTRDGLRFQQGPTCHLAVRGPMHTLTLSGLRPEDSGLMVFKAEGVHTSARLVVTELPVSFSRPLQDVVTTEKEKVTLECELSRPNVDVRWLKDGVELRAGKTMAIAAQGACRSLTIYRCEFADQGVYVCDAHDAQSSASVKVQGRTYTLIYRRVLAEDAGEIQFVAENAESRAQLRVKELPVTLVRPLRDKIAMEKHRGVLECQVSRASAQVRWFKGSQELQPGPKYELVSDGLYRKLIISDVHAEDEDTYTCDAGDVKTSAQFFVEEQSITIVRGLQDVTVMEPAPAWFECETSIPSVRPPKWLLGKTVLQAGGNVGLEQEGTVHRLMLRRTCSTMTGPVHFTVGKSRSSARLVVSDIPVVLTRPLEPKTGRELQSVVLSCDFRPAPKAVQWYKDDTPLSPSEKFKMSLEGQMAELRILRLMPADAGVYRCQAGSAHSSTEVTVEAREVTVTGPLQDAEATEEGWASFSCELSHEDEEVEWSLNGMPLYNDSFHEISHKGRRHTLVLKSIQRADAGIVRASSLKVSTSARLEVRVKPVVFLKALDDLSAEERGTLALQCEVSDPEAHVVWRKDGVQLGPSDKYDFLHTAGTRGLVVHDVSPEDAGLYTCHVGSEETRARVRVHDLHVGITKRLKTMEVLEGESCSFECVLSHESASDPAMWTVGGKTVGSSSRFQATRQGRKYILVVREAAPSDAGEVVFSVRGLTSKASLIVRERPAAIIKPLEDQWVAPGEDVELRCELSRAGTPVHWLKDRKAIRKSQKYDVVCEGTMAMLVIRGASLKDAGEYTCEVEASKSTASLHVEEKANCFTEELTNLQVEEKGTAVFTCKTEHPAATVTWRKGLLELRASGKHQPSQEGLTLRLTISALEKADSDTYTCDIGQAQSRAQLLVQGRRVHIIEDLEDVDVQEGSSATFRCRISPANYEPVHWFLDKTPLHANELNEIDAQPGGYHVLTLRQLALKDSGTIYFEAGDQRASAALRVTEKPSVFSRELTDATITEGEDLTLVCETSTCDIPVCWTKDGKTLRGSARCQLSHEGHRAQLLITGATLQDSGRYKCEAGGACSSSIVRVHARPVRFQEALKDLEVLEGGAATLRCVLSSVAAPVKWCYGNNVLRPGDKYSLRQEGAMLELVVRNLRPQDSGRYSCSFGDQTTSATLTVTALPAQFIGKLRNKEATEGATATLRCELSKAAPVEWRKGSETLRDGDRYCLRQDGAMCELQIRGLAMVDAAEYSCVCGEERTSASLTIRPMPAHFIGRLRHQESIEGATATLRCELSKAAPVEWRKGRESLRDGDRHSLRQDGAVCELQICGLAVADAGEYSCVCGEERTSATLTVKALPAKFTEGLRNEEAVEGATAMLWCELSKVAPVEWRKGPENLRDGDRYILRQEGTRCELQICGLAMADAGEYLCVCGQERTSATLTIRALPARFIEDVKNQEAREGATAVLQCELNSAAPVEWRKGSETLRDGDRYSLRQDGTKCELQIRGLAMADTGEYSCVCGQERTSAMLTVRALPIKFTEGLRNEEATEGATAVLRCELSKMAPVEWWKGHETLRDGDRHSLRQDGARCELQIRGLVAEDAGEYLCMCGKERTSAMLTVRAMPSKFIEGLRNEEATEGDTATLWCELSKAAPVEWRKGHETLRDGDRHSLRQDGSRCELQIRGLAVVDAGEYSCVCGQERTSATLTVRALPARFIEDVKNQEAREGATAVLQCELSKAAPVEWRKGSETLRGGDRYSLRQDGTRCELQIHGLSVADTGEYSCVCGQERTSATLTVRAPQPVFREPLQSLQAEEGSTATLQCELSEPTATVVWSKGGLQLQANGRREPRLQGCTAELVLQDLQREDTGEYTCTCGSQATSATLTVTAAPVRFLRELQHQEVDEGGTAHLCCELSRAGASVEWRKGSLQLFPCAKYQMVQDGAAAELLVRGVEQEDAGDYTCDTGHTQSMASLSVRVPRPKFKTRLQSLEQETGDIARLCCQLSDAESGAVVQWLKEGVELHAGPKYEMRSQGATRELLIHQLEAKDTGEYACVTGGQKTAASLRVTEPEVTIVRGLVDAEVTADEDVEFSCEVSRAGATGVQWCLQGLPLQSNEVTEVAVRDGRIHTLRLKGVTPEDAGTVSFHLGNHASSAQLTVRAPEVTILEPLQDVQLSEGQDASFQCRLSRASGQEARWALGGVPLQANEMNDITVEQGTLHLLTLHKVTLEDAGTVSFHVGTCSSEAQLKVTAKNTVVRGLENVEALEGGEALFECQLSQPEVAAHTWLLDDEPVHTSENAEVVFFENGLRHLLLLKNLRPQDSCRVTFLAGDMVTSAFLTVRGWRLEILEPLKNAAVRAGAQACFTCTLSEAVPVGEASWYINGAAVQPDDSDWTVTADGSHHALLLRSAQPHHAGEVTFACRDAVASARLTVLGLPDPPEDAEVVARSSHTVTLSWAAPMSDGGGGLCGYRVEVKEGATGQWRLCHELVPGPECVVDGLAPGETYRFRVAAVGPVGAGEPVHLPQTVRLAEPPKPVPPQPSAPESRQVAAGEDVSLELEVVAEAGEVIWHKGMERIQPGGRFEVVSQGRQQMLVIKGFTAEDQGEYHCGLAQGSICPAAATFQVALSPASVDEAPQPSLPPEAAQEGDLHLLWEALARKRRMSREPTLDSISELPEEDGRSQRLPQEAEEVAPDLSEGYSTADELARTGDADLSHTSSDDESRAGTPSLVTYLKKAGRPGTSPLASKVGAPAAPSVKPQQQQEPLAAVRPPLGDLSTKDLGDPSMDKAAVKIQAAFKGYKVRKEMKQQEGPMFSHTFGDTEAQVGDALRLECVVASKADVRARWLKDGVELTDGRHHHIDQLGDGTCSLLITGLDRADAGCYTCQVSNKFGQVTHSACVVVSGSESEAESSSGGELDDAFRRAARRLHRLFRTKSPAEVSDEELFLSADEGPAEPEEPADWQTYREDEHFICIRFEALTEARQAVTRFQEMFATLGIGVEIKLVEQGPRRVEMCISKETPAPVVPPEPLPSLLTSDAAPVFLTELQNQEVQDGYPVSFDCVVTGQPMPSVRWFKDGKLLEEDDHYMINEDQQGGHQLIITAVVPADMGVYRCLAENSMGVSSTKAELRVDLTSTDYDTAADATESSSYFSAQGYLSSREQEGTESTTDEGQLPQVVEELRDLQVAPGTRLAKFQLKVKGYPAPRLYWFKDGQPLTASAHIRMTDKKILHTLEIISVTREDSGQYAAYISNAMGAAYSSARLLVRGPDEPEEKPASDVHEQLVPPRMLERFTPKKVKKGSSITFSVKVEGRPVPTVHWLREEAERGVLWIGPDTPGYTVASSAQQHSLVLLDVGRQHQGTYTCIASNAAGQALCSASLHVSGLPKVEEQEKVKEALISTFLQGTTQAISAQGLETASFADLGGQRKEEPLAAKEALGHLSLAEVGTEEFLQKLTSQITEMVSAKITQAKLQVPGGDSDEDSKTPSASPRHGRSRPSSSIQESSSESEDGDARGEIFDIYVVTADYLPLGAEQDAITLREGQYVEVLDAAHPLRWLVRTKPTKSSPSRQGWVSPAYLDRRLKLSPEWGAAEAPEFPGEAVSEDEYKARLSSVIQELLSSEQAFVEELQFLQSHHLQHLERCPHVPIAVAGQKAVIFRNVRDIGRFHSSFLQELQQCDTDDDVAMCFIKNQAAFEQYLEFLVGRVQAESVVVSTAIQEFYKKYAEEALLAGDPSQPPPPPLQHYLEQPVERVQRYQALLKELIRNKARNRQNCALLEQAYAVVSALPQRAENKLHVSLMENYPGTLQALGEPIRQGHFIVWEGAPGARMPWKGHNRHVFLFRNHLVICKPRRDSRTDTVSYVFRNMMKLSSIDLNDQVEGDDRAFEVWQEREDSVRKYLLQARTAIIKSSWVKEICGIQQRLALPVWRPPDFEEELADCTAELGETVKLACRVTGTPKPVISWYKDGKAVQVDPHHILIEDPDGSCALILDSLTGVDSGQYMCFAASAAGNCSTLGKILVQVPPRFVNKVRASPFVEGEDAQFTCTIEGAPYPQIRWYKDGALLTTGNKFQTLSEPRSGLLVLVIRAASKEDLGLYECELVNRLGSARASAELRIQSPMLQAQEQCHREQLVAAVEVTEQETKVPKKTVIIEETITTVVKSPRGQRRSPSKSPSRSPSRCSASPLRPGLLAPDLLYLPGAGQPRRPEAEPGQKPVVPTLYVTEAEAHSPALPGLSGPQPKWVEVEETIEVRVKKMGPQGVSPTTEVPRSSSGHLFTLPGATPGGDPNSNNSNNKLLAQEAWAQGTAMVGVREPLVFRVDARGSVDWAASGMGSLEEEGTMEEAGEEEGEDGDAFVTEESQDTHSLGDRDPKILTHNGRMLTLADLEDYVPGEGETFHCGGPGPGAPDDPPCEVSVIQREIGEPTVGQPVLLSVGHALGPRGPLGLFRPEPRGASPPGPQVRSLEGTSFLLREAPARPVGSAPWTQSFCTRIRRSADSGQSSFTTELSTQTVNFGTVGETVTLHICPDRDGDEAAQP

SEQ ID NO: 58292 - protein, 298 aa, Homo sapiens
MKTLQSTLLLLLLVPLIKPAPPTQQDSRIIYDYGTDNFEESIFSQDYEDKYLDGKNIKEKETVIIPNEKSLQLQKDEAITPLPPKKENDEMPTCLLCVCLSGSVYCEEVDIDAVPPLPKESAYLYARFNKIKKLTAKDFADIPNLRRLDFTGNLIEDIEDGTFSKLSLLEELSLAENQLLKLPVLPPKLTLFNAKYNKIKSRGIKANAFKKLNNLTFLYLDHNALESVPLNLPESLRVIHLQFNNIASITDDTFCKANDTSYIRDRIEEIRLEGNPIVLGKHPNSFICLKRLPIGSYF

SEQ ID NO: 58293 - protein, 298 aa, Homo sapiens; identical to SEQ ID NO: 58292

SEQ ID NO: 58294 - protein, 298 aa, Homo sapiens; identical to SEQ ID NO: 58292

SEQ ID NO: 58295 - protein, 1347 aa, Homo sapiens
MDLLSGTYIFAVLLACVVFHSGAQEKNYTIREEMPENVLIGDLLKDLNLSLIPNKSLTTAMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLETAAYLDYESTKEYAIKLLAADAGKPPLNQSAMLFIKVKDENDNAPVFTQSFVTVSIPENNSPGIQLTKVSAMDADSGPNAKINYLLGPDAPPEFSLDCRTGMLTVVKKLDREKEDKYLFTILAKDNGVPPLTSNVTVFVSIIDQNDNSPVFTHNEYNFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPSNCSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSTEAPVTPNTEIADVSSPTSDYVKILVAAVAGTITVVVVIFITAVVRCRQAPHLKAAQKNKQNSEWATPNPENRQMIMMKKKKKKKKHSPKNLLLNFVTIEETKADDVDSDGNRVTLDLPIDLEEQTMGKYNWVTTPTTFKPDSPDLARHYKSASPQPAFQIQPETPLNSKHHIIQELPLDNTFVACDSISKCSSSSSDPYSVSDCGYPVTTFEVPVSVHTRPPMKEVVRSCTPMKESTTMEIWIHPQPQRKSEGKVAGKSQRRVTFHLPEGSQESSSDGGLGDHDAGSLTSTSHGLPLGYPQEEYFDRATPSNRTEGDGNSDPESTFIPGLKKAAEITVQPTVEEASDNCTQECLIYGHSDACWMPASLDHSSSSQAQASALCHSPPLSQASTQHHSPRVTQTIALCHSPPVTQTIALCHSPPPIQVSALHHSPPLVQATALHHSPPSAQASALCYSPPLAQAAAISHSSPLPQVIALHRSQAQSSVSLQQGWVQGADGLCSVDQGVQGSATSQFYTMSERLHPSDDSIKVIPLTTFTPRQQARPSRGDSPIMEEHPL

SEQ ID NO: 58296 - protein, 1337 aa, Homo sapiens
MDLLSGTYIFAVLLACVVFHSGAQEKNYTIREEMPENVLIGDLLKDLNLSLIPNKSLTTAMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLETAAYLDYESTKEYAIKLLAADAGKPPLNQSAMLFIKVKDENDNAPVFTQSFVTVSIPENNSPGIQLTKVSAMDADSGPNAKINYLLGPDAPPEFSLDCRTGMLTVVKKLDREKEDKYLFTILAKDNGVPPLTSNVTVFVSIIDQNDNSPVFTHNEYNFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPSNCSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSTEAPVTPNTEIADVSSPTSDYVKILVAAVAGTITVVVVIFITAVVRCRQAPHLKAAQKNKQNSEWATPNPENRQMIMMKKKKKKKKHSPKNLLLNFVTIEETKADDVDSDGNRVTLDLPIDLEEQTMGKYNWVTTPTTFKPDSPDLARHYKSASPQPAFQIQPETPLNSKHHIIQELPLDNTFVACDSISKCSSSSSDPYSVSDCGYPVTTFEVPVSVHTRPPMKEVVRSCTPMKESTTMEIWIHPQPQSQRRVTFHLPEGSQESSSDGGLGDHDAGSLTSTSHGLPLGYPQEEYFDRATPSNRTEGDGNSDPESTFIPGLKKAAEITVQPTVEEASDNCTQECLIYGHSDACWMPASLDHSSSSQAQASALCHSPPLSQASTQHHSPRVTQTIALCHSPPVTQTIALCHSPPPIQVSALHHSPPLVQATALHHSPPSAQASALCYSPPLAQAAAISHSSPLPQVIALHRSQAQSSVSLQQGWVQGADGLCSVDQGVQGSATSQFYTMSERLHPSDDSIKVIPLTTFTPRQQARPSRGDSPIMEEHPL

SEQ ID NO: 58297 - protein, 1340 aa, Homo sapiens
MFRVGFLIISSSSSLSPLLLVSVVRVNTTNCHKCLLSGTYIFAVLLVCVVFHSGAQEKNYTIREEIPENVLIGNLLKDLNLSLIPNKSLTTTMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLENAAYLDYESTKEYAIKLLAADAGKPPLNQSAMLFIKVKDENDNAPVFTQSFVTVSIPENNSPGIQLMKVSATDADSGPNAEINYLLGPDAPPEFSLDRRTGMLTVVKKLDREKEDKYLFTILAKDNGVPPLTSNVTVFVSIIDQNDNSPVFTHNEYKFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPYNYSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSIEAPVTPNTEIADVSSPTSDYVKILVAAVAGTITVVVVIFITAVVRCRQAPHLKAAQKNMQNSEWATPNPENRQMIMMKKKKKKKKHSPKNLLLNVVTIEETKADDVDSDGNRVTLDLPIDLEEQTMGKYNWVTTPTTFKPDSPDLARHYKSASPQPAFQIQPETPLNLKHHIIQELPLDNTFVACDSISNCSSSSSDPYSVSDCGYPVTTFEVPVSVHTRPSQRRVTFHLPEGSQESSSDGGLGDHDAGSLTSTSHGLPLGYPQEEYFDRATPSNRTEGDGNSDPESTFIPGLKKEITVQPTVEEASDNCTQECLIYGHSDACWMPASLDHSSSSQAQASALCHSPPLSQASTQHHSPPVTQTIVLCHSPPVTQTIALCHSPPPIQVSALHHSPPLVQGTALHHSPPSAQASALCYSPPLAQAAAISHSSSLPQVIALHRSQAQSSVSLQQGWVQGANGLCSVDQGVQGSATSQFYTMSERLHPSDDSIKVIPLTTFAPRQQARPSRGDSPIMETHPL

SEQ ID NO: 58298 - protein, 364 aa, Homo sapiens
MPQTVILPGPAPWGFRLSGGIDFNQPLVITRITPGSKAAAANLCPGDVILAIDGFGTESMTHADAQDRIKAAAHQLCLKIDRGETHLWSPQVSEDGKAHPFKINLESEPQDGNYFEHKHNIRPKPFVIPGRSSGCSTPSGIDCGSGRSTPSSVSTVSTICPGDLKVAAKLAPNIPLEMELPGVKIVHAQFNTPMQLYSDDNIMETLQGQVSTALGETPLMNEPTASVPPESDVYRMLHDNRNEPTQPRQSGSFRVLQGMVDDGSDDRPAGTRSVRAPVTKVHGGSGGAQRMPLCDKCGSGIVGAVVKARDKYRHPECFVCADCNLNLKQKGYFFIEGELYCETHARARTKPPEGYDTVTLYPKA

SEQ ID NO: 58299 - protein, 253 aa, Homo sapiens
MATHRLVMVRHGESTWNQENRFCGWFDAELSEKGTEEAKRGAKAIKDAKMEFDICYTSVLKRAIRTLWAILDGTDQMWLPVVRTWRLNERHYGGLTGLNKAETAAKHGEEQVKIWRRSFDIPPPPMDEKHPYYNSISKERRYAGLKPGELPTCESLKDTIARALPFWNEEIVPQIKAGKRVLIAAHGNSLRGIVKHLEGMSDQAIMELNLPTGIPIVYELNKELKPTKPMQFLGDEETVRKAMEAVAAQGKAK

SEQ ID NO: 58300 - protein, 76 aa, Homo sapiens
MTDVETTYADFIASGRTGRRNAIHDILVSSASGNSNELALKLAGLDINKTEGEEDAQRSSTEQSGEAQGEAAKSES

SEQ ID NO: 58301 - protein, 76 aa, Homo sapiens; identical to SEQ ID NO: 58300

SEQ ID NO: 58302 - protein, 317 aa, Homo sapiens
MSCTRMIQVLDPRPLTSSVMPVDVAMRLCLAHSPPVKSFLGPYDEFQRRHFVNKLKPLKSCLNIKHKAKSQNDWKCSHNQAKKRVVFADSKGLSLTAIHVFSDLPEEPAWDLQFDLLDLNDISSALKHHEEKNLILDFPQPSTDYLSFRSHFQKNFVCLENCSLQERTVTGTVKVKNVSFEKKVQIRITFDSWKNYTDVDCVYMKNVYGGTDSDTFSFAIDLPPVIPTEQKIEFCISYHANGQVFWDNNDGQNYRIVHVQWKPDGVQTQMAPQDCAFHQTSPKTELESTIFGSPRLASGLFPEWQSWGRMENLASYR

SEQ ID NO: 58303 - protein, 489 aa, Homo sapiens
MEPGLEHALRRTPSWSSLGGSEHQEMSFLEQENSSSWPSPAVTSSSERIRGKRRAKALRWTRQKSVEEGEPPGQGEGPRSRPAAESTGLEATFPKTTPLAQADPAGVGTPPTGWDCLPSDCTASAAGSSTDDVELATEFPATEAWECELEGLLEERPALCLSPQAPFPKLGWDDELRKPGAQIYMRFMQEHTCYDAMATSSKLVIFDTMLEIKKAFFALVANGVRAAPLWDSKKQSFVGMLTITDFILVLHRYYRSPLVQIYEIEQHKIETWREIYLQGCFKPLVSISPNDSLFEAVYTLIKNRIHRLPVLDPVSGNVLHILTHKRLLKFLHIFGSLLPRPSFLYRTIQDLGIGTFRDLAVVLETAPILTALDIFVDRRVSALPVVNECGQVVGLYSRFDVIHLAAQQTYNHLDMSVGEALRQRTLCLEGVLSCQPHESLGEVIDRIAREQVHRLVLVDETQHLLGVVSLSDILQALVLSPAGIDALGA

SEQ ID NO: 58304 - protein, 412 aa, Homo sapiens
MGQDQTKQQIEKGLQLYQSNQTEKALQVWTKVLEKSSDLMGRFRVLGCLVTAHSEMGRYKEMLKFAVVQIDTARELEDADFLLESYLNLARSNEKLCEFHKTISYCKTCLGLPGTRAGAQLGGQVSLSMGNAFLGLSVFQKALESFEKALRYAHNNDDAMLECRVCCSLGSFYAQVKDYEKALFFPCKAAELVNNYGKGWSLKYRAMSQYHMAVAYRLLGRLGSAMECCEESMKIALQHGDRPLQALCLLCFADIHRSRGDLETAFPRYDSAMSIMTEIGNRLGQVQALLGVAKCWVARKALDKALDAIERAQDLAEEVGNKLSQLKLHCLSESIYRSKGLQRELRAHVVRFHECVEETELYCGLCGESIGEKNSRLQALPCSHIFHLRCLQNNGTRSCPNCRRSSMKPGFV

SEQ ID NO: 58305 - protein, 388 aa, Homo sapiens
MLKVKRLEEFNTCYNSNQLEKMAFFQCREEVEKVKCFLEKNSGDQDSRSGHNEAKEVWSNADLTERMPVKSKRTSALAVDIPAPPAPFDHRIVTAKQGAVNSFYTVSKTEILGGGRFGQVHKCEETATGLKLAAKIIKTRGMKDKEEVKNEISVMNQLDHANLIQLYDAFESKNDIVLVMEYVDGGELFDRIIDESYNLTELDTILFMKQICEGIRHMHQMYILHLDLKPENILCVNRDAKQIKIIDFGLARRYKPREKLKVNFGTPEFLAPEVVNYDFVSFPTDMWSVGVIAYMLLSGLSPFLGDNDAETLNNILACRWDLEDEEFQDISEEAKEFISKLLIKEKSWRISASEALKHPWLSDHKLHSRLSAQKKKNRGSDAQDFVTK

SEQ ID NO: 58306 - protein, 545 aa, Homo sapiens
MGQVLPVFAHCKEAPSTASSTPDSTEGGNDDSDFRELHTAREFSEEDEEETTSQDWGTPRELTFSYIAFDGVVGSGGRRDSTARRPRPQGRSVSEPRDQHPQPSLGDSLESIPSLSQSPEPGRRGDPDTAPPSERPLEDLRLRLDHLGWVARGTGSGEDSSTSSSTPLEDEEPQEPNRLETGEAGEELDLRLRLAQPSSPEVLTPQLSPGSGTPQAGTPSPSRSRDSNSGPEEPLLEEEEKQWGPLEREPVRGQCLDSTDQLEFTVEPRLLGTAMEWLKTSLLLAVYKTVPILELSPPLWTAIGWVQRGPTPPTPVLRVLLKWAKSPRSSGVPSLSLGADMGSKVADLLYWKDTRTSGVVFTGLMVSLLCLLHFSIVSVAAHLALLLLCGTISLRVYRKVLQAVHRGDGANPFQAYLDVDLTLTREQTERLSHQITSRVVSAATQLRHFFLVEDLVDSLKLALLFYILTFVGAIFNGLTLLILGVIGLFTIPLLYRQHQAQIDQYVGLVTNQLSHIKAKIRAKIPGTGALASAAAAVSGSKAKAE

SEQ ID NO: 58307 - protein, 472 aa, Homo sapiens
MGQVLPVFAHCKEAPSTASSTPDSTEGGNDDSDFRELHTAREFSEEDEEETTSQDWGTPRELTFSYIAFDGVVGSGGRRDSTARRPRPQGRSVSEPRDQHPQPSLGDSLESIPSLSQSPEPGRRGDPDTAPPSERPLEDLRLRLDHLGWVARGTGSGEDSSTSSSTPLEDEEPQEPNRLETGEAGEELDLRLRLAQPSSPEVLTPQLSPGSGTPQAGTPSPSRSRDSNSGPEEPLLEEEEKQWGPLEREPVRGQCLDSTDQLEFTVEPRLLVADLLYWKDTRTSGVVFTGLMVSLLCLLHFSIVSVAAHLALLLLCGTISLRVYRKVLQAVHRGDGANPFQAYLDVDLTLTREQTERLSHQITSRVVSAATQLRHFFLVEDLVDSLKLALLFYILTFVGAIFNGLTLLILGVIGLFTIPLLYRQHQAQIDQYVGLVTNQLSHIKAKIRAKIPGTGALASAAAAVSGSKAKAE

SEQ ID NO: 58308 - protein, 205 aa, Homo sapiens
MGSKVADLLYWKDTRTSGVVFTGLMVSLLCLLHFSIVSVAAHLALLLLCGTISLRVYRKVLQAVHRGDGANPFQAYLDVDLTLTREQTERLSHQITSRVVSAATQLRHFFLVEDLVDSLKLALLFYILTFVGAIFNGLTLLILGVIGLFTIPLLYRQHQAQIDQYVGLVTNQLSHIKAKIRAKIPGTGALASAAAAVSGSKAKAE

SEQ ID NO: 58309 - protein, 276 aa, Homo sapiens
MGQVLPVFAHCKEAPSTASSTPDSTEGGNDDSDFRELHTAREFSEEDEEETTSQDWGTPRELTFSYIAFDGVVGSGGRRDSTARRPRPQGRSVSEPRDQHPQPSLGDSLESIPSLSQSPEPGRRGDPDTAPPSERPLEDLRLRLDHLGWVARGTGSGEDSSTSSSTPLEDEEPQEPNRLETGEAGEELDLRLRLAQPSSPEVLTPQLSPGSGTPQAGTPSPSRSRDSNSGPEEPLLEEEEKQWGPLEREPVRGQCLDSTDQLEFTVEPRLLGKQRV

SEQ ID NO: 58310 - protein, 5038 aa, Homo sapiens
MGDAEGEDEVQFLRTDDEVVLQCSATVLKEQLKLCLAAEGFGNRLCFLEPTSNAQNVPPDLAICCFVLEQSLSVRALQEMLANTVEAGVESSQGGGHRTLLYGHAILLRHAHSRMYLSCLTTSRSMTDKLAFDVGLQEDATGEACWWTMHPASKQRSEGEKVRVGDDIILVSVSSERYLHLSTASGELQVDASFMQTLWNMNPICSRCEEGFVTGGHVLRLFHGHMDECLTISPADSDDQRRLVYYEGGAVCTHARSLWRLEPLRISWSGSHLRWGQPLRVRHVTTGQYLALTEDQGLVVVDASKAHTKATSFCFRISKEKLDVAPKRDVEGMGPPEIKYGESLCFVQHVASGLWLTYAAPDPKALRLGVLKKKAMLHQEGHMDDALSLTRCQQEESQAARMIHSTNGLYNQFIKSLDSFSGKPRGSGPPAGTALPIEGVILSLQDLIIYFEPPSEDLQHEEKQSKLRSLRNRQSLFQEEGMLSMVLNCIDRLNVYTTAAHFAEFAGEEAAESWKEIVNLLYELLASLIRGNRSNCALFSTNLDWLVSKLDRLEASSGILEVLYCVLIESPEVLNIIQENHIKSIISLLDKHGRNHKVLDVLCSLCVCNGVAVRSNQDLITENLLPGRELLLQTNLINYVTSIRPNIFVGRAEGTTQYSKWYFEVMVDEVTPFLTAQATHLRVGWALTEGYTPYPGAGEGWGGNGVGDDLYSYGFDGLHLWTGHVARPVTSPGQHLLAPEDVISCCLDLSVPSISFRINGCPVQGVFESFNLDGLFFPVVSFSAGVKVRFLLGGRHGEFKFLPPPGYAPCHEAVLPRERLHLEPIKEYRREGPRGPHLVGPSRCLSHTDFVPCPVDTVQIVLPPHLERIREKLAENIHELWALTRIEQGWTYGPVRDDNKRLHPCLVDFHSLPEPERNYNLQMSGETLKTLLALGCHVGMADEKAEDNLKKTKLPKTYMMSNGYKPAPLDLSHVRLTPAQTTLVDRLAENGHNVWARDRVGQGWSYSAVQDIPARRNPRLVPYRLLDEATKRSNRDSLCQAVRTLLGYGYNIEPPDQEPSQVENQSRCDRVRIFRAEKSYTVQSGRWYFEFEAVTTGEMRVGWARPELRPDVELGADELAYVFNGHRGQRWHLGSEPFGRPWQPGDVVGCMIDLTENTIIFTLNGEVLMSDSGSETAFREIEIGDGFLPVCSLGPGQVGHLNLGQDVSSLRFFAICGLQEGFEPFAINMQRPVTTWFSKGLPQFEPVPLEHPHYEVSRVDGTVDTPPCLRLTHRTWGSQNSLVEMLFLRLSLPVQFHQHFRCTAGATPLAPPGLQPPAEDEARAAEPDPDYENLRRSAGGWSEAENGKEGTAKEGAPGGTPQAGGEAQPARAENEKDATTEKNKKRGFLFKAKKVAMMTQPPATPTLPRLPHDVVPADNRDDPEIILNTTTYYYSVRVFAGQEPSCVWAGWVTPDYHQHDMSFDLSKVRVVTVTMGDEQGNVHSSLKCSNCYMVWGGDFVSPGQQGRISHTDLVIGCLVDLATGLMTFTANGKESNTFFQVEPNTKLFPAVFVLPTHQNVIQFELGKQKNIMPLSAAMFQSERKNPAPQCPPRLEMQMLMPVSWSRMPNHFLQVETRRAGERLGWAVQCQEPLTMMALHIPEENRCMDILELSERLDLQRFHSHTLRLYRAVCALGNNRVAHALCSHVDQAQLLHALEDAHLPGPLRAGYYDLLISIHLESACRSRRSMLSEYIVPLTPETRAITLFPPGRSTENGHPRHGLPGVGVTTSLRPPHHFSPPCFVAALPAAGAAEAPARLSPAIPLEALRDKALRMLGEAVRDGGQHARDPVGASVEFQFVPVLKLVSTLLVMGIFGDEDVKQILKMIEPEVFTEEEEEEDEEEEGEEEDEEEKEEDEEETAQEKEDEEKEEEEAAEGEKEEGLEEGLLQMKLPESVKLQMCHLLEYFCDQELQHRVESLAAFAERYVDKLQANQRSRYGLLIKAFSMTAAETARRTREFRSPPQEQINMLLQFKDGTDEEDCPLPEEIRQDLLDFHQDLLAHCGIQLDGEEEEPEEETTLGSRLMSLLEKVRLVKKKEEKPEEERSAEESKPRSLQELVSHMVVRWAQEDFVQSPELVRAMFSLLHRQYDGLGELLRALPRAYTISPSSVEDTMSLLECLGQIRSLLIVQMGPQEENLMIQSIGNIMNNKVFYQHPNLMRALGMHETVMEVMVNVLGGGESKEIRFPKMVTSCCRFLCYFCRISRQNQRSMFDHLSYLLENSGIGLGMQGSTPLDVAAASVIDNNELALALQEQDLEKVVSYLAGCGLQSCPMLVAKGYPDIGWNPCGGERYLDFLRFAVFVNGESVEENANVVVRLLIRKPECFGPALRGEGGSGLLAAIEEAIRISEDPARDGPGIRRDRRREHFGEEPPEENRVHLGHAIMSFYAALIDLLGRCAPEMHLIQAGKGEALRIRAILRSLVPLEDLVGIISLPLQIPTLGKDGALVQPKMSASFVPDHKASMVLFLDRVYGIENQDFLLHVLDVGFLPDMRAAASLDTATFSTTEMALAVNRYLCLAVLPLITKCAPLFAGTEHRAIMVDSMLHTVYRLSRGRSLTKAQRDVIEDCLMSLCRYIRPSMLQHLLRRLVFDVPILNEFAKMPLKLLTNHYERCWKYYCLPTGWANFGVTSEEELHLTRKLFWGIFDSLAHKKYDPELYRMAMPCLCAIAGALPPDYVDASYSSKAEKKATVDAEGNFDPRPVETLNVIIPEKLDSFINKFAEYTHEKWAFDKIQNNWSYGENIDEELKTHPMLRPYKTFSEKDKEIYRWPIKESLKAMIAWEWTIEKAREGEEEKTEKKKTRKISQSAQTYDPREGYNPQPPDLSAVTLSRELQAMAEQLAENYHNTWGRKKKQELEAKGGGTHPLLVPYDTLTAKEKARDREKAQELLKFLQMNGYAVTRGLKDMELDSSSIEKRFAFGFLQQLLRWMDISQEFIAHLEAVVSSGRVEKSPHEQEIKFFAKILLPLINQYFTNHCLYFLSTPAKVLGSGGHASNKEKEMITSLFCKLAALVRHRVSLFGTDAPAVVNCLHILARSLDARTVMKSGPEIVKAGLRSFFESASEDIEKMVENLRLGKVSQARTQVKGVGQNLTYTTVALLPVLTTLFQHIAQHQFGDDVILDDVQVSCYRTLCSIYSLGTTKNTYVEKLRPALGECLARLAAAMPVAFLEPQLNEYNACSVYTTKSPRERAILGLPNSVEEMCPDIPVLERLMADIGGLAESGARYTEMPHVIEITLPMLCSYLPRWWERGPEAPPSALPAGAPPPCTAVTSDHLNSLLGNILRIIVNNLGIDEASWMKRLAVFAQPIVSRARPELLQSHFIPTIGRLRKRAGKVVSEEEQLRLEAKAEAQEGELLVRDEFSVLCRDLYALYPLLIRYVDNNRAQWLTEPNPSAEELFRMVGEIFIYWSKSHNFKREEQNFVVQNEINNMSFLTADNKSKMAKAGDIQSGGSDQERTKKKRRGDRYSVQTSLIVATLKKMLPIGLNMCAPTDQDLITLAKTRYALKDTDEEVREFLHNNLHLQGKVEGSPSLRWQMALYRGVPGREEDADDPEKIVRRVQEVSAVLYYLDQTEHPYKSKKAVWHKLLSKQRRRAVVACFRMTPLYNLPTHRACNMFLESYKAAWILTEDHSFEDRMIDDLSKAGEQEEEEEEVEEKKPDPLHQLVLHFSRTALTEKSKLDEDYLYMAYADIMAKSCHLEEGGENGEAEEEVEVSFEEKQMEKQRLLYQQARLHTRGAAEMVLQMISACKGETGAMVSSTLKLGISILNGGNAEVQQKMLDYLKDKKEVGFFQSIQALMQTCSVLDLNAFERQNKAEGLGMVNEDGTVINRQNGEKVMADDEFTQDLFRFLQLLCEGHNNDFQNYLRTQTGNTTTINIIICTVDYLLRLQESISDFYWYYSGKDVIEEQGKRNFSKAMSVAKQVFNSLTEYIQGPCTGNQQSLAHSRLWDAVVGFLHVFAHMMMKLAQDSSQIELLKELLDLQKDMVVMLLSLLEGNVVNGMIARQMVDMLVESSSNVEMILKFFDMFLKLKDIVGSEAFQDYVTDPRGLISKKDFQKAMDSQKQFSGPEIQFLLSCSEADENEMINCEEFANRFQEPARDIGFNVAVLLTNLSEHVPHDPRLHNFLELAESILEYFRPYLGRIEIMGASRRIERIYFEISETNRAQWEMPQVKESKRQFIFDVVNEGGEAEKMELFVSFCEDTIFEMQIAAQISEPEGEPETDEDEGAGAAEAGAEGAEEGAAGLEGTAATAAAGATARVVAAAGRALRGLSYRSLRRRVRRLRRLTAREAATAVAALLWAAVTRAGAAGAGAAAGALGLLWGSLFGGGLVEGAKKVTVTELLAGMPDPTSDEVHGEQPAGPGGDADGEGASEGAGDAAEGAGDEEEAVHEAGPGGADGAVAVTDGGPFRPEGAGGLGDMGDTTPAEPPTPEGSPILKRKLGVDGVEEELPPEPEPEPEPELEPEKADAENGEKEEVPEPTPEPPKKQAPPSPPPKKEEAGGEFWGELEVQRVKFLNYLSRNFYTLRFLALFLAFAINFILLFYKVSDSPPGEDDMEGSAAGDVSGAGSGGSSGWGLGAGEEAEGDEDENMVYYFLEESTGYMEPALRCLSLLHTLVAFLCIIGYNCLKVPLVIFKREKELARKLEFDGLYITEQPEDDDVKGQWDRLVLNTPSFPSNYWDKFVKRKVLDKHGDIYGRERIAELLGMDLATLEITAHNERKPNPPPGLLTWLMSIDVKYQIWKFGVIFTDNSFLYLGWYMVMSLLGHYNNFFFAAHLLDIAMGVKTLRTILSSVTHNGKQLVMTVGLLAVVVYLYTVVAFNFFRKFYNKSEDEDEPDMKCDDMMTCYLFHMYVGVRAGGGIGDEIEDPAGDEYELYRVVFDITFFFFVIVILLAIIQGLIIDAFGELRDQQEQVKEDMETKCFICGIGSDYFDTTPHGFETHTLEEHNLANYMFFLMYLINKDETEHTGQESYVWKMYQERCWDFFPAGDCFRKQYEDQLS

SEQ ID NO: 58311 - protein, 993 aa, Homo sapiens
MGSGRVPGLCLLVLLVHARAAQYSKAAQDVDECVEGTDNCHIDAICQNTPRSYKCICKSGYTGDGKHCKDVDECEREDNAGCVHDCVNIPGNYRCTCYDGFHLAHDGHNCLDVDECAEGNGGCQQSCVNMMGSYECHCREGFFLSDNQHTCIQRPEEGMNCMNKNHGCAHICRETPKGGIACECRPGFELTKNQRDCKLTCNYGNGGCQHTCDDTEQGPRCGCHIKFVLHTDGKTCIETCAVNNGGCDSKCHDAATGVHCTCPVGFMLQPDRKTCKDIDECRLNNGGCDHICRNTVGSFECSCKKGYKLLINERNCQDIDECSFDRTCDHICVNTPGSFQCLCHRGYLLYGITHCGDVDECSINRGGCRFGCINTPGSYQCTCPAGQGRLHWNGKDCTEPLKCQGSPGASKAMLSCNRSGKKDTCALTCPSRARFLPESENGFTVSCGTPSPRAAPARAGHNGNSTNSNHCHEAAVLSIKQRASFKIKDAKCRLHLRNKGKTEEAGRITGPGGAPCSECQVTFIHLKCDSSRKGKGRRARTPPGKEVTRLTLELEAEVRAEETTASCGLPCLRQRMERRLKGSLKMLRKSINQDRFLLRLAGLDYELAHKPGLVAGERAEPMESCRPGQHRAGTKCVSCPQGTYYHGQTEQCVPCPAGTFQEREGQLSCDLCPGSDAHGPLGATNVTTCAGQCPPGQHSVDGFKPCQPCPRGTYQPEAGRTLCFPCGGGLTTKHEGAISFQDCDTKVQCSPGHYYNTSIHRCIRCAMGSYQPDFRQNFCSRCPGNTSTDFDGSTSVAQCKNRQCGGELGEFTGYIESPNYPGNYPAGVECIWNINPPPKRKILIVVPEIFLPSEDECGDVLVMRKNSSPSSITTYETCQTYERPIAFTARSRKLWINFKTSEANSARGFQIPYVTYDEDYEQLVEDIVRDGRLYASENHQEILKDKKLIKAFFEVLAHPQNYFKYTEKHKEMLPKSFIKLLRSKVSSFLRPYK

SEQ ID NO: 58312 - protein, 304 aa, Homo sapiens
METVPPAVDLVLGASACCLACVFTNPLEVVKTRLQLQGELQARGTYPRPYHGFIASVAAVARADGLWGLQKGLAAGLLYQGLMNGVRFYCYSLACQAGLTQQPGGTVVAGAVAGALGAFVGSPAYLIKTQLQAQTVAAVAVGHQHNHQTVLGALETIWRQQGLLGLWQGVGGAVPRVMVGSAAQLATFASAKAWVQKQQWLPEDSWLVALAGGMISSIAVVVVMTPFDVVSTRLYNQPVDTAGRGQLYGGLTDCMVKIWRQEGPLALYKGLGPAYLRLGPHTILSMLFWDELRKLAGRAQHKGT

SEQ ID NO: 58313 - protein, 31 aa, Homo sapiens
MGINTRELFLNFTIVLITVILMWLLVRSYQY

SEQ ID NO: 58314 - protein, 518 aa, Homo sapiens
MTEKALCDSMFFKAKARTYRGASEMEQKEGKLSEDGTTVSPAADNPEMSGGGAPAEETKGTAGKAINEGPPTESGKQEKAPAEDGMSAELQGEANGLDEVKVESQREAGGKEDAEAELKKEDGEKEETTVGSQEMTGRKEETKSEPKEAEEKESTLASEKQKAEEKEAKPESGQKADANDRDKPEPKATVEEEDAKTASQEETGQRKECSTEPKEKATDEEAKAESQKAVVEDEAKAEPKEPDGKEEAKHGAKEEADAKEEAEDAEEAEPGSPSEEQEQDVEKEPEGGAGVIPSSPEEWPESPTGEGHNLSTDGLGPDCVASGQTSPSASESSPSDVPQSPPESPSSGEKKEKAPERRVSAPARPRGPRAQNRKAIVDKFGGAASGPTALFRNTKAAGAAIGGVKNMLLEWCRAMTKKYEHVDIQNFSSSWSSGMAFCALIHKFFPDAFDYAELDPAKRRHNFTLAFSTAEKLADCAQLLDVDDMVRLAVPDSKCVYTYIQELYRSLVQKGLVKTKKK

SEQ ID NO: 58315 - protein, 518 aa, Homo sapiens; identical to SEQ ID NO: 58314

SEQ ID NO: 58316 - protein, 664 aa, Homo sapiens
MKTGPFFLCLLGTAAAIPTNARLLSDHSKPTAETVAPDNTAIPSLWAEAEENEKETAVSTEDDSHHKAEKSSVLKSKEESHEQSAEQGKSSSQELGLKDQEDSDGHLSVNLEYAPTEGTLDIKEDMIEPQEKKLSENTDFLAPGVSSFTDSNQQESITKREENQEQPRNYSHHQLNRSSKHSQGLRDQGNQEQDPNISNGEEEEEKEPGEVGTHNDNQERKTELPREHANSKQEEDNTQSDDILEESDQPTQVSKMQEDEFDQGNQEQEDNSNAEMEEENASNVNKHIQETEWQSQEGKTGLEAISNHKETEEKTVSEALLMEPTDDGNTTPRNHGVDDDGDDDGDDGGTDGPRHSASDDYFIPSQAFLEAERAQSIAYHLKIEEQREKVHENENIGTTEPGEHQEAKKAENSSNEEETSSEGNMRVHAVDSCMSFQCKRGHICKADQQGKPHCVCQDPVTCPPTKPLDQVCGTDNQTYASSCHLFATKCRLEGTKKGHQLQLDYFGACKSIPTCTDFEVIQFPLRMRDWLKNILMQLYEANSEHAGYLNEKQRNKVKKIYLDEKRLLAGDHPIDLLLRDFKKNYHMYVYPVHWQFSELDQHPMDRVLTHSELAPLRASLVPMEHCITRFFEECDPNKDKHITLKEWGHCFGIKEEDIDENLLF

SEQ ID NO: 58317 - protein, 364 aa, Homo sapiens
MTEKEVLESPKPSFPAETRQSGLQRLKQLLRKGSTGTKEMELPPEPQANGEAVGAGGGPIYYIYEEEEEEEEEEEEPPPEPPKLVNDKPHKFKDHFFKKPKFCDVCARMIVLNNKFGLRCKNCKTNIHEHCQSYVEMQRCFGKIPPGFHRAYSSPLYSNQQYACVKDLSAANRNDPVFETLRTGVIMANKERKKGQADKKNPVAAMMEEEPESARPEEGKPQDGNPEGDKKAEKKTPDDKHKQPGFQQSHYFVALYRFKALEKDDLDFPPGEKITVIDDSNEEWWRGKIGEKVGFFPPNFIIRVRAGERVHRVTRSFVGNREIGQITLKKDQIVVQKGDEAGGYVKVYTGRKVGLFPTDFLEEI

SEQ ID NO: 58318 - protein, 567 aa, Homo sapiens
MSASTGGGGDSGGSGGSSSSSQASCGPESSGSELALATPVPQMLQGLLGSDDEEQEDPKDYCKGGYHPVKIGDVFNGRYHVVRKLGWGHFSTVWLCWDIQRKRFVALKVVKSAGHYTETAVDEIKLLKCVRDSDPSDPKRETIVQLIDDFRISGVNGVHVCMVLEVLGHQLLKWIIKSNYQGLPVPCVKSIVRQVLHGLDYLHTKCKIIHTDIKPENILLCVGDAYIRRLAAEATEWQQAGAPPPSRSIVSTAPQEVLQTGKLSKNKRKKMRRKRKQQKRLLEERLRDLQRLEAMEAATQAEDSGLRLDGGSGSTSSSGCHPGGARAGPSPASSSPAPGGGRSLSAGSQTSGFSGSLFSPASCSILSGSSNQRETGGLLSPSTPFGASNLLVNPLEPQNADKIKIKIADLGNACWVHKHFTEDIQTRQYRAVEVLIGAEYGPPADIWSTACMAFELATGDYLFEPHSGEDYSRDEDHIAHIVELLGDIPPAFALSGRYSREFFNRRGELRHIHNLKHWGLYEVLMEKYEWPLEQATQFSAFLLPMMEYIPEKRASAADCLQHPWLNP

SEQ ID NO: 58319 - protein, 827 aa, Homo sapiens
MHGEKGIWQHFQREGEALLDFKSRERAHCQRNSLIKAASFMATAVAGLGLRLSDCVTLSPRVPQTGGGSLRPASYSPRLPAPSPSAPLYPQSARPSAAPFGTEVSRCPARRRSRVTAASSAPQRRPPGVRRPRRSGSASRASPGSPRSSLSARPARSLRFVSRAQSAEPSGARWAVAWATPNAARALTRVRWPAHSRTMTAEGPSPPARWHRRLPGLWAAALLLLGLPRLSVRADGKFFVLESQNGSQGLQLEAARLSCKSRGAHLASADELRRVVQDCSFAVCTTGWLADGTLGTTVCSKGSGEQQIMRAVDVRIESNPVPGGTYSALCIKDEEKPCGDPPSFPHTILQGRTGLEMGDELLYVCAPGHIMGHRETAFTLLCNSCGEWYGLVQACGKDEAEAHIDYEDNFPDDRSVSFRELMEDSRTEADEDRGQGDSSEEAPKQDRLVSISVGRENIARDKVFVPTTGLPGAGSSVPADSPGSRLLQKHLFWFPAEAFHKPGLEKEVDDDTKKQFSAGDNHSGVKLVPGEPETKVIYGNTDGPSGPFVGKNDSKAGDPVVSSSDESWLDGYPVTEGAWRKTEAEEEEDGDRGDGSVGLDENVLVTPDQPILVEVKKPKSSTLTPSEGMTHSSVLPSQMLDVEALALRPVNASETEGIGDGDLTKYQSTLPWRFITEESPMATLSYELTSSTLEILTVNTVKQTPNHIPSTIMATTQPPVETTVPEIQDSFPYLLSEDFFGQEGPGPGASEELHPTLESCVGDGCPGLSRGPVIATIVTVLCLLLLLAGVGMVWGYRKCQHKSSVYKLNVGQRQARHYHQQIEMEKV

SEQ ID NO: 58320 - protein, 903 aa, Homo sapiens
MEGYSEEASLLRHLEKVASEEEEVPLVVYLKENAALLTANGLHLSQNREAQQSSPAPPPAEVHSPAADVNQNLASPSATLTTPTSNSSHNPPATDVNQNPPATVVPQSLPLSSIQQNSSEAQLPSNGTGPASKPSTLCADGQPQAPAEEVRCSTLLIDKVSTPATTTSTFSREATLIPSSRPPASDFMSSSLLIDIQPNTLVVSADQEMSGRAAATTPTKVYSEVHFTLAKPPSVVNRTARPFGIQAPGGTSQMERSPMLERRHFGEKAPAPQPPSLPDRSPRPQRHIMSRSPMVERRMMGQRSPASERRPLGNFTAPPTYTETLSTAPLASWVRSPPSYSVLYPSSDPKSSHLKGQAVPASKTGILEESMARRGSRKSMFTFVEKPKVTPNPDLLDLVQTADEKRRQRDQGEVGVEEEPFALGAEASNFQQEPAPRDRASPAAAEEVVPEWASCLKSPRIQAKPKPKPNQNLSEASGKGAELYARRQSRMEKYVIESSSHTPELARCPSPTMSLPSSWKYPTNAPGAFRVASRSPARTPPASLYHGYLPENGVLRPEPTKQPPYQLRPSLFVLSPIKEPAKVSPRAASPAKPSSLDLVPNLPKGALPPSPALPRPSRSSPGLYTSPGQDSLQPTAVSPPYGGDISPVSPSRAWSPRAKQAPRPSFSTRNAGIEAQDRRESLPTSPPWTPGASRPPSSLDGWVSPGPWEPGRGSSMSSPPPLPPPPPMSPSWSERSVSPLRPETEARPPSRQLQALLARNIINAARRKSASPRSAGAENPRPFSPPRAPPPPPPPPPPPPRMRSPQPARPGSAAVPGAAFAPIPRSPLPAGPSSCTSPRSPLPAPPRPFLYRRSPTDSDVSLDSEDSGAKSPGILGYNICPRGWNGSLRLKRGSLPAEASCTT

SEQ ID NO: 58321 - protein, 110 aa, Homo sapiens
MRLSCPRAPGWMGPFFPYSLLSFFPCSFSSPSFIFLLLILKTGCSLFPCCPISPLCPYFSQSLSPLKSRAGRCYWCFFTLGPSSIFVFSVYPLPDTSFSPSLGPKAENQC

SEQ ID NO: 58322 - protein, 299 aa, Homo sapiens
MELLSALSLGELALSFSRVPLFPVFDLSYFIVSILYLKYEPGAVELSRRHPIASWLCAMLHCFGSYILADLLLGEPLIDYFSNNSSILLASAVWYLIFFCPLDLFYKCVCFLPVKLIFVAMKEVVRVRKIAVGIHHAHHHYHHGWFVMIATGWVKGSGVALMSNFEQLLRGVWKPETNEILHMSFPTKASLYGAILFTLQQTRWLPVSKASLIFIFTLFMVSCKVFLTATHSHSSPFDALEGYICPVLFGSACGGDHHHDNHGGSHSGGGPGAQHSAMPAKSKEELSEGSRKKKAKKAD

SEQ ID NO: 58323 - protein, 345 aa, Homo sapiens
MSSYQKELEKYRDIDEDEILRTLSPEELEQLDCELQEMDPENMLLPAGLRQRDQTKKSPTGPLDREALLQYLEQQALEVKERDDLVPFTGEKKGKPYIQPKREIPAEEQITLEPELEEALAHATDAEMCDIAAILDMYTLMSNKQYYDALCSGEICNTEGISSVVQPDKYKPVPDEPPNPTNIEEILKRVRSNDKELEEVNLNNIQDIPIPMLSELCEAMKANTYVRSFSLVATRSGDPIANAVADMLRENRSLQSLNIESNFISSTGLMAVLKAVRENATLIELRVDNQRQWPGDAVEMEMATVLEQCPSIVRFGYHFTQQGPRARAAQAMTRNNELRRQQKKR

SEQ ID NO: 58324 - protein, 160 aa, Homo sapiens
MTDQQAEARSYLSEEMIAEFKAAFDMFDADGGGDISVKELGTVMRMLGQTPTKEELDAIIEEVDEDGSGTIDFEEFLVMMVRQMKEDAKGKSEEELAECFRIFDRNADGYIDPEELAEIFRASGEHVTDEEIESLMKDGDKNNDGRIDFDEFLKMMEGVQ

SEQ ID NO: 58325 - protein, 187 aa, Homo sapiens
MPEVERKPKITASRKLLLKSLMLAKAKECWEQEHEEREAEKVRYLAERIPTLQTRGLSLSALQDLCRELHAKVEVVDEERYDIEAKCLHNTREIKDLKLKVMDLRGKFKRPPLRRVRVSADAMLRALLGSKHKVSMDLRANLKSVKKEDTEKERPVEVGDWRKNVEAMSGMEGRKKMFDAAKSPTSQ

SEQ ID NO: 58326 - protein, 182 aa, Homo sapiens
MGDEEKRNRAITARRQHLKSVMLQIAATELEKEESRREAEKQNYLAEHCPPLHIPGSMSEVQELCKQLHAKIDAAEEEKYDMEVRVQKTSKELEDMNQKLFDLRGKFKRPPLRRVRMSADAMLKALLGSKHKVCMDLRANLKQVKKEDTEKERDLRDVGDWRKNIEEKSGMEGRKKMFESES

SEQ ID NO: 58327 - protein, 278 aa, Homo sapiens
MSDTEEQEYEEEQPEEEAADEEEEAPEEPEPVAEPEEERPKPSRPVVPPLIPPKIPEGERVDFDDIHRKRMEKDLLELQTLIDVHFEQRKKEEEELVALKERIERRRSERAEQQRFRTEKERERQAKLAEEKMRKEEEEAKKRAEDDAKKKKVLSNMGAHFGGYLVKAEQKRGKRQTGREMKVRILSERKKPLDIDYMGEEQLRARSAWLPPSQPSCPAREKAQELSDWIHQLESEKFDLMAKLKQQKYEINVLYNRISHAQKFRKGAGKGRVGGRWK

SEQ ID NO: 58328 - protein, 258 aa, Homo sapiens
MSDEEVEQVEEQYEEEEEAQEEEEVQEDTAEEDAEEEKPRPKLTAPKIPEGEKVDFDDIQKKRQNKDLMELQALIDSHFEARKKEEEELVALKERIEKRRAERAEQQRIRAEKERERQNRLAEEKARREEEDAKRRAEDDLKKKKALSSMGANYSSYLAKADQKRGKKQTAREMKKKILAERRKPLNIDHLGEDKLRDKAKELWETLHQLEIDKFEFGEKLKRQKYDITTLRSRIDQAQKHSKKAGTPAKGKVGGRWK

SEQ ID NO: 58329 - protein, 400 aa, Homo sapiens
MNFTVGFKPLLGDAHSMDNLEKQLICPICLEMFSKPVVILPCQHNLCRKCANDVFQASNPLWQSRGSTTVSSGGRFRCPSCRHEVVLDRHGVYGLQRNLLVENIIDIYKQESSRPLHSKAEQHLMCEEHEEEKINIYCLSCEVPTCSLCKVFGAHKDCEVAPLPTIYKRQKKQDLTLLPRLECSGTNTTYCSLDLPSSSDPPILASQNTKIIDSELSDGIAMLVAGNDRVQAVITQMEEVCQTIEDNSRRQKQLLNQRFESLCAVLEERKGELLQALAREQEEKLQRVRGLIRQYGDHLEASSKLVESAIQSMEEPQMALYLQQAKELINKVGAMSKVELAGRPEPGYESMEQFTVRVEHVAEMLRTIDFQPGASGEEEEVAPDGEEGSAGPEEERPDGP

SEQ ID NO: 58330 - protein, 358 aa, Homo sapiens
MNFTVGFKPLLGDAHSMDNLEKQLICPICLEMFSKPVVILPCQHNLCRKCANDVFQASNPLWQSRGSTTVSSGGRFRCPSCRHEVVLDRHGVYGLQRNLLVENIIDIYKQESSRPLHSKAEQHLMCEEHEEEKINIYCLSCEVPTCSLCKVFGAHKDCEVAPLPTIYKRQKSELSDGIAMLVAGNDRVQAVITQMEEVCQTIEDNSRRQKQLLNQRFESLCAVLEERKGELLQALAREQEEKLQRVRGLIRQYGDHLEASSKLVESAIQSMEEPQMALYLQQAKELINKVGAMSKVELAGRPEPGYESMEQFTVRVEHVAEMLRTIDFQPGASGEEEEVAPDGEEGSAGPEEERPDGP

SEQ ID NO: 58331 - protein, 143 aa, Homo sapiens
MSCLDVMYQVYGPPQPYFAAAYTPYHQKLAYYSKMQEAQECNASPSSSGSGSSSFSSQTPASIKEEEGSPEKERPPEAEYINSRCVLFTYFQGDISSVVDEHFSRALSQPSSYSPSCTSSKAPRSSGPWRARRYSLCGASLLS

SEQ ID NO: 58332 - protein, 317 aa, Homo sapiens
MSCLDVMYQVYGPPQPYFAAAYTPYHQKLAYYSKMQEAQECNASPSSSGSGSSSFSSQTPASIKEEEGSPEKERPPEAEYINSRCVLFTYFQGDISSVVDEHFSRALSQPSSYSPSCTSSKAPRSSGPWRDCSFPMSQRSFPASFWNSAYQAPVPPPLGSPLATAHSELPFAAADPYSPAALHGHLHQGATEPWHHAHPHHAHPHHPYALGGALGAQAAPYPRPAAVHEVYAPHFDPRYGPLLMPAASGRPARLATAPAPAPGSPPCELSGKGEPAGAAWAGPGGPFASPSGDVAQGLGLSVDSARRYSLCGASLLS

SEQ ID NO: 58333 - DNA, 20 bp, Homo sapiens
gatcagttggatattaaacc

SEQ ID NO: 58334 - DNA, 20 bp, Homo sapiens
gatcaccgcgctggcaccca

SEQ ID NO: 58335 - DNA, 20 bp, Homo sapiens
gatcatcgccccgccggagc

SEQ ID NO: 58336 - DNA, 20 bp, Homo sapiens
gatccacaccgagtatttgc

SEQ ID NO: 58337 - DNA, 20 bp, Homo sapiens
gatcccagggtacatcgtgg

SEQ ID NO: 58338 - DNA, 20 bp, Homo sapiens
gatcgcggcccgccaggtcc

SEQ ID NO: 58339 - DNA, 20 bp, Homo sapiens
gatcgctgaccgcatgcaga

SEQ ID NO: 58340 - DNA, 20 bp, Homo sapiens
gatcgtgcgcgacatcaagg

SEQ ID NO: 58341 - DNA, 20 bp, Homo sapiens
gatctcaccgactacctgat

SEQ ID NO: 58342 - DNA, 20 bp, Homo sapiens
gatctcgcgctcagctgtgg

SEQ ID NO: 58343 - DNA, 20 bp, Homo sapiens
gatctctttctgcatgcggt

SEQ ID NO: 58344 - DNA, 20 bp, Homo sapiens
gatcttcatcaggtagtcgg

SEQ ID NO: 58345 - DNA, 20 bp, Homo sapiens
gatcaagatgtgctagcagg

SEQ ID NO: 58346 - DNA, 20 bp, Homo sapiens
gatcctcctaatttcctatt

SEQ ID NO: 58347 - DNA, 20 bp, Homo sapiens
gatctagggacagaaggaaa

SEQ ID NO: 58348 - DNA, 20 bp, Homo sapiens
gatctgtgatgctgagcttc

SEQ ID NO: 58349 - DNA, 20 bp, Homo sapiens
gatctgttgaatgttcattc

SEQ ID NO: 58350 - DNA, 20 bp, Homo sapiens
gatcagccacagggtgcatc

SEQ ID NO: 58351 - DNA, 20 bp, Homo sapiens
gatctttattcagaagcact

SEQ ID NO: 58352 - DNA, 20 bp, Homo sapiens
gatcccaacaggccctggca

SEQ ID NO: 58353 - DNA, 20 bp, Homo sapiens
gatccatttctgatatgtct

SEQ ID NO: 58354 - DNA, 20 bp, Homo sapiens
gatcattagccctttctgaa

SEQ ID NO: 58355 - DNA, 20 bp, Homo sapiens
gatctcactgtctacagatg

SEQ ID NO: 58356 - DNA, 20 bp, Homo sapiens
gatcgctctacatgacattc

SEQ ID NO: 58357 - DNA, 20 bp, Homo sapiens
gatctgggaggagcgtcacc

SEQ ID NO: 58358 - DNA, 20 bp, Homo sapiens
gatctgtcggaaccaggaca

SEQ ID NO: 58359 - DNA, 20 bp, Homo sapiens
gatcttttcttgactctccc

SEQ ID NO: 58360 - DNA, 20 bp, Homo sapiens
gatcaagcagggtgggtgca

SEQ ID NO: 58361 - DNA, 20 bp, Homo sapiens
gatcccacctgggaggccag

SEQ ID NO: 58362 - DNA, 20 bp, Homo sapiens
gatcgggagcacccccctgc

SEQ ID NO: 58363 - DNA, 20 bp, Homo sapiens
gatccaggctgctctgaaga

SEQ ID NO: 58364 - DNA, 20 bp, Homo sapiens
gatcttctccctcctgcagc

SEQ ID NO: 58365 - DNA, 20 bp, Homo sapiens
gatcatgtattcagataaat

SEQ ID NO: 58366 - DNA, 20 bp, Homo sapiens
gatcaaggctcgggacatcg

SEQ ID NO: 58367 - DNA, 20 bp, Homo sapiens
gatcatcggcagggggtcaa

SEQ ID NO: 58368 - DNA, 20 bp, Homo sapiens
gatccagaagatgaaagaag

SEQ ID NO: 58369 - DNA, 20 bp, Homo sapiens
gatccgagaccaaatggctg

SEQ ID NO: 58370 - DNA, 20 bp, Homo sapiens
gatccgccagctaatgaaga

SEQ ID NO: 58371 - DNA, 20 bp, Homo sapiens
gatctcactgccagtcattg

SEQ ID NO: 58372 - DNA, 20 bp, Homo sapiens
gatctggcactgccgtggcc

SEQ ID NO: 58373 - DNA, 20 bp, Homo sapiens
gatctgtgacacgggctcag

SEQ ID NO: 58374 - DNA, 20 bp, Homo sapiens
gatcaggagggttgaacccc

SEQ ID NO: 58375 - DNA, 20 bp, Homo sapiens
gatcaagaaaaggcccactt

SEQ ID NO: 58376 - DNA, 20 bp, Homo sapiens
gatcagaaaatagctttcag

SEQ ID NO: 58377 - DNA, 20 bp, Homo sapiens
gatcctgaccaccctctggg

SEQ ID NO: 58378 - DNA, 20 bp, Homo sapiens
gatctcctgagaggccgtcc

SEQ ID NO: 58379 - DNA, 20 bp, Homo sapiens
gatcacttcatatcattaca

SEQ ID NO: 58380 - DNA, 20 bp, Homo sapiens
gatcactctagacctgtcaa

SEQ ID NO: 58381 - DNA, 20 bp, Homo sapiens
gatctggttgtctaccagaa

SEQ ID NO: 58382 - DNA, 20 bp, Homo sapiens
gatcacagcagccactgata

SEQ ID NO: 58383 - DNA, 20 bp, Homo sapiens
gatcaccagaaccaataaag

SEQ ID NO: 58384 - DNA, 20 bp, Homo sapiens
gatcactagaacacaaaaga

SEQ ID NO: 58385 - DNA, 20 bp, Homo sapiens
gatcagtacaactgctttga

SEQ ID NO: 58386 - DNA, 20 bp, Homo sapiens
gatcatataacaattaaaca

SEQ ID NO: 58387 - DNA, 20 bp, Homo sapiens
gatcattcattccagcctcc

SEQ ID NO: 58388 - DNA, 20 bp, Homo sapiens
gatccagcagcctcatttga

SEQ ID NO: 58389 - DNA, 20 bp, Homo sapiens
gatctctgtaataatcatct

SEQ ID NO: 58390 - DNA, 20 bp, Homo sapiens
gatcttcatacacctctact

SEQ ID NO: 58391 - DNA, 20 bp, Homo sapiens
gatcttggtgaccacatctc

SEQ ID NO: 58392 - DNA, 20 bp, Homo sapiens
gatcatggcaacagagctac

SEQ ID NO: 58393 - DNA, 20 bp, Homo sapiens
gatccacgcaccaaccccct

SEQ ID NO: 58394 - DNA, 20 bp, Homo sapiens
gatcacctctcccaaggtac

SEQ ID NO: 58395 - DNA, 20 bp, Homo sapiens
gatcgagtactattactcct

SEQ ID NO: 58396 - DNA, 20 bp, Homo sapiens
gatctgatttgggattaaag

SEQ ID NO: 58397 - DNA, 20 bp, Homo sapiens
gatccagtaggtgcagctgc

SEQ ID NO: 58398 - DNA, 20 bp, Homo sapiens
gatcaacacagaggacgatg

SEQ ID NO: 58399 - DNA, 20 bp, Homo sapiens
gatcagcttcctctgcgaag

SEQ ID NO: 58400 - DNA, 20 bp, Homo sapiens
gatcagtgtctcagcaccca

SEQ ID NO: 58401 - DNA, 20 bp, Homo sapiens
gatccccctcatttgatgag

SEQ ID NO: 58402 - DNA, 20 bp, Homo sapiens
gatcatgtttaagtgactcc

SEQ ID NO: 58403 - DNA, 20 bp, Homo sapiens
gatcatttgccaagaggcag

SEQ ID NO: 58404 - DNA, 20 bp, Homo sapiens
gatcatctcctgcagctcct

SEQ ID NO: 58405 - DNA, 20 bp, Homo sapiens
gatcaaacaccccgaggtga

SEQ ID NO: 58406 - DNA, 20 bp, Homo sapiens
gatcagcgttggacacgtca

SEQ ID NO: 58407 - DNA, 20 bp, Homo sapiens
gatcatgtcgtcaatggact

SEQ ID NO: 58408 - DNA, 20 bp, Homo sapiens
gatccccgcccagaagtagg

SEQ ID NO: 58409 - DNA, 20 bp, Homo sapiens
gatccgagatgatggggtca

SEQ ID NO: 58410 - DNA, 20 bp, Homo sapiens
gatcctcacccgcctgcgtc

SEQ ID NO: 58411 - DNA, 20 bp, Homo sapiens
gatcctcctcgttcacccac

SEQ ID NO: 58412 - DNA, 20 bp, Homo sapiens
gatcggctgggctcgtccga

SEQ ID NO: 58413 - DNA, 20 bp, Homo sapiens
gatctcctcaatcttctgca

SEQ ID NO: 58414 - DNA, 20 bp, Homo sapiens
gatctcctcgaacttggggt

SEQ ID NO: 58415 - DNA, 20 bp, Homo sapiens
gatcctttgaccccctccca

SEQ ID NO: 58416 - DNA, 20 bp, Homo sapiens
gatcagaaaaaagtaatggt

SEQ ID NO: 58417 - DNA, 20 bp, Homo sapiens
gatctgacagagggaaactt

SEQ ID NO: 58418 - DNA, 20 bp, Homo sapiens
gatcactgtcccacttgagg

SEQ ID NO: 58419 - DNA, 20 bp, Homo sapiens
gatcacttgtgccttacaga

SEQ ID NO: 58420 - DNA, 20 bp, Homo sapiens
gatctacacttgagttggga

SEQ ID NO: 58421 - DNA, 20 bp, Homo sapiens
gatcttttaatttaggaaag

SEQ ID NO: 58422 - DNA, 20 bp, Homo sapiens
gatccgctccttcagctcca

SEQ ID NO: 58423 - DNA, 20 bp, Homo sapiens
gatcactaggaatgttttca

SEQ ID NO: 58424 - DNA, 20 bp, Homo sapiens
gatcatgtagtaaatgtagg

SEQ ID NO: 58425 - DNA, 20 bp, Homo sapiens
gatcctagatgtcataagcc

SEQ ID NO: 58426 - DNA, 20 bp, Homo sapiens
gatcggagagaaaaaaaaaa

SEQ ID NO: 58427 - DNA, 20 bp, Homo sapiens
gatctcccggagaacaggcc

SEQ ID NO: 58428 - DNA, 20 bp, Homo sapiens
gatccacaaggacatgaccc

SEQ ID NO: 58429 - DNA, 20 bp, Homo sapiens
gatccctgacccttggccca

SEQ ID NO: 58430 - DNA, 20 bp, Homo sapiens
gatccaagcgtctcgaggat

SEQ ID NO: 58431 - DNA, 20 bp, Homo sapiens
gatcgcagcgtgcgtttccc

SEQ ID NO: 58432 - DNA, 20 bp, Homo sapiens
gatctgcccgcctcggcctt

SEQ ID NO: 58433 - DNA, 20 bp, Homo sapiens
gatcaacgggggctcccatg

SEQ ID NO: 58434 - DNA, 20 bp, Homo sapiens
gatcaagactggcgccccct

SEQ ID NO: 58435 - DNA, 20 bp, Homo sapiens
gatcaccaccttgtctgggt

SEQ ID NO: 58436 - DNA, 20 bp, Homo sapiens
gatccaggcgtgcaaactgg

SEQ ID NO: 58437 - DNA, 20 bp, Homo sapiens
gatcccgcacggcacatcac

SEQ ID NO: 58438 - DNA, 20 bp, Homo sapiens
gatccgcaacgcttagtttc

SEQ ID NO: 58439 - DNA, 20 bp, Homo sapiens
gatcctcatgagttggttgt

SEQ ID NO: 58440 - DNA, 20 bp, Homo sapiens
gatcgaggaggctcttgggg

SEQ ID NO: 58441 - DNA, 20 bp, Homo sapiens
gatcgtacttcccattgcga

SEQ ID NO: 58442 - DNA, 20 bp, Homo sapiens
gatctggttgaccttcagca

SEQ ID NO: 58443 - DNA, 20 bp, Homo sapiens
gatctgtcctgtgcagagcc

SEQ ID NO: 58444 - DNA, 20 bp, Homo sapiens
gatcttccaatattgactgc

SEQ ID NO: 58445 - DNA, 20 bp, Homo sapiens
gatcaggagcccactgataa

SEQ ID NO: 58446 - DNA, 20 bp, Homo sapiens
gatcttcctaaagaaatgct

SEQ ID NO: 58447 - DNA, 20 bp, Homo sapiens
gatccacttagagcaataac

SEQ ID NO: 58448 - DNA, 20 bp, Homo sapiens
gatctcatggttctgatgat

SEQ ID NO: 58449 - DNA, 20 bp, Homo sapiens
gatcgaatacccactctgat

SEQ ID NO: 58450 - DNA, 20 bp, Homo sapiens
gatcatgtcttctgctttca

SEQ ID NO: 58451 - DNA, 20 bp, Homo sapiens
gatcattagccataagaaac

SEQ ID NO: 58452 - DNA, 20 bp, Homo sapiens
gatcgaatccatccgcttgt

SEQ ID NO: 58453 - DNA, 20 bp, Homo sapiens
gatcgtttcagtaatatgct

SEQ ID NO: 58454 - DNA, 20 bp, Homo sapiens
gatcaaagaggcaaagtgct

SEQ ID NO: 58455 - DNA, 20 bp, Homo sapiens
gatcagccagcaaaactccc

SEQ ID NO: 58456 - DNA, 20 bp, Homo sapiens
gatcattttttctctggagg

SEQ ID NO: 58457 - DNA, 20 bp, Homo sapiens
gatccagccagtcttcctca

SEQ ID NO: 58458 - DNA, 20 bp, Homo sapiens
gatcagagtttaaaaccatt

SEQ ID NO: 58459 - DNA, 20 bp, Homo sapiens
gatcatgttgagaaagatga

SEQ ID NO: 58460 - DNA, 20 bp, Homo sapiens
gatcattacattgaagagtc

SEQ ID NO: 58461 - DNA, 20 bp, Homo sapiens
gatccttattttcttcatcc

SEQ ID NO: 58462 - DNA, 20 bp, Homo sapiens
gatctctgtatgcaattggt

SEQ ID NO: 58463 - DNA, 20 bp, Homo sapiens
gatccatgaaccagaaccac

SEQ ID NO: 58464 - DNA, 20 bp, Homo sapiens
gatcgccatgaggttatctc

SEQ ID NO: 58465 - DNA, 20 bp, Homo sapiens
gatccaaaggtaggaagggc

SEQ ID NO: 58466 - DNA, 20 bp, Homo sapiens
gatctgtgagaaggtgaata

SEQ ID NO: 58467 - DNA, 20 bp, Homo sapiens
gatcaaactgacaagccacc

SEQ ID NO: 58468 - DNA, 20 bp, Homo sapiens
gatccacgtggcagaactgg

SEQ ID NO: 58469 - DNA, 20 bp, Homo sapiens
gatctgcaaataaatctgaa

SEQ ID NO: 58470 - DNA, 20 bp, Homo sapiens
gatcttttcccgagatgcag

SEQ ID NO: 58471 - DNA, 20 bp, Homo sapiens
gatcccaagtacggtgagcc

SEQ ID NO: 58472 - DNA, 20 bp, Homo sapiens
gatcaacagatttgttagta

SEQ ID NO: 58473 - DNA, 20 bp, Homo sapiens
gatcgtggaatccaggaagt

SEQ ID NO: 58474 - DNA, 20 bp, Homo sapiens
gatcattgaaggagacttgg

SEQ ID NO: 58475 - DNA, 20 bp, Homo sapiens
gatccaggccgccccgctcc

SEQ ID NO: 58476 - DNA, 20 bp, Homo sapiens
gatcagctcatgagaatctc

SEQ ID NO: 58477 - DNA, 20 bp, Homo sapiens
gatcctggccatcatgagag

SEQ ID NO: 58478 - DNA, 20 bp, Homo sapiens
gatccacacctgaccctgtt

SEQ ID NO: 58479 - DNA, 20 bp, Homo sapiens
gatcaccaacttacgagcca

SEQ ID NO: 58480 - DNA, 20 bp, Homo sapiens
gatctctcagcaaactcagc

SEQ ID NO: 58481 - DNA, 20 bp, Homo sapiens
gatccaaactgagaagggag

SEQ ID NO: 58482 - DNA, 20 bp, Homo sapiens
gatcactggaggccagaagt

SEQ ID NO: 58483 - DNA, 20 bp, Homo sapiens
gatcccggtgcagctgctat

SEQ ID NO: 58484 - DNA, 20 bp, Homo sapiens
gatccagcttctgcaggagg

SEQ ID NO: 58485 - DNA, 20 bp, Homo sapiens
gatctgaaggagtgacaggt

SEQ ID NO: 58486 - DNA, 20 bp, Homo sapiens
gatctgagcctgtgctcagc

SEQ ID NO: 58487 - DNA, 20 bp, Homo sapiens
gatccttatataataggcct

SEQ ID NO: 58488 - DNA, 20 bp, Homo sapiens
gatcaccaagtcaacggttc

SEQ ID NO: 58489 - DNA, 20 bp, Homo sapiens
gatcatcaaatttttaaaaa

SEQ ID NO: 58490 - DNA, 20 bp, Homo sapiens
gatcaaacctacctgaagcc

SEQ ID NO: 58491 - DNA, 20 bp, Homo sapiens
gatcagaccccgctctctct

SEQ ID NO: 58492 - DNA, 20 bp, Homo sapiens
gatccaaaccatgcagaaca

SEQ ID NO: 58493 - DNA, 20 bp, Homo sapiens
gatccccgtgaagtacctgg

SEQ ID NO: 58494 - DNA, 20 bp, Homo sapiens
gatctcctcctcattgcaaa

SEQ ID NO: 58495 - DNA, 20 bp, Homo sapiens
gatctgaattaattgtcctt

SEQ ID NO: 58496 - DNA, 20 bp, Homo sapiens
gatctgggctgggcgggcca

SEQ ID NO: 58497 - DNA, 20 bp, Homo sapiens
gatcttgtgcttggtggcat

SEQ ID NO: 58498 - DNA, 20 bp, Homo sapiens
gatcgctcaatggctcgctg

SEQ ID NO: 58499 - DNA, 20 bp, Homo sapiens
gatctttgtcaagcatccca

SEQ ID NO: 58500 - DNA, 20 bp, Homo sapiens
gatcgccgcctcatctgtgc

SEQ ID NO: 58501 - DNA, 20 bp, Homo sapiens
gatcactgcactctctttag

SEQ ID NO: 58502 - DNA, 20 bp, Homo sapiens
gatcagactgtaaatcttgg

SEQ ID NO: 58503 - DNA, 20 bp, Homo sapiens
gatcatatttcccagagtgg

SEQ ID NO: 58504 - DNA, 20 bp, Homo sapiens
gatcatccacaatagcaact

SEQ ID NO: 58505 - DNA, 20 bp, Homo sapiens
gatccaagatacaggatgtt

SEQ ID NO: 58506 - DNA, 20 bp, Homo sapiens
gatcgccagggatggtaaaa

SEQ ID NO: 58507 - DNA, 20 bp, Homo sapiens
gatctttgtttgcaactatc

SEQ ID NO: 58508 - DNA, 20 bp, Homo sapiens
gatcatggggtatttcgtcc

SEQ ID NO: 58509 - DNA, 20 bp, Homo sapiens
gatcccaagttcctgataac

SEQ ID NO: 58510 - DNA, 20 bp, Homo sapiens
gatcgagaacatgaaggaca

SEQ ID NO: 58511 - DNA, 20 bp, Homo sapiens
gatcttcacggatttccatc

SEQ ID NO: 58512 - DNA, 20 bp, Homo sapiens
gatcatttcaagatataaga

SEQ ID NO: 58513 - DNA, 20 bp, Homo sapiens
gatcaccgtaataaaagtta

SEQ ID NO: 58514 - DNA, 20 bp, Homo sapiens
gatcctcgcacattttatat

SEQ ID NO: 58515 - DNA, 20 bp, Homo sapiens
gatcctggtattgtaatatt

SEQ ID NO: 58516 - DNA, 20 bp, Homo sapiens
gatccttttgtgccatgttc

SEQ ID NO: 58517 - DNA, 20 bp, Homo sapiens
gatcaacaccaagaagaagc

SEQ ID NO: 58518 - DNA, 20 bp, Homo sapiens
gatcaatgctgagctgacag

SEQ ID NO: 58519 - DNA, 20 bp, Homo sapiens
gatcagccgctgctgctcct

SEQ ID NO: 58520 - DNA, 20 bp, Homo sapiens
gatcaggagcaggaatgatg

SEQ ID NO: 58521 - DNA, 20 bp, Homo sapiens
gatcaggctggtgttctggg

SEQ ID NO: 58522 - DNA, 20 bp, Homo sapiens
gatccagcacgagctggagg

SEQ ID NO: 58523 - DNA, 20 bp, Homo sapiens
gatcctgcgcatccagcttg

SEQ ID NO: 58524 - DNA, 20 bp, Homo sapiens
gatcctggcagaatggaaac

SEQ ID NO: 58525 - DNA, 20 bp, Homo sapiens
gatctagaaagagcaaagag

SEQ ID NO: 58526 - DNA, 20 bp, Homo sapiens
gatctcactgaacagattgc

SEQ ID NO: 58527 - DNA, 20 bp, Homo sapiens
gatctgcttcttcccaccct

SEQ ID NO: 58528 - DNA, 20 bp, Homo sapiens
gatctttccctcttcatgtt

SEQ ID NO: 58529 - DNA, 20 bp, Homo sapiens
gatcagcgagaggctggaag

SEQ ID NO: 58530 - DNA, 20 bp, Homo sapiens
gatcaagcctctgttgaaga

SEQ ID NO: 58531 - DNA, 20 bp, Homo sapiens
gatcaatgacctgactgcgc

SEQ ID NO: 58532 - DNA, 20 bp, Homo sapiens
gatcactcttcacttatgac

SEQ ID NO: 58533 - DNA, 20 bp, Homo sapiens
gatcagctagaaaccctgaa

SEQ ID NO: 58534 - DNA, 20 bp, Homo sapiens
gatcaggagtaggaatgatg

SEQ ID NO: 58535 - DNA, 20 bp, Homo sapiens
gatcatgtcctgatgccatg

SEQ ID NO: 58536 - DNA, 20 bp, Homo sapiens
gatccaaagattcctcatag

SEQ ID NO: 58537 - DNA, 20 bp, Homo sapiens
gatccttcacggtctgctcc

SEQ ID NO: 58538 - DNA, 20 bp, Homo sapiens
gatcgaggagctgcgggcca

SEQ ID NO: 58539 - DNA, 20 bp, Homo sapiens
gatctcagcatccagcgtgc

SEQ ID NO: 58540 - DNA, 20 bp, Homo sapiens
gatctgcagctccgtctgga

SEQ ID NO: 58541 - DNA, 20 bp, Homo sapiens
gatctgggtatccttgagga

SEQ ID NO: 58542 - DNA, 20 bp, Homo sapiens
gatcttatcgaagttccttt

SEQ ID NO: 58543 - DNA, 20 bp, Homo sapiens
gatcttgaagggtccttgga

SEQ ID NO: 58544 - DNA, 20 bp, Homo sapiens
gatcagtgagaagtgagcct

SEQ ID NO: 58545 - DNA, 20 bp, Homo sapiens
gatccagaaactggaggcca

SEQ ID NO: 58546 - DNA, 20 bp, Homo sapiens
gatcaagatgtggcaaagct

SEQ ID NO: 58547 - DNA, 20 bp, Homo sapiens
gatcgaggacttgatggtgg

SEQ ID NO: 58548 - DNA, 20 bp, Homo sapiens
gatctgctcagccctggagg

SEQ ID NO: 58549 - DNA, 20 bp, Homo sapiens
gatcaccttaagccaggtcg

SEQ ID NO: 58550 - DNA, 20 bp, Homo sapiens
gatctggagagtttgtcatg

SEQ ID NO: 58551 - DNA, 20 bp, Homo sapiens
gatctgtttaccatcattca

SEQ ID NO: 58552 - DNA, 20 bp, Homo sapiens
gatcttaatggcagagaggt

SEQ ID NO: 58553 - DNA, 20 bp, Homo sapiens
gatcttggaatcacctgttc

SEQ ID NO: 58554 - DNA, 20 bp, Homo sapiens
gatccatcctgctagcacct

SEQ ID NO: 58555 - DNA, 20 bp, Homo sapiens
gatcaagaacatgtgggcgg

SEQ ID NO: 58556 - DNA, 20 bp, Homo sapiens
gatcacatcctcagggtcgg

SEQ ID NO: 58557 - DNA, 20 bp, Homo sapiens
gatcaccggagccttcaagg

SEQ ID NO: 58558 - DNA, 20 bp, Homo sapiens
gatcagttaaattttattgg

SEQ ID NO: 58559 - DNA, 20 bp, Homo sapiens
gatcgaccagaaccgtgatg

SEQ ID NO: 58560 - DNA, 20 bp, Homo sapiens
gatctcctcctgggagaagc

SEQ ID NO: 58561 - DNA, 20 bp, Homo sapiens
gatctgagtctggtcgaaca

SEQ ID NO: 58562 - DNA, 20 bp, Homo sapiens
gatctttgtttctcaaaaaa

SEQ ID NO: 58563 - DNA, 20 bp, Homo sapiens
gatcccgctcacctgtctga

SEQ ID NO: 58564 - DNA, 20 bp, Homo sapiens
gatcaaaataaaggcgctaa

SEQ ID NO: 58565 - DNA, 20 bp, Homo sapiens
gatcatctgctcacggctga

SEQ ID NO: 58566 - DNA, 20 bp, Homo sapiens
gatctcagtactgagctggg

SEQ ID NO: 58567 - DNA, 20 bp, Homo sapiens
gatcaggagttcttggtatg

SEQ ID NO: 58568 - DNA, 20 bp, Homo sapiens
gatcaggatgcaatccagga

SEQ ID NO: 58569 - DNA, 20 bp, Homo sapiens
gatctcggctatacctccac

SEQ ID NO: 58570 - DNA, 20 bp, Homo sapiens
gatctggcattctagtttca

SEQ ID NO: 58571 - DNA, 20 bp, Homo sapiens
gatcagagccatactgtccg

SEQ ID NO: 58572 - DNA, 20 bp, Homo sapiens
gatcagcagcaccatctggg

SEQ ID NO: 58573 - DNA, 20 bp, Homo sapiens
gatcaggagaccaggcaggc

SEQ ID NO: 58574 - DNA, 20 bp, Homo sapiens
gatcagtgtcccaagggatg

SEQ ID NO: 58575 - DNA, 20 bp, Homo sapiens
gatccattgagctgtcagag

SEQ ID NO: 58576 - DNA, 20 bp, Homo sapiens
gatcctgtctcaccaacccc

SEQ ID NO: 58577 - DNA, 20 bp, Homo sapiens
gatctacctttccatccttt

SEQ ID NO: 58578 - DNA, 20 bp, Homo sapiens
gatctctcctttttccctcc

SEQ ID NO: 58579 - DNA, 20 bp, Homo sapiens
gatcattggtcaaattgcat

SEQ ID NO: 58580 - DNA, 20 bp, Homo sapiens
gatctcaaagcatttcaaag

SEQ ID NO: 58581 - DNA, 20 bp, Homo sapiens
gatcaggagactattacagg

SEQ ID NO: 58582 - DNA, 20 bp, Homo sapiens
gatcagtgtaaagaccacac

SEQ ID NO: 58583 - DNA, 20 bp, Homo sapiens
gatcatcttcagttgctacc

SEQ ID NO: 58584 - DNA, 20 bp, Homo sapiens
gatcattcatgcccaacaag

SEQ ID NO: 58585 - DNA, 20 bp, Homo sapiens
gatcctgcagtcaatgtttc

SEQ ID NO: 58586 - DNA, 20 bp, Homo sapiens
gatcgtgactgctcccggct

SEQ ID NO: 58587 - DNA, 20 bp, Homo sapiens
gatcgttgttgtgggagctc

SEQ ID NO: 58588 - DNA, 20 bp, Homo sapiens
gatctacttcatgcagaccg

SEQ ID NO: 58589 - DNA, 20 bp, Homo sapiens
gatctgccagtgcactaagc

SEQ ID NO: 58590 - DNA, 20 bp, Homo sapiens
gatctgtaagtcctgcagac

SEQ ID NO: 58591 - DNA, 20 bp, Homo sapiens
gatctgtcaccactggtgtg

SEQ ID NO: 58592 - DNA, 20 bp, Homo sapiens
gatcatcagagtggggaggt

SEQ ID NO: 58593 - DNA, 20 bp, Homo sapiens
gatcttcctttattaaaata

SEQ ID NO: 58594 - DNA, 20 bp, Homo sapiens
gatcggggagcccacggtgg

SEQ ID NO: 58595 - DNA, 20 bp, Homo sapiens
gatcgctcattcttctttta

SEQ ID NO: 58596 - DNA, 20 bp, Homo sapiens
gatcaattttatgcagaggc

SEQ ID NO: 58597 - DNA, 20 bp, Homo sapiens
gatcacgaaaggtttgggcc

SEQ ID NO: 58598 - DNA, 20 bp, Homo sapiens
gatcccgggccgaagcagtg

SEQ ID NO: 58599 - DNA, 20 bp, Homo sapiens
gatctgggcaaggattcgga

SEQ ID NO: 58600 - DNA, 20 bp, Homo sapiens
gatctagtcccttaattttc

SEQ ID NO: 58601 - DNA, 20 bp, Homo sapiens
gatccgggcctgcggggagc

SEQ ID NO: 58602 - DNA, 20 bp, Homo sapiens
gatcaaggccggcaagcgag

SEQ ID NO: 58603 - DNA, 20 bp, Homo sapiens
gatcatggagctgaacctgc

SEQ ID NO: 58604 - DNA, 20 bp, Homo sapiens
gatccccattgtgtatgagc

SEQ ID NO: 58605 - DNA, 20 bp, Homo sapiens
gatcgcctggtctgacatcc

SEQ ID NO: 58606 - DNA, 20 bp, Homo sapiens
gatctggaggcgctccttcg

SEQ ID NO: 58607 - DNA, 20 bp, Homo sapiens
gatcatccccgagggcgggg

SEQ ID NO: 58608 - DNA, 20 bp, Homo sapiens
gatccagaaagcactgtttt

SEQ ID NO: 58609 - DNA, 20 bp, Homo sapiens
gatctgcgtatttctggagt

SEQ ID NO: 58610 - DNA, 20 bp, Homo sapiens
gatcaaatatttcaaccttt

SEQ ID NO: 58611 - DNA, 20 bp, Homo sapiens
gatcaatgaatcctgataaa

SEQ ID NO: 58612 - DNA, 20 bp, Homo sapiens
gatcatgttttataagaaat

SEQ ID NO: 58613 - DNA, 20 bp, Homo sapiens
gatcattcaaacctagtgaa

SEQ ID NO: 58614 - DNA, 20 bp, Homo sapiens
gatctgaaataaatgagaag

SEQ ID NO: 58615 - DNA, 20 bp, Homo sapiens
gatctttttcccctccagaa

SEQ ID NO: 58616 - DNA, 20 bp, Homo sapiens
gatctgagtcctcaatccca

SEQ ID NO: 58617 - DNA, 20 bp, Homo sapiens
gatcaccatccgcgtccact

SEQ ID NO: 58618 - DNA, 20 bp, Homo sapiens
gatcatcttggccatgtggt

SEQ ID NO: 58619 - DNA, 20 bp, Homo sapiens
gatccggaacatagccacct

SEQ ID NO: 58620 - DNA, 20 bp, Homo sapiens
gatcgcattcctgagcttcg

SEQ ID NO: 58621 - DNA, 20 bp, Homo sapiens
gatcgtagtactcctgggca

SEQ ID NO: 58622 - DNA, 20 bp, Homo sapiens
gatctaactccagtacccca

SEQ ID NO: 58623 - DNA, 20 bp, Homo sapiens
gatctcccgggcatactggg

SEQ ID NO: 58624 - DNA, 20 bp, Homo sapiens
gatctggggtgtggagcctt

SEQ ID NO: 58625 - DNA, 20 bp, Homo sapiens
gatcggaaaccgcctggggc

SEQ ID NO: 58626 - DNA, 20 bp, Homo sapiens
gatctggccgaggaggtggg

SEQ ID NO: 58627 - DNA, 20 bp, Homo sapiens
gatcaactcttccaactgag

SEQ ID NO: 58628 - DNA, 20 bp, Homo sapiens
gatcaattaagctcctttga

SEQ ID NO: 58629 - DNA, 20 bp, Homo sapiens
gatcttaggtcattgattta

SEQ ID NO: 58630 - DNA, 20 bp, Homo sapiens
gatcttcttgtaatcctcac

SEQ ID NO: 58631 - DNA, 20 bp, Homo sapiens
gatctttttagttttgggat

SEQ ID NO: 58632 - DNA, 20 bp, Homo sapiens
gatccgaacttaagaaaaag

SEQ ID NO: 58633 - DNA, 20 bp, Homo sapiens
gatctctttgagcaaaaaaa

SEQ ID NO: 58634 - DNA, 20 bp, Homo sapiens
gatcttccgcatcggcaggg

SEQ ID NO: 58635 - DNA, 20 bp, Homo sapiens
gatcactcccactagggact

SEQ ID NO: 58636 - DNA, 20 bp, Homo sapiens
gatcaacaacatgtccttcc

SEQ ID NO: 58637 - DNA, 20 bp, Homo sapiens
gatcagaccctggatgatgg

SEQ ID NO: 58638 - DNA, 20 bp, Homo sapiens
gatcatcgacgcttttggtg

SEQ ID NO: 58639 - DNA, 20 bp, Homo sapiens
gatctcgtccccaatgcctc

SEQ ID NO: 58640 - DNA, 20 bp, Homo sapiens
gatctctagtgtggccaggt

SEQ ID NO: 58641 - DNA, 20 bp, Homo sapiens
gatcctctctttctttccct

SEQ ID NO: 58642 - DNA, 20 bp, Homo sapiens
gatcagagaaggctgaagaa

SEQ ID NO: 58643 - DNA, 20 bp, Homo sapiens
gatcaggacccagacgcaca

SEQ ID NO: 58644 - DNA, 20 bp, Homo sapiens
gatcaaccagcctaccaact

SEQ ID NO: 58645 - DNA, 20 bp, Homo sapiens
gatcccaacaatgaatagga

SEQ ID NO: 58646 - DNA, 20 bp, Homo sapiens
gatcaaagacacaccctggc

SEQ ID NO: 58647 - DNA, 20 bp, Homo sapiens
gatcaggggcttgtaacaat

SEQ ID NO: 58648 - DNA, 20 bp, Homo sapiens
gatcctcttcaggaggtgag

SEQ ID NO: 58649 - DNA, 20 bp, Homo sapiens
gatctgtctcaccacacatc

SEQ ID NO: 58650 - DNA, 20 bp, Homo sapiens
gatccagctctgcgtagtca

SEQ ID NO: 58651 - DNA, 20 bp, Homo sapiens
gatcccgcaaagcgccggca

SEQ ID NO: 58652 - DNA, 20 bp, Homo sapiens
gatcagaggagaggagacag

SEQ ID NO: 58653 - DNA, 20 bp, Homo sapiens
gatcaatgggatggtcccca

SEQ ID NO: 58654 - DNA, 20 bp, Homo sapiens
gatccttccagacactcctc

SEQ ID NO: 58655 - DNA, 20 bp, Homo sapiens
gatcggaactttattgagac

SEQ ID NO: 58656 - DNA, 20 bp, Homo sapiens
gatcacagtcattgatgact

SEQ ID NO: 58657 - DNA, 20 bp, Homo sapiens
gatcacttcttcaagaagcc

SEQ ID NO: 58658 - DNA, 20 bp, Homo sapiens
gatcatggcaaacaaggaac

SEQ ID NO: 58659 - DNA, 20 bp, Homo sapiens
gatccttcgtggggaaccgc

SEQ ID NO: 58660 - DNA, 20 bp, Homo sapiens
gatcgtggtgcagaaaggag

SEQ ID NO: 58661 - DNA, 20 bp, Homo sapiens
gatcggcgccgaatacggcc

SEQ ID NO: 58662 - DNA, 20 bp, Homo sapiens
gatcatttcatattctttca

SEQ ID NO: 58663 - DNA, 20 bp, Homo sapiens
gatcctaatctactgcaaga

SEQ ID NO: 58664 - DNA, 20 bp, Homo sapiens
gatccaggcgccagggggca

SEQ ID NO: 58665 - DNA, 20 bp, Homo sapiens
gatcaggggtggggggagaa

SEQ ID NO: 58666 - DNA, 20 bp, Homo sapiens
gatcacaaagcagctgcccc

SEQ ID NO: 58667 - DNA, 20 bp, Homo sapiens
gatcagggccactcctccca

SEQ ID NO: 58668 - DNA, 20 bp, Homo sapiens
gatccaggaaaatgtgaggg

SEQ ID NO: 58669 - DNA, 20 bp, Homo sapiens
gatccttccattctgcccag

SEQ ID NO: 58670 - DNA, 20 bp, Homo sapiens
gatctcagccacctcctggc

SEQ ID NO: 58671 - DNA, 20 bp, Homo sapiens
gatctgacactgtccacacg

SEQ ID NO: 58672 - DNA, 20 bp, Homo sapiens
gatcctgcacatgtctttcc

SEQ ID NO: 58673 - DNA, 20 bp, Homo sapiens
gatcaccctggagcctgagc

SEQ ID NO: 58674 - DNA, 20 bp, Homo sapiens
gatctgctcctctgctggga

SEQ ID NO: 58675 - DNA, 20 bp, Homo sapiens
gatctggggagggagtcggg

SEQ ID NO: 58676 - DNA, 20 bp, Homo sapiens
gatctgtcctgggggatgca

SEQ ID NO: 58677 - DNA, 20 bp, Homo sapiens
gatcatctcttcgctgaggt

SEQ ID NO: 58678 - DNA, 20 bp, Homo sapiens
gatcgaatctctgatgaaag

SEQ ID NO: 58679 - DNA, 20 bp, Homo sapiens
gatcgcgtgtccctagggtg

SEQ ID NO: 58680 - DNA, 20 bp, Homo sapiens
gatcgctgagttcaaggctg

SEQ ID NO: 58681 - DNA, 20 bp, Homo sapiens
gatctcctcgtccgtcacgt

SEQ ID NO: 58682 - DNA, 20 bp, Homo sapiens
gatcttggtagaggcgactg

SEQ ID NO: 58683 - DNA, 20 bp, Homo sapiens
gatcacacagctaataagtg

SEQ ID NO: 58684 - DNA, 20 bp, Homo sapiens
gatcactgcctcccgcaaac

SEQ ID NO: 58685 - DNA, 20 bp, Homo sapiens
gatcagaggaaggtcgtttc

SEQ ID NO: 58686 - DNA, 20 bp, Homo sapiens
gatccatggacaccttgtgc

SEQ ID NO: 58687 - DNA, 20 bp, Homo sapiens
gatctaaaagcatgcatgcc

SEQ ID NO: 58688 - DNA, 20 bp, Homo sapiens
gatctccactctgtcctgtc

SEQ ID NO: 58689 - DNA, 20 bp, Homo sapiens
gatctgcgggccaacctcaa

SEQ ID NO: 58690 - DNA, 20 bp, Homo sapiens
gatcttgggttttctctcga

SEQ ID NO: 58691 - DNA, 20 bp, Homo sapiens
gatctttttgtaaaccttaa

SEQ ID NO: 58692 - DNA, 20 bp, Homo sapiens
gatcaaatagcttctggttc

SEQ ID NO: 58693 - DNA, 20 bp, Homo sapiens
gatcgatgcggctgaagagg

SEQ ID NO: 58694 - DNA, 20 bp, Homo sapiens
gatctgcggggcaagttcaa

SEQ ID NO: 58695 - DNA, 20 bp, Homo sapiens
gatcttggcgtgcagctgtt

SEQ ID NO: 58696 - DNA, 20 bp, Homo sapiens
gatcaaaggaggcaccacgg

SEQ ID NO: 58697 - DNA, 20 bp, Homo sapiens
gatcaacgtgctgtacaacc

SEQ ID NO: 58698 - DNA, 20 bp, Homo sapiens
gatccaccagctggagtctg

SEQ ID NO: 58699 - DNA, 20 bp, Homo sapiens
gatccagtccgacagctcct

SEQ ID NO: 58700 - DNA, 20 bp, Homo sapiens
gatcccagaaggggagcgcg

SEQ ID NO: 58701 - DNA, 20 bp, Homo sapiens
gatctcatatttctgctgtt

SEQ ID NO: 58702 - DNA, 20 bp, Homo sapiens
gatcaccttggtgaagacaa

SEQ ID NO: 58703 - DNA, 20 bp, Homo sapiens
gatcccagaaggggagaaag

SEQ ID NO: 58704 - DNA, 20 bp, Homo sapiens
gatcgatgttgagcggcttg

SEQ ID NO: 58705 - DNA, 20 bp, Homo sapiens
gatcttaggagcagtgagtt

SEQ ID NO: 58706 - DNA, 20 bp, Homo sapiens
gatcctggaaggagagctgg

SEQ ID NO: 58707 - DNA, 20 bp, Homo sapiens
gatcagctgagtttaaatgt

SEQ ID NO: 58708 - DNA, 20 bp, Homo sapiens
gatccagaacagagcagaaa

SEQ ID NO: 58709 - DNA, 20 bp, Homo sapiens
gatcgggcagagcaagctga

SEQ ID NO: 58710 - DNA, 20 bp, Homo sapiens
gatctgattctaccagagtg

SEQ ID NO: 58711 - DNA, 20 bp, Homo sapiens
gatctgccccctttactcct

SEQ ID NO: 58712 - DNA, 20 bp, Homo sapiens
gatcctacggttcaaggagg

SEQ ID NO: 58713 - DNA, 20 bp, Homo sapiens
gatcagtatgcattctgtcg

SEQ ID NO: 58714 - DNA, 20 bp, Homo sapiens
gatccagtccgtggtttcct

SEQ ID NO: 58715 - DNA, 20 bp, Homo sapiens
gatcctttaaaactggtacg

SEQ ID NO: 58716 - DNA, 20 bp, Homo sapiens
gatctgagccaatcttggca

SEQ ID NO: 58717 - DNA, 20 bp, Homo sapiens
gatctgtgcccaaatccccc

SEQ ID NO: 58718 - DNA, 20 bp, Homo sapiens
gatctttctgttcatgcttt

SEQ ID NO: 58719 - DNA, 20 bp, Homo sapiens
gatctcaataaagaactcga

SEQ ID NO: 58720 - DNA, 20 bp, Homo sapiens
gatcagcgctgtagagcaga

SEQ ID NO: 58721 - DNA, 20 bp, Homo sapiens
gatcagggttgtcaggtcat

SEQ ID NO: 58722 - DNA, 20 bp, Homo sapiens
gatccaaagtaactggatac

SEQ ID NO: 58723 - DNA, 20 bp, Homo sapiens
gatccaaattcattccctaa

SEQ ID NO: 58724 - DNA, 20 bp, Homo sapiens
gatccatttaagagggcctg

SEQ ID NO: 58725 - DNA, 20 bp, Homo sapiens
gatcgaatatgtatattcac

SEQ ID NO: 58726 - DNA, 20 bp, Homo sapiens
gatctcaaaatattaatgaa

SEQ ID NO: 58727 - DNA, 20 bp, Homo sapiens
gatcatcccagagaagaaag

SEQ ID NO: 58728 - DNA, 20 bp, Homo sapiens
gatcaatgctaataattact

SEQ ID NO: 58729 - DNA, 20 bp, Homo sapiens
gatctaataaacttccaaac

SEQ ID NO: 58730 - DNA, 20 bp, Homo sapiens
gatcccttcctgcccatccc

SEQ ID NO: 58731 - DNA, 20 bp, Homo sapiens
gatctgctgacccagggttt

SEQ ID NO: 58732 - DNA, 20 bp, Homo sapiens
gatcagttttaatttctcca

SEQ ID NO: 58733 - DNA, 2229 bp, Homo sapiens
ccggcatttgcgtttggggcgccctccctgcgccgggggcgggagcccagcgagcgcagagccccggccccgcgcggcccgagtgccacatcactgcgctggccgtccaaggtccgccgccccaccatgccgcccccgccgccgctgctgctccttacagtcctggtcgtcgccgctgcccggccggggtgcgagtttgagcggaaccccgccggtgaatgccacaggccaccagctgcagacagcgccacctgcgtggacctgcagctcaggacctgcagcgatgccgcctacaaccacaccaccttccccaacctgcttcagcaccggtcgtgggaggtggtggaggccagctccgagtacatcctgctgagcgttctacaccagctcctggaaggccagtgcaacccggacctgcggctgctgggctgtgctgtgctggccccccggtgtgagggcggctgggtgcgcagaccctgccggcacatctgcgagggcctgcgggaggtctgccagcccgccttcgacgccattgacatggcctggccctacttccttgactgccaccgctacttcacgagagaggacgagggctgctatgacccgctggagaagcttcggggaggcctggaggctgacgaggcactgccctcagggctgccgcccaccttcatccgcttcagccaccactcctacgcccagatggtgcgtgtgctgaggcggacggcctcccgctgcgcccacgtggccaggacctacagcatcgggcgcagcttcgacggcagggagctgctggtcatcgagttctccagccgccccggccagcacgagctgatggagcccgaggtgaagctcatcggcaacattcatggcaacgaggtggcgggccgggagatgctcatctacctagcccagtacctgtgctctgagtacctgcttggtaacccccgcatccagcgcctgctcaacaccacccgcatccacctgctgccctccatgaaccctgacggctatgaggtggcagctgccgagggtgccggctacaacgggtggacgagcgggaggcagaacgcgcagaacctggatctgaaccgaaatttcccggacctgacgtccgagtactaccggctggcggagacccgcggcgcacgcagcgaccacatccccatcccccagcactactggtggggtaaggtggccccggagacaaaggcaatcatgaagtggatgcagaccataccctttgtgctctcagccagccttcatgggggcgacctggtggtgtcctaccccttcgacttctccaagcacccccaggaggagaagatgttttctcccacgcccgacgagaagatgttcaagctgctgtccagagcctacgctgacgtccaccccatgatgatggacaggtcggagaataggtgtggaggcaatttcctgaagagggggagcatcatcaacggggcggactggtacagcttcacgggaggcatgtccgatttcaactacctgcacaccaactgctttgagatcacggtagagctgggctgtgtgaagttcccccccgaggaggccctgtacacactctggcagcacaacaaggagtcactcctgaatttcgtggagacggtgcaccggggcatcaaaggtgtggtgacagataaattcggcaagccagtcaaaaacgcccggatctcagtcaaaggcattcgccacgacatcaccacagccccagatggtgactactggagactgctgcccccaggtatccacattgtcattgcccaagcccctggctacgccaaagtcatcaagaaagtcatcatccccgcccggatgaagagggctggccgtgtggacttcattctgcaacctctggggatgggacccaagaactttattcatgggctgcggaggactgggccccacgacccgctgggaggtgccagctctttgggggaggccacggagcccgacccgctccgggcgcgcaggcagccctcggccgacgggagtaagccctggtggtggtcctacttcacatcgctgagcacccacaggccacgctggctgctcaagtactagccccggccccagcacccgccaggatgtggagaccgaggcccatctccgcatcccgggctcctggctcttgattttgtctgccacagacatcccacaaagccgctgccattttattaaagtgttttgatccactttccactggaa

SEQ ID NO: 58734 - DNA, 2492 bp, Homo sapiens
ccggcatttgcgtttggggcgccctccctgcgccgggggcgggagcccagcgagcgcagagccccggccccgcgcggcccgagtgccacatcactgcgctggccgtccaaggtccgccgccccaccatgccgcccccgccgccgctgctgctccttacagtcctggtcgtcgccgctgcccggccggggtgcgagtttgagcggaaccccgccggtgaatgccacaggccaccagctgcagacagcggtacagtaccgggacctccctggcttctgttctgtaggagggctgcagcccccacactgtcagagcactttaggcagctgaatccgtgatttcagaagctctgattcctgcacagtagctgttgtcctggtcctcccctgccagaccgtgggtgcccctccctgcaggccctggccctgcgtggggtcccctacgtaaatgtctgacgcgtcacggtcagggccactgcgggagggactgacctgccgaccctgcctccccagccacctgcgtggacctgcagctcaggacctgcagcgatgccgcctacaaccacaccaccttccccaacctgcttcagcaccggtcgtgggaggtggtggaggccagctccgagtacatcctgctgagcgttctacaccagctcctggaaggccagtgcaacccggacctgcggctgctgggctgtgctgtgctggccccccggtgtgagggcggctgggtgcgcagaccctgccggcacatctgcgagggcctgcgggaggtctgccagcccgccttcgacgccattgacatggcctggccctacttccttgactgccaccgctacttcacgagagaggacgagggctgctatgacccgctggagaagcttcggggaggcctggaggctgacgaggcactgccctcagggctgccgcccaccttcatccgcttcagccaccactcctacgcccagatggtgcgtgtgctgaggcggacggcctcccgctgcgcccacgtggccaggacctacagcatcgggcgcagcttcgacggcagggagctgctggtcatcgagttctccagccgccccggccagcacgagctgatggagcccgaggtgaagctcatcggcaacattcatggcaacgaggtggcgggccgggagatgctcatctacctagcccagtacctgtgctctgagtacctgcttggtaacccccgcatccagcgcctgctcaacaccacccgcatccacctgctgccctccatgaaccctgacggctatgaggtggcagctgccgagggtgccggctacaacgggtggacgagcgggaggcagaacgcgcagaacctggatctgaaccgaaatttcccggacctgacgtccgagtactaccggctggcggagacccgcggcgcacgcagcgaccacatccccatcccccagcactactggtggggtaaggtggccccggagacaaaggcaatcatgaagtggatgcagaccataccctttgtgctctcagccagccttcatgggggcgacctggtggtgtcctaccccttcgacttctccaagcacccccaggaggagaagatgttttctcccacgcccgacgagaagatgttcaagctgctgtccagagcctacgctgacgtccaccccatgatgatggacaggtcggagaataggtgtggaggcaatttcctgaagagggggagcatcatcaacggggcggactggtacagcttcacgggaggcatgtccgatttcaactacctgcacaccaactgctttgagatcacggtagagctgggctgtgtgaagttcccccccgaggaggccctgtacacactctggcagcacaacaaggagtcactcctgaatttcgtggagacggtgcaccggggcatcaaaggtgtggtgacagataaattcggcaagccagtcaaaaacgcccggatctcagtcaaaggcattcgccacgacatcaccacagccccagatggtgactactggagactgctgcccccaggtatccacattgtcattgcccaagcccctggctacgccaaagtcatcaagaaagtcatcatccccgcccggatgaagagggctggccgtgtggacttcattctgcaacctctggggatgggacccaagaactttattcatgggctgcggaggactgggccccacgacccgctgggaggtgccagctctttgggggaggccacggagcccgacccgctccgggcgcgcaggcagccctcggccgacgggagtaagccctggtggtggtcctacttcacatcgctgagcacccacaggccacgctggctgctcaagtactagccccggccccagcacccgccaggatgtggagaccgaggcccatctccgcatcccgggctcctggctcttgattttgtctgccacagacatcccacaaagccgctgccattttattaaagtgttttgatccactttccactggaa

SEQ ID NO: 58735 - DNA, 2196 bp, Homo sapiens
ccggcatttgcgtttggggcgccctccctgcgccgggggcgggagcccagcgagcgcagagccccggccccgcgcggcccgagtgccacatcactgcgctggccgtccaaggtccgccgccccaccatgccgcccccgccgccgctgctgctccttacagtcctggtcgtcgccgctgcccggccggggtgcgagtttgagcggaaccccgccgccacctgcgtggacctgcagctcaggacctgcagcgatgccgcctacaaccacaccaccttccccaacctgcttcagcaccggtcgtgggaggtggtggaggccagctccgagtacatcctgctgagcgttctacaccagctcctggaaggccagtgcaacccggacctgcggctgctgggctgtgctgtgctggccccccggtgtgagggcggctgggtgcgcagaccctgccggcacatctgcgagggcctgcgggaggtctgccagcccgccttcgacgccattgacatggcctggccctacttccttgactgccaccgctacttcacgagagaggacgagggctgctatgacccgctggagaagcttcggggaggcctggaggctgacgaggcactgccctcagggctgccgcccaccttcatccgcttcagccaccactcctacgcccagatggtgcgtgtgctgaggcggacggcctcccgctgcgcccacgtggccaggacctacagcatcgggcgcagcttcgacggcagggagctgctggtcatcgagttctccagccgccccggccagcacgagctgatggagcccgaggtgaagctcatcggcaacattcatggcaacgaggtggcgggccgggagatgctcatctacctagcccagtacctgtgctctgagtacctgcttggtaacccccgcatccagcgcctgctcaacaccacccgcatccacctgctgccctccatgaaccctgacggctatgaggtggcagctgccgagggtgccggctacaacgggtggacgagcgggaggcagaacgcgcagaacctggatctgaaccgaaatttcccggacctgacgtccgagtactaccggctggcggagacccgcggcgcacgcagcgaccacatccccatcccccagcactactggtggggtaaggtggccccggagacaaaggcaatcatgaagtggatgcagaccataccctttgtgctctcagccagccttcatgggggcgacctggtggtgtcctaccccttcgacttctccaagcacccccaggaggagaagatgttttctcccacgcccgacgagaagatgttcaagctgctgtccagagcctacgctgacgtccaccccatgatgatggacaggtcggagaataggtgtggaggcaatttcctgaagagggggagcatcatcaacggggcggactggtacagcttcacgggaggcatgtccgatttcaactacctgcacaccaactgctttgagatcacggtagagctgggctgtgtgaagttcccccccgaggaggccctgtacacactctggcagcacaacaaggagtcactcctgaatttcgtggagacggtgcaccggggcatcaaaggtgtggtgacagataaattcggcaagccagtcaaaaacgcccggatctcagtcaaaggcattcgccacgacatcaccacagccccagatggtgactactggagactgctgcccccaggtatccacattgtcattgcccaagcccctggctacgccaaagtcatcaagaaagtcatcatccccgcccggatgaagagggctggccgtgtggacttcattctgcaacctctggggatgggacccaagaactttattcatgggctgcggaggactgggccccacgacccgctgggaggtgccagctctttgggggaggccacggagcccgacccgctccgggcgcgcaggcagccctcggccgacgggagtaagccctggtggtggtcctacttcacatcgctgagcacccacaggccacgctggctgctcaagtactagccccggccccagcacccgccaggatgtggagaccgaggcccatctccgcatcccgggctcctggctcttgattttgtctgccacagacatcccacaaagccgctgccattttattaaagtgttttgatccactttccactggaa

SEQ ID NO: 58736 - DNA, 2744 bp, Homo sapiens
tgggcggactccccatggccagaggctgagctccactcccgccggccgctccctaggggaaggggaaggagaggggagagcagcgacaggcctccagcaagcaagcgcgggcggcatccgcagtctccagaagtttgagacttggccgtaagcggactcgtgcgccccaactctttgccgcgccagcgcctggagcggagagcagaggcggcccggccgcggcgcgccggctttgtcatgatggccagctaccccgagcccgaggacgcggcgggggccctgctggccccagagaccggtcgcacagtcaaggagccagaagggccgccgccgagcccaggcaagggcggtgggggtggcggcgggacagccccggagaagccggacccggcgcagaagcccccgtactcgtacgtggcgctcatcgccatggcgatccgcgagagcgcggagaagaggctcacgctgtccggcatctaccagtacatcatcgcgaagttcccgttctacgagaagaataagaagggctggcaaaatagcatccgccacaacctcagcctcaacgagtgcttcatcaaggtgccgcgcgagggcggcggcgagcgcaagggcaactactggacgctggacccggcctgcgaagacatgttcgagaagggcaactaccggcgccgccgccgcatgaagaggcccttccggccgccgcccgcgcacttccagcccggcaaggggctcttcggggccggaggcgccgcaggcgggtgcggcgtggcgggcgccggggccgacggctacggctacctggcgccccccaagtacctgcagtctggcttcctcaacaactcgtggccgctaccgcagcctccctcacccatgccctatgcctcctgccagatggcggcagccgcagcggctgcagcagctgcggctgcagccgcgggccccggtagccctggcgcggccgctgtggtcaaggggctggcgggcccggccgcctcgtacgggccgtacacacgcgtgcagagcatggcgctgccccccggcgtagtgaactcgtacaatggcctgggaggcccgccggccgcacccccgcctccgccgcacccccacccgcatccgcacgcacaccatctgcacgcggccgccgcaccgccgcctgccccaccgcaccacggggccgccgcgccgccgccgggccagctcagccctgccagcccagccaccgccgcgcccccggcgcccgcgcccaccagtgcgccgggcctgcagttcgcttgtgcccggcagcccgagctcgccatgatgcattgctcttactgggaccacgacagcaagaccggcgcgctgcattcgcgcctcgatctctgagagcccaccgcatgccggtgcagacggatgcgaggatgcagggacgcgcgacgccggccccggtcgcagccgacgacgccgccgccagcctgacctcacaccctctgggcccgcctctggagccagcgcccagggtccctctgtgctttttcgctttcctaagctcctgtcgctcctctttgtcccctcagtttatgtcctcctgtgctcacctccctgacctctgtgaccttgcactcccctggcctgaagctgcctctctgcgcgctttctactgggctcgtctctttccggagccccagcgtctcctgcccaaattcaccgcggaaagggcccggggcggaggtgcgaccgggcgtcggcagcgcagacctcttggccttctctcacaggtcggtgcgctcgctctccgcgttccccgcccgactgccgtgcagtccatggctagacgcgccggacaggactgatggcgggaccgcgctgcccgagaaagggacggaccaatacgtgtgtttgctccgcgaaccctcttgaagctgttcagaagccgcttgccgcggggcccactaggcggggcgggggttgggacccagcgggagccggggcagcctggctccacggcctgtactcggtttacaccgcgggcgggcgcggagggaggctgcgtttcctccgctatcagtcccgtcgcttcgggcacctccgggccccggcggctggctaatgttttgtttgaaagatcggtggaactttttaagagagtatttaaaaaaaaaaaaaggaaaaaaaattcaccgggcaaccggggaagtattgtggccttggagtttgctaaatccaaatatgaaaatcaaaagctttagtattcctcatcttctcttctggaagatttgcgttagagtttttgttgggccttcaaaaagctgtgttcagagttaggagaatatatccaataaaagatggtttcgtctaccaattggggaagtttcaccctctccctatctgaagaaaaaaatcaaaaacaaatgtccccggatctttcgatgcaagtcctggaggcagggagatcactgcctgcctggcccacgctgctgggacggctcgtcctccctgctttttgtttttcaaacctcctgcttctcccaccttgggaaggagaaatgtgaaacccggcagcggccgacctaggcggtcttgtggcccggagccggcccggcccgaaaaccatagacctggttgtactgtagcttgttgtttgggggaccaaattttctagagagaactagagcacttttgttgtgtttttttgttttgtttttgttttttgccttgtcgattcccgaataaattttgtgttccttcttttaaaaaaaaaa

SEQ ID NO: 58737 - DNA, 2088 bp, Homo sapiens
cggagagaagagagagcccggccagacccactgcgatgagacagcaggacgcgcccaagcccactcctgcagcccgccgctgctccggcctggcccggagggtgctgaccatcgccttcgccctgctcatcctgggcctcatgacctgggcctacgccgccggggtgccgctggcctccgatcgctacggcctcctggccttcggcctctacggggccttcctttcagcgcacctggtggcgcagagcctcttcgcgtacctggagcaccggcgggtggcggcggcggcgcgggggccgctggatgcagccaccgcgcgcagtgtggcgctgaccatctccgcctaccaggaggaccccgcgtacctgcgccagtgcctggcgtccgcccgcgccctgctgtacccgcgcgcgcggctgcgcgtcctcatggtggtggatggcaaccgcgccgaggacctctacatggtcgacatgttccgcgaggtcttcgctgacgaggaccccgccacgtacgtgtgggacggcaactaccaccagccctgggaacccgcggcggcgggcgcggtgggcgccggagcctatcgggaggtggaggcggaggatcctgggcggctggcagtggaggcgctggtgaggactcgcaggtgcgtgtgcgtggcgcagcgctggggcggcaagcgcgaggtcatgtacacagccttcaaggcgctcggagattcggtggactacgtgcaggtctgtgactcggacacaaggttggaccccatggcactgctggagctcgtgcgggtactggacgaggacccccgggtaggggctgttggtggggacgtgcggatccttaaccctctggactcctgggtcagcttcctaagcagcctgcgatactgggtagccttcaatgtggagcgggcttgtcagagctacttccactgtgtatcctgcatcagcggtcctctaggcctatataggaataacctcttgcagcagtttcttgaggcctggtacaaccagaagttcctgggtacccactgtacttttggggatgaccggcacctcaccaaccgcatgctcagcatgggttatgctaccaagtacacctccaggtcccgctgctactcagagacgccctcgtccttcctgcggtggctgagccagcagacacgctggtccaagtcgtacttccgtgagtggctgtacaacgcgctctggtggcaccggcaccatgcgtggatgacctacgaggcggtggtctccggcctgttccccttcttcgtggcggccactgtgctgcgtctgttctacgcgggccgcccttgggcgctgctgtgggtgctgctgtgcgtgcagggcgtggcactggccaaggcggccttcgcggcctggctgcggggctgcctgcgcatggtgcttctctcgctctacgcgcccctctacatgtgtggcctcctgcctgccaagttcctggcgctagtcaccatgaaccagagtggctggggcacctcgggccggcggaagctggccgctaactacgtccctctgctgcccctggcgctctgggcgctgctgctgcttgggggcctggtccgcagcgtagcacacgaggccagggccgactggagcggcccttcccgcgcagccgaggcctaccacttggccgcgggggccggcgcctacgtgggctactgggtggccatgttgacgctgtactgggtgggcgtgcggaggctttgccggcggcggaccgggggctaccgcgtccaggtgtgagtccagccacgcggatgccgcctcaagggtcttcaggggaggccagaggagagctgctgggccccgagccacgaacttgctgggtggttctctgggcctcagtttccctcctctgccaaacgagggggtcagcccaagattcttcagtctggactatattgggactgggacttctgggtctccagggagggtatttattggtcaggatgtgggatttgaggagtggaggggaaagggtcctgctttctcctcgttcttatttaatctccatttctactgtgtgatcaggatgtaataaagaattttatttattttc

SEQ ID NO: 58738 - DNA, 2500 bp, Homo sapiens
ctttgcagctgagactgggtggagggagaggcgcggagacactggggctctgacgagctggctgaggccctctcagtaggggggtcacgcctcctggaactcagggaccccaagtttctgtgcattcagggcggggctggccccatgccctgtgcataggggcctggctgcatcccagtcgatcagccagaggcagcagcagtggactcatcaattgtggaggaagccctggggaccctggggaccttgccgactctattcccagccagctcctaggacaagcctcagagccaacacccgctcgaccctctcccggcccctccccttctttgtcttttgcagatgatcgccgggtgtcgatccttttccctccagtcagggccaggcgtggacgccgccggaccgctgagactcggggcacggtgaagcactggccggggtctggctgggtctggcgctcgggagccagatggaggtggcgataggggccatgggagccggcgccaagtagccggtggacccccgcgctcgcacctctcccggcgcccgggcgctccccaaggctgccatggaggtgcctaacgtcaaggacttccagtggaagcgcctggcgccactgcccagccgccgggtctactgctccctgctggagaccgggggccaggtctatgccatcgggggatgtgacgacaacggcgtccccatggactgcttcgaggtctactccccggaggccgaccagtggaccgccttgccccggctgcccacagcccgggcgggggtggccgtcaccgccctggggaagcggatcatggtgattgggggcgtgggcaccaatcagctgcccctgaaggtcgtggagatgtacaacatcgatgagggcaagtggaagaagaggagcatgctgcgtgaggccgccatgggcatttctgtcacggccaaagattaccgagtatatgcggcaggcgggatgggcctggacctacgtccacacaaccacctccaacactatgacatgctgaaggacatgtgggtgtccctagcacccatgcccaccccgagatatgctgccacctccttcctccgaggctccaagatctacgtgctggggggacgacagtccaagtacgcggtcaacgccttcgaggtctttgacatcgagactcgctcctggaccaagtttcccaacattccctataagcgggccttctccagctttgtgaccctggacaaccacttgtacagcctaggaggcctgcggcaaggtcgcctctaccggcagcccaagttcctgcggacgatggacgtgttcgacatggaacaggggggatggctgaagatggaacgatcgttcttcctcaagaagcggcgggcagattttgtggctggctctctgagtggacgggtcatagtggctgggggacttgggaatcaacccactgtcctggagacggcggaagcattccacccagggaagaacaaatgggagatcctccctgccatgcccacaccccgctgtgcctgctccagcatagtcgtcaagaactgcctcctcgccgtgggaggtgtcaaccagggtctgagtgacgcagtggaggccctgtgtgtctctgactcctagctgtctctgggctcagtacctttgccctggaccatatcacttcactcttaacatgaggaatgatcttgtccaagcagtcggggctacttccaagaatgtcagctcctgttagcaaccagtggagtctggccttggggctctaagttgacctctctatagctccaaatcctaccaatctcagaaaactgtaagaggcacagatgactccaccagctgcagagctgactctgaagagagtcttcacttactgcacaggcaaagaaaggcacaggaatatttcctacctctccctcctgtgagtcccacctccccccacccccatctccaggaggcaggtagagcagttctgaccgagaggatagactgctgttgctgtctttccccagctctgaactagttttaaggtagcttaggatgaaaaatggagaatgattgggggttccaaaccactttcttctcccttggcttatatctcttcaccatttggtggtcaactgtgggcctaccctggacctcatctactcagcgagaattggacatgaagctagaggcagctgccttggaagggaagtcaggctcacttggacagcccaggccatggcaggaagaatcccttcctcttggggtccttgatgggcatgtgtgatggggaaggagcagtctcccagccctgggtctgctccccacatctctcctaattccacttcaccttttgccaccccctccccaccagaggcctagcccttttgtcaccgaaggcccccagagtgtttctgtgtgaaaccctctcatttacactgtggcatcaaaatccacaaaagatggattaattgcactctggttaatagcagcagcacaatgattaaaatctatattcct

SEQ ID NO: 58739 - DNA, 652 bp, Homo sapiens
gggaaagggagggtccactgagaaccatcccagtaactcaaccacggctggtcttcgctggacaccatgaaccacactgtccaaaccttcttctctcctgtcaacagcggccagccccccaactatgagatgctcaaggaggagcacaaggtggctgtgctgggggtgccccacaaccctgctcccccaacgtccaccgtgatccacatccgcagcaagacctccgtgccccaccatgtcgtctggtccctgttcaacaccctcttcatgaacccctgctgcctgggcttcatagcatttgcctactccgtgaagtctagggacaggaagatggttggcaacgtgactggggcccaggcctatgcctccaccaccaagtgcctgaacatctgggccctgattttgggcatcctcatgaccattctgctcatcatcatcccagtattaatcttccaagcccatagatagatcaggagacatcactgaggccaggagatctacccatgacctgtatcctttgtactccaccttccattcctcgccctgctcccggagccaagtcctgtatcagccctttatcctcacacacttttttacgacggcattcaataaagtgtacgtgtttctggtaaaataaataaataaataaatt

SEQ ID NO: 58740 - DNA, 543 bp, Homo sapiens
atgggttccaggaagggcagggcagcagaaagtggcagccatctcctcctcggcatcttggccgccctcagaccccttgtgaagcccaagatcgtcaaaaagagaaccaagaagttcatccggcaccagtcagaccattatgtcaaaattaagcgtaactggtggaaacccagaggcattgacaacagggttcgtagaagattcagggtccagatcttgatgcccaacactggttatgggagcaacaaaaaaacaaagcacatgctgcccagtggcttccggaagttcctggtccacaacgtcaaggagctggaagtgctgctgatgtgcaacaatcgtacttgtgccgagatcgctcacaatgtttcctccaagaaccgcaaagccatcgtggaaagagctgcccaactggccatcacagtcaccaaccccagtgccaggctgtgcagcgaagaaaatgagtagacagctcgtgtgcacattttctgtttaaataaatgtaaaaacagccatctggcatcttcctttaaaaaaaaagaaaag

SEQ ID NO: 58741 - DNA, 659 bp, Homo sapiens
gggaaagggagggtccactgagaaccatcccagtaactcaaccacggctggtcttcgctggacaccatgaaccacactgtccaaaccttcttctctcctgtcaacagcggccagccccccaactatgagatgctcaaggaggagcacaaggtggctgtgctgggggtgccccacaaccctgctcccccaacgtccaccgtgatccacatccgcagcaagacctccgtgccccaccatgtcgtctggtccctgttcaacaccctcttcatgaacccctgctgcctgggcttcatagcatttgcctactccgtgaagtctagggacaggaagatggttggcaacgtgactggggcccaggcctatgcctccaccaccaagtgcctgaacatctgggccctgattttgggcatcctcatgaccattctgctcatcatcatcccagtattaatcttccaagcccatcgatagatcaggagacatcactgaggccaggagatctacccatgacctgtatcctttgtactccaccttccattcctcgccctgctcccggagccaagtcctgtatcagccctttatcctcacacacttttttacgacggcattcaataaagtgtacgtgtttctggtaaaataaataaataaataaattcaaatat

SEQ ID NO: 58742 - DNA, 543 bp, Homo sapiens
atgggttccaggaagggcagggcagcagaaagtggcagccatctcctcctcggcatcttggccgccctcagaccccttgtgaagcccaagatcgtcaaaaagagaaccaagaagttcatccggcaccagtcagaccattatgtcaaaattaagcgtaactggtggaaacccagaggcattgacaacagggttcgtagaagattcagggtccagatcttgatgcccaacactggttatgggagcaacaaaaaaacaaagcacatgctgcccagtggcttccggaagttcctggtccacaacgtcaaggagctggaagtgctgctgatgtgcaacaatcgtacttgtgccgagatcgctcacaatgtttcctccaagaaccgcaaagccatcgtggaaagagctgcccaactggccatcacagtcaccaaccccaatgccaggctgtgcagcgaagaaaatgagtagacagctcgtgtgcacattttctgtttaaataaatgtaaaaacagccatctggcatcttcctttaaaaaaaaagaaaag

SEQ ID NO: 58743 - DNA, 2071 bp, Homo sapiens
gcccctcacctgaccaatcaagacggccggccgaggcccctggaacggctcaggcggctgcggctgctacggcggcgcatgctaggggattctgccgggtagaagagctgggcctggaacccagccctgaggacatcctgcggcccaggggcaagtgacacctgctgagagaggcccaggatggtggaggctgaggaactggcacagctgcggctgctcaatctggagctcctgaggcagctgtgggtggggcaggatgctgtgcggcggtcagtggccagggcagcctcggagtcaagcctggaatccagcagcagctacaactcagagactccatcgaccccagagacgtcctcaacttccttgagcacctcctgcccacggggccggtcctccgtgtggggcccaccagatgcctgtcgaggggacctccgtgatgtggccagatcgggggtggcctctctcccacctgccaaatgccagcaccaggagtccctgggccgaccgagaccccactcagcaccctcgctgggcacctcaagcctgagggacccagagccctcagggaggctgggtgatccaggaccccaggaggcacagaccccgaggtccatcctggctcaacagagcaagctgtccaagcccagggtgaccttctctgaggagtctgcagttcctaagaggagctggcgcctcaggccatacctgggctatgactggattgcagggtctctggacaccagctcttccatcaccagccagcctgaggccttcttctccaagctgcaggagtttcgggaaaccaacaaggaggagtgtatctgcagccatcctgaaccccagttgccaggcctgcgtgagagcagtggcagcggcgtggaggaagaccatgaatgtgagtgcgggccctcggctaggccgctgagtagtccagcctcgcgctgccctggcctcccctgccccagagcagtcccatttgaggtttggggcctggggaggcccctgagatgttgagactcatggagggaggcctgcagtctggacagggtggccaagccctggtaggggtggagtgagctaaggcctggccaccgaattaggggctgccctgtgtggcaccatcccaccctccccagcagtgcccctgtgctggtgggactccatcccagctcctgagggccccaggaggatgtccctccccaccccttagggcgtgggccccaggttctgggaggaaaggggttaggaggaaatgggccgaagggcttcccagagggattggcagcttgtgtggttgggggccgctgagggcagcacggagcctggggacctgggttcctggctcagggagagctgtggcttctcatgggcctcgcaggcgtgtactgttaccgtgtcaaccggcgcctgttcccggtgcctgtggatcccggtaccccctgccgcctgtgcaggacaccgcgagaccagcagggccctgggaccctggcgcagccagcgcacgtcagggtgagcatcccgctgtcgatcctggagcccccgcaccggtaccacatccaccggcgaaagagctttgacgcctctgacacactggccctgccccggcactgcctgctgggctgggacatttttcctccgaagtctgagaaaagctcagcccccaggaacctggacctctggtcctctgtctccgctgaggcccagcaccagaagctgtccggcaccagcagcccttttcacccggcctcaccaatgcagatgctgcccccgaccccgacctggtcagtgccccaggtccctcggccccacgtcccacggcagaagccctgaggactgactcctgggggagaacagcattcccgccgcctccagcctctcccctctggcaggcgcacccaggagatggaatcccctgcccgcccagctcaggcccagctgtcctaggttgggcaggtgggtggacccaagcttgtctgctgcctgagttccagagagggaggaccctggggtggagggtgagggattctgtggaagtttgtaaataaagctcagtgctctgcagctcaagtcc

SEQ ID NO: 58744 - DNA, 1588 bp, Homo sapiens
gcccctcacctgaccaatcaagacggccggccgaggcccctggaacggctcaggcggctgcggctgctacggcggcgcatgctaggggattctgccgggtagaagagctgggcctggaacccagccctgaggacatcctgcggcccaggggcaagtgacacctgctgagagaggcccaggatggtggaggctgaggaactggcacagctgcggctgctcaatctggagctcctgaggcagctgtgggtggggcaggatgctgtgcggcggtcagtggccagggcagcctcggagtcaagcctggaatccagcagcagctacaactcagagactccatcgaccccagagacgtcctcaacttccttgagcacctcctgcccacggggccggtcctccgtgtggggcccaccagatgcctgtcgaggggacctccgtgatgtggccagatcgggggtggcctctctcccacctgccaaatgccagcaccaggagtccctgggccgaccgagaccccactcagcaccctcgctgggcacctcaagcctgagggacccagagccctcagggaggctgggtgatccaggaccccaggaggcacagaccccgaggtccatcctggctcaacagagcaagctgtccaagcccagggtgaccttctctgaggagtctgcagttcctaagaggagctggcgcctcaggccatacctgggctatgactggattgcagggtctctggacaccagctcttccatcaccagccagcctgaggccttcttctccaagctgcaggagtttcgggaaaccaacaaggaggagtgtatctgcagccatcctgaaccccagttgccaggcctgcgtgagagcagtggcagcggcgtggaggaagaccatgaatgcgtgtactgttaccgtgtcaaccggcgcctgttcccggtgcctgtggatcccggtaccccctgccgcctgtgcaggacaccgcgagaccagcagggccctgggaccctggcgcagccagcgcacgtcagggtgagcatcccgctgtcgatcctggagcccccgcaccggtaccacatccaccggcgaaagagctttgacgcctctgacacactggccctgccccggcactgcctgctgggctgggacatttttcctccgaagtctgagaaaagctcagcccccaggaacctggacctctggtcctctgtctccgctgaggcccagcaccagaagctgtccggcaccagcagcccttttcacccggcctcaccaatgcagatgctgcccccgaccccgacctggtcagtgccccaggtccctcggccccacgtcccacggcagaagccctgaggactgactcctgggggagaacagcattcccgccgcctccagcctctcccctctggcaggcgcacccaggagatggaatcccctgcccgcccagctcaggcccagctgtcctaggttgggcaggtgggtggacccaagcttgtctgctgcctgagttccagagagggaggaccctggggtggagggtgagggattctgtggaagtttgtaaataaagctcagtgctctgcagctcaagtcc

SEQ ID NO: 58745 - DNA, 657 bp, Homo sapiens
actcctggtacctaagcaccgatctgccttggagaacctgattctgagactccagcaggatgtcttatcaacagcagcagtgcaagcagccctgccagccacctcctgtgtgccccgcgccaaagtgcccagagccatgtccacccccgaagtgccctgagccctgcccaccatcaaagtgtccacagtcctgcccacctcagcagtgccagcagaaatgtcctcctgtgacaccttccccaccctgccagccaaagtgtccacccaagagcaagtaacagcttcaggattcatcaggagcatgaaaggataaggataattggctcacctcgttccacagctccacctgcatcttctcatcaaagccatccagggatacacagggagcttctttcctcttagcctgtgatcggcctgtgatgatctctgatagcaaaaggttttctttttgaggctgccatactgccactgtcgaggtggagactgagcaaaggaagtcctgggctgtgccagctcccagagcttcagaagaaagagcagctctctccctgggaaccattagagaattctgttgatgttttctgtgtctgtctgtcccctgggcatgagcttccaccacctgtgcagttgtcactttcctttcactccctgaataaa

SEQ ID NO: 58746 - DNA, 3534 bp, Homo sapiens
aaaacaagcaggtgtcccaccgtgccagatacgctgcctaaactgcttccagcttctttttttttttttccccccttctgcaataagtctgtgatcagccacgggacagaggcgccagcagcctgcctgtgacaggcatcaggttagctggctcccactcgggtggcgcgcccaggatataaatccgggcgcgggcccctgctgtggctcctctccctgcacactcaggagagggagcttccttctaaagacctttcttttatctgaagccgcacagcccggcaggctgtgctgacttggtggaggcagcagcggcagagcagcctgagcagcagcctgagcaggaaacctgctggggtggggagggcaggtgtctgcagcccctgagaagaaggccctggtgggccccagaccctggcatcgtttcaggggaggtctctagccgccccagcctgcaccatgtgggccccaaggtgtcgccggttctggtctcgctgggagcaggtggcagcgctgctgctgctgctgctactgctcggggtgcccccgcgaagcctggcgctgccgcccatccgctattcccacgccggcatctgccccaacgacatgaatcccaacctctgggtggacgcacagagcacctgcaggcgggagtgtgagacggaccaggagtgtgagacctatgagaagtgctgccccaacgtatgtgggaccaagagctgcgtggcggcccgctacatggacgtgaaagggaagaagggcccagtgggcatgcccaaggaggccacatgtgaccacttcatgtgtctgcagcagggctctgagtgtgacatctgggatggccagcccgtgtgtaagtgcaaagaccgctgtgagaaggagcccagctttacctgcgcctcggacggcctcacctactataaccgctgctacatggatgccgaggcctgctccaaaggcatcacactggccgttgtaacctgccgctatcacttcacctggcccaacaccagccccccaccacctgagaccaccatgcaccccaccacagcctccccagagacccctgagctggacatggcggcccctgcgctgctcaacaaccctgtgcaccagtcggtcaccatgggtgagacagtgagcttcctctgtgatgtggtgggccggccccggcctgagatcacctgggagaagcagttggaggatcgggagaatgtggtcatgcggcccaaccatgtgcgtggcaacgtggtggtcaccaacattgcccagctggtcatctataacgcccagctgcaggatgctgggatctacacctgcacggcccggaacgtggctggggtcctgagggctgatttcccgctgtcggtggtcaggggtcatcaggctgcagccacctcagagagcagccccaatggcacggctttcccggcggccgagtgcctgaagcccccagacagtgaggactgtggcgaagagcagacccgctggcacttcgatgcccaggccaacaactgcctgaccttcaccttcggccactgccaccgtaacctcaaccactttgagacctatgaggcctgcatgctggcctgcatgagcgggccgctggccgcgtgcagcctgcccgccctgcaggggccctgcaaagcctacgcgcctcgctgggcttacaacagccagacgggccagtgccagtcctttgtctatggtggctgcgagggcaatggcaacaactttgagagccgtgaggcctgtgaggagtcgtgccccttccccagggggaaccagcgctgtcgggcctgcaagcctcggcagaagctcgttaccagcttctgtcgcagcgactttgtcatcctgggccgagtctctgagctgaccgaggagcctgactcgggccgcgccctggtgactgtggatgaggtcctaaaggatgagaaaatgggcctcaagttcctgggccaggagccattggaggtcactctgcttcacgtggactgggcatgcccctgccccaacgtgaccgtgagcgagatgccgctcatcatcatgggggaggtggacggcggcatggccatgctgcgccccgatagctttgtgggcgcatcgagtgcccgccgggtcaggaagcttcgtgaggtcatgcacaagaagacctgtgacgtcctcaaggagtttcttggcttgcactgaagccccccacccctccctgccccctccctggccttcttccacctatccaccccaatgcctctcagcaaactgggcgaggtcagattagacaggcttgggacagcagggaaacatcaaccgacgtgtcacagaaaaagccacagaaggtctcagatcagcatctattctttgggttcaataaggggttcatatcttttttagctgagggggacaagaggagaagtcagtggacacatggaagttactcgtgaccaccagcttgctcagatattctcctcctcccctcactggccccacacccctggctctcccagtcaccctcccctagccagtctcccagcaagggtttaagagatggccgctgtgtgctggtcacaggaagtgttgaatggattggcttgcaaagggggtaggtggggagagataggagggcccagggactcatgggacacctttcccacagcctcctcgattgctgtgagcagaggccactcggagttaggggcatgggcaatagcaagctggcggcagagtccagcccagcatatgacttgccctgaatggaagctgctgaaacgggtgcctttgggtggtggtcggcttgcctctgaggccaccacggcaccagcagaatacgtatttcttctccttggctgcactggtttgtcgatctagttcagttcaactcagtggatgttctctgaatgcttactgggtgccaggaccacagagagatgttagtcactgcccagttcttagagccccaacacagataccctcatcccagggcccccagacacacccctccgctggactcacaactgtctggagtttctgtctgatggatggtgtgctttcatatgccactggcttccttggacatagatcagacaaaagccccgggatctgtttggtagcaggagaaatgaaggaagatgaaaaagcaggcagggaagggggtagtaaaggactgagagaggagggaggtggctggagaaggaaaaggaacattgctcgatgctcccatctggtggcggcctcaggaacccacgggaacctggaaggaggctctttgtgagacctgggcaaaggatggggcagctcgtcgatgatttttttgtgtttccaggcttcctgtgtgatcctggccctccggccgctagagagaggattgggaaaccccactgtcagctctgcatctgcccccactaccctcctctgccctattctgtccctgcccctccaagctgaagaaggtccttgtggggcgtcctcatttcttcctcaaatataaggaggaagataccaattaaaagctcatagtatcaaaaaaaaaaaaaaaaa

SEQ ID NO: 58747 - protein, 652 aa, Homo sapiens
MPPPPPLLLLTVLVVAAARPGCEFERNPAGECHRPPAADSATCVDLQLRTCSDAAYNHTTFPNLLQHRSWEVVEASSEYILLSVLHQLLEGQCNPDLRLLGCAVLAPRCEGGWVRRPCRHICEGLREVCQPAFDAIDMAWPYFLDCHRYFTREDEGCYDPLEKLRGGLEADEALPSGLPPTFIRFSHHSYAQMVRVLRRTASRCAHVARTYSIGRSFDGRELLVIEFSSRPGQHELMEPEVKLIGNIHGNEVAGREMLIYLAQYLCSEYLLGNPRIQRLLNTTRIHLLPSMNPDGYEVAAAEGAGYNGWTSGRQNAQNLDLNRNFPDLTSEYYRLAETRGARSDHIPIPQHYWWGKVAPETKAIMKWMQTIPFVLSASLHGGDLVVSYPFDFSKHPQEEKMFSPTPDEKMFKLLSRAYADVHPMMMDRSENRCGGNFLKRGSIINGADWYSFTGGMSDFNYLHTNCFEITVELGCVKFPPEEALYTLWQHNKESLLNFVETVHRGIKGVVTDKFGKPVKNARISVKGIRHDITTAPDGDYWRLLPPGIHIVIAQAPGYAKVIKKVIIPARMKRAGRVDFILQPLGMGPKNFIHGLRRTGPHDPLGGASSLGEATEPDPLRARRQPSADGSKPWWWSYFTSLSTHRPRWLLKY

SEQ ID NO: 58748 - protein, 515 aa, Homo sapiens
MAWPYFLDCHRYFTREDEGCYDPLEKLRGGLEADEALPSGLPPTFIRFSHHSYAQMVRVLRRTASRCAHVARTYSIGRSFDGRELLVIEFSSRPGQHELMEPEVKLIGNIHGNEVAGREMLIYLAQYLCSEYLLGNPRIQRLLNTTRIHLLPSMNPDGYEVAAAEGAGYNGWTSGRQNAQNLDLNRNFPDLTSEYYRLAETRGARSDHIPIPQHYWWGKVAPETKAIMKWMQTIPFVLSASLHGGDLVVSYPFDFSKHPQEEKMFSPTPDEKMFKLLSRAYADVHPMMMDRSENRCGGNFLKRGSIINGADWYSFTGGMSDFNYLHTNCFEITVELGCVKFPPEEALYTLWQHNKESLLNFVETVHRGIKGVVTDKFGKPVKNARISVKGIRHDITTAPDGDYWRLLPPGIHIVIAQAPGYAKVIKKVIIPARMKRAGRVDFILQPLGMGPKNFIHGLRRTGPHDPLGGASSLGEATEPDPLRARRQPSADGSKPWWWSYFTSLSTHRPRWLLKY

SEQ ID NO: 58749 - protein, 641 aa, Homo sapiens
MPPPPPLLLLTVLVVAAARPGCEFERNPAATCVDLQLRTCSDAAYNHTTFPNLLQHRSWEVVEASSEYILLSVLHQLLEGQCNPDLRLLGCAVLAPRCEGGWVRRPCRHICEGLREVCQPAFDAIDMAWPYFLDCHRYFTREDEGCYDPLEKLRGGLEADEALPSGLPPTFIRFSHHSYAQMVRVLRRTASRCAHVARTYSIGRSFDGRELLVIEFSSRPGQHELMEPEVKLIGNIHGNEVAGREMLIYLAQYLCSEYLLGNPRIQRLLNTTRIHLLPSMNPDGYEVAAAEGAGYNGWTSGRQNAQNLDLNRNFPDLTSEYYRLAETRGARSDHIPIPQHYWWGKVAPETKAIMKWMQTIPFVLSASLHGGDLVVSYPFDFSKHPQEEKMFSPTPDEKMFKLLSRAYADVHPMMMDRSENRCGGNFLKRGSIINGADWYSFTGGMSDFNYLHTNCFEITVELGCVKFPPEEALYTLWQHNKESLLNFVETVHRGIKGVVTDKFGKPVKNARISVKGIRHDITTAPDGDYWRLLPPGIHIVIAQAPGYAKVIKKVIIPARMKRAGRVDFILQPLGMGPKNFIHGLRRTGPHDPLGGASSLGEATEPDPLRARRQPSADGSKPWWWSYFTSLSTHRPRWLLKY

SEQ ID NO: 58750 - protein, 376 aa, Homo sapiens
MMASYPEPEDAAGALLAPETGRTVKEPEGPPPSPGKGGGGGGGTAPEKPDPAQKPPYSYVALIAMAIRESAEKRLTLSGIYQYIIAKFPFYEKNKKGWQNSIRHNLSLNECFIKVPREGGGERKGNYWTLDPACEDMFEKGNYRRRRRMKRPFRPPPAHFQPGKGLFGAGGAAGGCGVAGAGADGYGYLAPPKYLQSGFLNNSWPLPQPPSPMPYASCQMAAAAAAAAAAAAAAGPGSPGAAAVVKGLAGPAASYGPYTRVQSMALPPGVVNSYNGLGGPPAAPPPPPHPHPHPHAHHLHAAAAPPPAPPHHGAAAPPPGQLSPASPATAAPPAPAPTSAPGLQFACARQPELAMMHCSYWDHDSKTGALHSRLDL

SEQ ID NO: 58751 - protein, 578 aa, Homo sapiens
MRQQDAPKPTPAARRCSGLARRVLTIAFALLILGLMTWAYAAGVPLASDRYGLLAFGLYGAFLSAHLVAQSLFAYLEHRRVAAAARGPLDAATARSVALTISAYQEDPAYLRQCLASARALLYPRARLRVLMVVDGNRAEDLYMVDMFREVFADEDPATYVWDGNYHQPWEPAAAGAVGAGAYREVEAEDPGRLAVEALVRTRRCVCVAQRWGGKREVMYTAFKALGDSVDYVQVCDSDTRLDPMALLELVRVLDEDPRVGAVGGDVRILNPLDSWVSFLSSLRYWVAFNVERACQSYFHCVSCISGPLGLYRNNLLQQFLEAWYNQKFLGTHCTFGDDRHLTNRMLSMGYATKYTSRSRCYSETPSSFLRWLSQQTRWSKSYFREWLYNALWWHRHHAWMTYEAVVSGLFPFFVAATVLRLFYAGRPWALLWVLLCVQGVALAKAAFAAWLRGCLRMVLLSLYAPLYMCGLLPAKFLALVTMNQSGWGTSGRRKLAANYVPLLPLALWALLLLGGLVRSVAHEARADWSGPSRAAEAYHLAAGAGAYVGYWVAMLTLYWVGVRRLCRRRTGGYRVQV

SEQ ID NO: 58752 - protein, 350 aa, Homo sapiens
MEVPNVKDFQWKRLAPLPSRRVYCSLLETGGQVYAIGGCDDNGVPMDCFEVYSPEADQWTALPRLPTARAGVAVTALGKRIMVIGGVGTNQLPLKVVEMYNIDEGKWKKRSMLREAAMGISVTAKDYRVYAAGGMGLDLRPHNHLQHYDMLKDMWVSLAPMPTPRYAATSFLRGSKIYVLGGRQSKYAVNAFEVFDIETRSWTKFPNIPYKRAFSSFVTLDNHLYSLGGLRQGRLYRQPKFLRTMDVFDMEQGGWLKMERSFFLKKRRADFVAGSLSGRVIVAGGLGNQPTVLETAEAFHPGKNKWEILPAMPTPRCACSSIVVKNCLLAVGGVNQGLSDAVEALCVSDS

SEQ ID NO: 58753 - protein, 133 aa, Homo sapiens
MNHTVQTFFSPVNSGQPPNYEMLKEEHKVAVLGVPHNPAPPTSTVIHIRSKTSVPHHVVWSLFNTLFMNPCCLGFIAFAYSVKSRDRKMVGNVTGAQAYASTTKCLNIWALILGILMTILLIIIPVLIFQAHR

SEQ ID NO: 58754 - protein, 154 aa, Homo sapiens
MGSRKGRAAESGSHLLLGILAALRPLVKPKIVKKRTKKFIRHQSDHYVKIKRNWWKPRGIDNRVRRRFRVQILMPNTGYGSNKKTKHMLPSGFRKFLVHNVKELEVLLMCNNRTCAEIAHNVSSKNRKAIVERAAQLAITVTNPSARLCSEENE

SEQ ID NO: 58755 - protein, 133 aa, Homo sapiens; identical to SEQ ID NO: 58753

SEQ ID NO: 58756 - protein, 154 aa, Homo sapiens
MGSRKGRAAESGSHLLLGILAALRPLVKPKIVKKRTKKFIRHQSDHYVKIKRNWWKPRGIDNRVRRRFRVQILMPNTGYGSNKKTKHMLPSGFRKFLVHNVKELEVLLMCNNRTCAEIAHNVSSKNRKAIVERAAQLAITVTNPNARLCSEENE

SEQ ID NO: 58757 - protein, 277 aa, Homo sapiens
MVEAEELAQLRLLNLELLRQLWVGQDAVRRSVARAASESSLESSSSYNSETPSTPETSSTSLSTSCPRGRSSVWGPPDACRGDLRDVARSGVASLPPAKCQHQESLGRPRPHSAPSLGTSSLRDPEPSGRLGDPGPQEAQTPRSILAQQSKLSKPRVTFSEESAVPKRSWRLRPYLGYDWIAGSLDTSSSITSQPEAFFSKLQEFRETNKEECICSHPEPQLPGLRESSGSGVEEDHECECGPSARPLSSPASRCPGLPCPRAVPFEVWGLGRPLRC

SEQ ID NO: 58758 - protein, 388 aa, Homo sapiens
MVEAEELAQLRLLNLELLRQLWVGQDAVRRSVARAASESSLESSSSYNSETPSTPETSSTSLSTSCPRGRSSVWGPPDACRGDLRDVARSGVASLPPAKCQHQESLGRPRPHSAPSLGTSSLRDPEPSGRLGDPGPQEAQTPRSILAQQSKLSKPRVTFSEESAVPKRSWRLRPYLGYDWIAGSLDTSSSITSQPEAFFSKLQEFRETNKEECICSHPEPQLPGLRESSGSGVEEDHECVYCYRVNRRLFPVPVDPGTPCRLCRTPRDQQGPGTLAQPAHVRVSIPLSILEPPHRYHIHRRKSFDASDTLALPRHCLLGWDIFPPKSEKSSAPRNLDLWSSVSAEAQHQKLSGTSSPFHPASPMQMLPPTPTWSVPQVPRPHVPRQKP

SEQ ID NO: 58759 - protein, 72 aa, Homo sapiens
MSYQQQQCKQPCQPPPVCPAPKCPEPCPPPKCPEPCPPSKCPQSCPPQQCQQKCPPVTPSPPCQPKCPPKSK

SEQ ID NO: 58760 - protein, 576 aa, Homo sapiens
MWAPRCRRFWSRWEQVAALLLLLLLLGVPPRSLALPPIRYSHAGICPNDMNPNLWVDAQSTCRRECETDQECETYEKCCPNVCGTKSCVAARYMDVKGKKGPVGMPKEATCDHFMCLQQGSECDIWDGQPVCKCKDRCEKEPSFTCASDGLTYYNRCYMDAEACSKGITLAVVTCRYHFTWPNTSPPPPETTMHPTTASPETPELDMAAPALLNNPVHQSVTMGETVSFLCDVVGRPRPEITWEKQLEDRENVVMRPNHVRGNVVVTNIAQLVIYNAQLQDAGIYTCTARNVAGVLRADFPLSVVRGHQAAATSESSPNGTAFPAAECLKPPDSEDCGEEQTRWHFDAQANNCLTFTFGHCHRNLNHFETYEACMLACMSGPLAACSLPALQGPCKAYAPRWAYNSQTGQCQSFVYGGCEGNGNNFESREACEESCPFPRGNQRCRACKPRQKLVTSFCRSDFVILGRVSELTEEPDSGRALVTVDEVLKDEKMGLKFLGQEPLEVTLLHVDWACPCPNVTVSEMPLIIMGEVDGGMAMLRPDSFVGASSARRVRKLREVMHKKTCDVLKEFLGLH

SEQ ID NO: 58761 - DNA, 20 bp, Homo sapiens
gatcaaaacactttaataaa

SEQ ID NO: 58762 - DNA, 20 bp, Homo sapiens
gatctcagtcaaaggcattc

SEQ ID NO: 58763 - DNA, 20 bp, Homo sapiens
gatcactgcctgcctggccc

SEQ ID NO: 58764 - DNA, 20 bp, Homo sapiens
gatcggtggaactttttaag

SEQ ID NO: 58765 - DNA, 20 bp, Homo sapiens
gatcaggatgtaataaagaa

SEQ ID NO: 58766 - DNA, 20 bp, Homo sapiens
gatcttgtccaagcagtcgg

SEQ ID NO: 58767 - DNA, 20 bp, Homo sapiens
gatcaggagacatcactgag

SEQ ID NO: 58768 - DNA, 20 bp, Homo sapiens
gatcttgatgcccaacactg

SEQ ID NO: 58769 - DNA, 20 bp, Homo sapiens
gatcttcttaatatagctgt

SEQ ID NO: 58770 - DNA, 20 bp, Homo sapiens
gatcagccctgagagcaggt

SEQ ID NO: 58771 - DNA, 20 bp, Homo sapiens
gatccttggaaaggagttgt

SEQ ID NO: 58772 - DNA, 20 bp, Homo sapiens
gatctctcttgtctagtacg

SEQ ID NO: 58773 - DNA, 20 bp, Homo sapiens
gatcccggtaccccctgccg

SEQ ID NO: 58774 - DNA, 20 bp, Homo sapiens
gatctctgatagcaaaaggt

SEQ ID NO: 58775 - DNA, 20 bp, Homo sapiens
gatcacacaggaagcctgga

SEQ ID NO: 58776 - DNA, 20 bp, Homo sapiens
gatcctggccctccggccgc

SEQ ID NO: 58777 - DNA, 20 bp, Homo sapiens
gatctgtttggtagcaggag

SEQ ID NO: 58778 - DNA, 1939 bp, Homo sapiens
aatgaccatgtgtagcggagcgaggctggccctgctggtctatgggataatcatgcacagcagcgtctacagctcacctgccgccgccggactccggttccccgggatcaggccagaggaagaggcgtacggcgaggacggaaacccgctgccagacttcggtggctcggagccgccgggcgcagggagccccgcctccgcgccgcgcgccgccgccgcctggtaccgcccggccgggagaagagatgtcgcccacgggatccttaacgaggcctaccgcaaagtgctggaccagctgtccgccgggaagcacctgcagtcgctcgtggcccggggcgtgggtgggagcctcggcggcggcgcgggggacgacgcggagccgctctccaagcgccactcggacgggatcttcacggacagctacagccgctaccggaaacaaatggctgtcaagaaatacttggcggccgtcctagggaagaggtataaacaaagggttaaaaacaaaggacgccgaatagcttatttgtagcgatgggttaccagctaccctgtgtatacagccctgacgcaatgaaaagtcgttttccaaactgactcaacagtcatcgctcgtgtgttctatccaaacatgtatttatgtaatgaagtaaagccattaaatgaatattttgataataatattgtttttctttctacaaagcactagagaatgcacagatatactttgtggaccaattattgatatatattataaatatatataaagaatatatatatatatatatatataaagtatagagagaagttcatacaaagcgtgcacaaggattgaaaattcgcccgagctgtttatgtttttataaaaataaatagaaaagtagacaatcattgttttgaatattactcctatttttgtaaactggaattaaaaggatagtatttttatccatgacaggcctgaagatattactacttaccatttgctactgtacataaacaatgatgccctgctccagggagattttgaggtaaagatatggagaattgctgaagggcattctttcccagtgagtctctggggcaggctgcttcaatcccagcctaactcaactgggctctgtccccctggttgggtggcaattccaatatttctgctttctttgattctccttttatgtgtagttgtctctcttcagactctcagcccagaagaaaattctcctgataaaacaacagctcgatccaaattgtgcttctccccagaattcacgcctctccctaggagaagagttgaggaactgtacagaaaagggcggcttcgttagaccgctctcttttctgtacttcctgagtggccagggaatctaatatccccaaattagggcaattggaacaaagtgaaggacatagaggtatattggaagaggcagagcctgaggtggtaggaggacgaccctggaaatggactggtttgagattgccccaggtctgggaagctgagggcaaatccagtcccagtggtcctgactttgggcgctgggtattggaaatggatgcaaagtacaatgtgtttttctccagtgctgtccatgcttctcatcttgtgaaatggccaggatcctctcctttgaaacctgctctgtaggagctacccttttcctttgtggttttatggagacctctccttcctaccctcctgcactgtttaagtactgtttaccatttttcattcacttctcttaaacttgtgaatgcttctcacttttttttttgtttgatgcaggcacttattgtaaattttagaaacccctctgtagccactagtaagtaattatgcactaaatatgaaccctttgtttcttgtttattgagtttgtaggtaaaatgtatttttctacattattgcttattgcttagtaaaatttatttcataaaa

SEQ ID NO: 58779 - DNA, 2397 bp, Homo sapiens
accctcacccctgagcagcccggggggccacagcaagaggtacacatgctgtggacaccagcacccccagacctgacccttggggaaggtgaggaggctaggacgtgggacttcctgacagcggtgggcggcagccaggctgaggctcaggcctgcctcactgaggccctgcagctgcaggccaggggagctctgtatacggctcacgcacaggcctgggcccagctctgggtagaatgtggcttggacgtggtggggcccctgcagctgcgccaggccctgcgtggctccctctactacctgctcagtgccctgccccagcccaaggccccaggatacatctgccatggcctcagtcctgggggcctctccaatgggagccgtgaggaatgctactggggccacgtcttctgggaccaggacctctggatgttcccgagtatcctgatgttccacccagaagccgccagggccatcctggagtaccgcatccgcacgctggacggggccctggagaacgcccagaacctgggctaccagggagccaagtttgcctgggagagtgcagactccggcctagaggtttgccctgaggacatttacggagtccaggaggtccacgtcaacggggccgtggtgttggccttcgagctgtactaccataccacccaggacctgcagctatttcgagaggctggtggctgggacgtggtcagggctgtggccgagttttggtgcagtcgtgttgagtggagccccagggaggaaaagtaccacctgaggggagtcatgtcccccgacgagtaccattcaggggtcaacaactctgtgtacaccaacgtcctggtccagaacagcctgcgctttgctgctgccctggcccaggacctgggtcttcccatccccagccagtggctggcggtggctgacaagatcaaggtaccctttgacgtggagcagaacttccacccggagttcgatgggtatgagcctggagaggtggtgaagcaggcagacgtcgtgctcctgggatacccagtccccttctccctgagtcctgatgttcgcaggaaaaatctggagatttacgaggctgtgacgtccccccagggccccgccatgacctggagcatgtttgctgtgggctggatggagctgaaggacgcagtgcgggcccggggcctcctggacaggagctttgccaacatggctgaacccttcaaggtgtggacggagaatgcagacgggtcaggcgctgtgaacttcctgacaggcatggggggcttcctgcaggcggtggtcttcgggtgcacggggttcagggtcacccgagcgggtgtgacctttgaccctgtgtgtctgtcggggatctccagagtgagcgtctccggcatcttctaccaggggaacaagctcaacttctctttttccgaggactccgtgaccgtggaggtcacagctcgagcagggccctgggctcctcacctggaggctgagctgtggccatcccagtcccggctctccctgttgccaggacacaaggtctcctttccccgctcggctggccggatacaaatgtcacccccgaagctgcctggaagttccagctccgagttccctgggaggactttttcagatgttagggacccgctccagagccccctctgggtcaccctgggttcctccagccccaccgagtcactcactgtggaccctgcctctgaataatcaggaacggtggcttcagagacgtctcttgggccttccctctggccacgtctgcacccacccctcctgggcaccctcctagcctgccatccctcacctgcagccaggctctcagggaaggtccatgctgcttggcctgagttcaaggctttctgcctgtagcctggactcccgtggacccccgtgggcaggtggcttccccgtggcatctccacaccgcctctgcctgcccctgtggactgatgctatcgcgcacggtcccacgaccccaccccgagctcctgaagccggggtctgagcctgcatcacctctggcctctcatcccccactctcctgagagcagtggtcacagcggccggccgctctgctgagaaggcagagaggcaggctcaggcctcagcgtggacagcagggataaggggcacgaaggacggggactcggccccttcagaattcctcaggactctcaggtgcagctttgccaaaaaggaacttttcatgtcatgcagttgaggggacttagtctcaatcccaggctcctcttgactctgggcagctttaatcaggttgggcagcctctgctacagcgtggagtgggatggctctcttccctcagccacgccgcttgtgaggacagaggtgggggagtgggaagtgggaagtacatg

SEQ ID NO: 58780 - DNA, 639 bp, Homo sapiens
ctgacaagatgtccctgtggactcccaaactctactccagatggggaggtgcccttaacaccaagattttaaaagctccaatttcagagcaagagtcgaaaactcacagataaagttatagttatttcagggttctgaaaagacgcagaacatgaagggactcagaagtctggcagcaacaaccttggctcttttcctggtgtttgttttcctgggaaactccagctgcgctccgcagagactgttggagagaaggaactggactcctcaagctatgctctacctgaaaggggcacagggtcgccgcttcatctccgaccagagccggagaaaggacctctccgaccggccactgccggaaagacgaagcccaaatccccaactactaactattccggaggcagcaaccatcttactggcgtcccttcagaaatcaccagaagatgaagaaaaaaactttgatcaaaccagattcctggaagacagtctgcttaactggtgaaaatatactggattatgtttaattatggttctattctctttgaaaacatgaaccatgtgaataaaacctttggaccctttttaaaaaaaaaaaaaaaaaaaaaaaaaaaaaaaaaaaaaaaaaaaaaaaaaaaaaaa

SEQ ID NO: 58781 - DNA, 1517 bp, Homo sapiens
gcgaggcaggagccggcggctgggctccgcagcgcagccagcgcagcgcggcgccccgggcccggccccatgcccgcagccccgccggaccgtccttgagcgcgggcgcctagcccgcgccccctgcccgccggcaccattgccccgacggcgcggccgggcggcccggcgctccccaggctccgcgcgggccgaaagacgctgctagcggccgccgcgggtgtggtgatgctgctggtgctggtggtgctcatccccgtgctggtgagctcgggcggcccggaaggccactatgagatgctgggcacctgccgcatggtgtgcgacccctaccccgcgcggggccccggcgccggcgcgcggaccgacggcggcgacgccctgagcgagcagagcggcgcgcccccgccttccacgctggtgcagggcccccaggggaagccgggccgcaccggcaagcccggccctccggggcctcccggggacccaggtcctcccggccctgtggggccgccgggggagaagggtgagccaggcaagccgggccctccggggctgccgggcgcggggggcagcggcgccatcagcactgccacctacaccacggtgccgcgcgtggccttctacgccggcctcaagaacccccacgagggttacgaggtactcaagtttgacgacgtggtcaccaacctaggcaacaactacgacgcggccagcggcaagtttacgtgcaacattcccggcacctactttttcacctaccatgtcctcatgcgcggcggcgacggcaccagtatgtgggcagacctctgcaagaatggccaggtgcgggccagtgctattgcccaggacgcggaccagaactacgactacgccagcaacagcgtgatcctgcacctggacgccggcgacgaggtcttcatcaagctggatggaggcaaagcacacggcggcaacagcaacaaatacagcacgttctctggcttcatcatctactccgactgagctccccacgtctccctccacccacgtccctcacccgccggggtcccctccgggcggggcagacgatgactcgcccctcgcccacccgctcgctgcccggccctccccggctatgacgcccccggcccgtgctcaacaccgcctgggccacagctaggccctcccaccggctcgctgcagagccgggcccagcgcgccctgtccccgtgccagggaaccggggttgaccgcccccgcccagcccgcgctatatatttgtacaataggactgtttactgcccacctccgcctgccagcccaccccagcctggggagaggtcgcggcggcgggtttgcttcctgcgctctgagatgagctgccctcggctccctccggggtggcgcgcccgggggaggggggagttgggggctggatagcttcccagcaccctcagagcccccgcccggctgtgccccgtctgaccaaagttataataaaaacattttcaccccgcaaaaaaaaaaaaaaaaaa

SEQ ID NO: 58782 - DNA, 2262 bp, Homo sapiens
acataatgaagtgtccgatgctaaggtcaaggctgggccaggaaagcgtccactgtgggcccatgttcatccaggtctcccggcccctgcccctgtggagggacaatagacagactccatggctgctgtcccttcgaggggagctggtggcttctcttgaagacgccagcctgatgggactgtatgtggacatgaatgccaccactgtcaccgtccaaagcccgagacaaggccttcttcagaggtgggaggtcagtggtgggcagcaggctctgccaggagtgtcattccagccagagtcggaggtcttagttcacatccccaagcagagactgggtctagtcaaaagaggttcctacattgaggaaaccctgagcctcagactcctccgagtccaccagtccaacatctttatggtgactgagaacaaggactttgtggtggtcagcattccggcggccggggtgctccaggtccagcgatgccaagaagtcggaggaaccccgggaacacaagctttctatagggtagacctgagcctggaatttgccgagatggctgccccggtcctctggacagtggagagcttcttccagtgtgtgggttcaggaacagagccgcctgcctcaactgctgcactgaggaccactccctccccaccatccccaggaccagagacccctccagcgggagtgccacctgctgcttcctcccaggtgtgggctgcagggccagctgcccaggaatggctttctcgggacctcctgcaccggccttccgacgcactggccaaaaaggggcttggaccattcctgcaaacagccaaaccggcgagaagaggccagacatctgcctccattctccccagagtggtgcaagctcagcgaggtccccagcctcccccaggggaagcagggatccctggacaccccacacctccagccacgctcccctcggagcctgtagagggtgtccaggctagtccctggcggccacgtccagtcttgccaacgcacccggctctgaccctgcccgtgtcctcagatgcctcctctccttcaccgccagccccgaggcctgaacgacctgaatcacttctggtctcaggaccatctgtcaccctgactgaaggtctaggaactgtgaggcctgaacaggaccccgccaagtctccaggaagtcccctcctgctgagaggcttgtcaagcggggatgtggctgcacctgagcccatcatgggggagcccggccaagccagtgaggagttccagccattggcgaggccctggcgggccacactggctgcagaggagctggtttctcaccgttctcccggagagccccaggaaacgtgctctggaacggaggtggagaggccacgccagacagggcctggtctccccagggagggggccagggggcacatggacctttcatcctcagaaccaagccaggacatagaggggccgggactctccatcctgccagcgagggatgccacattctccaccccaagtgtgaggcagccagaccccagtgcctggctgagttcaggacctgaactcaccgggatgcccagggtgaggctggcagcgcccctggcagttcttcctatggaacctctgccaccagaacctgttcgcccagcagctcttctgacacccgaagcctcatctgtgggagggccagaccaggcccgatacctggagtcagcccctggctggcctgtgggccaggaggagtggggggttgcacacacgtccagccctccatccacgcaaaccctgagcctgtgggctcccacaggagtgttgctacccagcctggtggagcttgaataccccttccaggctggccggggggcctcactccagcaggagctgacagagcccaccttggccctcagtgctgaaagccacaggcctcctgagcttcaagacagtgtggaggggctttctgagaggccctcacgctgagcctccatggagactccaggcagccggtaccccgctggcttggacggccccagtgaccctcagtgacccagctgtccccaggctccctggcttagatgcccagctgtggctgggtacagtgttctgggccggaagagcactcactcagtgcttccctggaaaggtggacccccagacgcccacctccaggcagacccatcactggaagtgggatttgaaatgcagccaagaagaggagaccgtcggcaacgcccgcccggaacaagaaataaataaataaataatc

SEQ ID NO: 58783 - DNA, 1031 bp, Homo sapiens
gcaggtgtggtgttcatcccgggtcgaccggccgctcgcgctgccctgaaactctagtcgccagagaggcggcatgggtttccggaagttctcccccttcctggctctcagtatcttggtcctgtaccaggcgggcagcctccaggcggcgccattcaggtctgccctggagagcagcccagacccggccacactcagtaaagaggacgcgcgcctcctgctggctgcactggtgcaggactatgtgcagatgaaggccagtgagctgaagcaggagcaggagacacagggctccagctccgctgcccagaagagagcctgcaacactgccacctgtgtgactcatcggctggcaggcttgctgagcagatcagggggcatggtgaagagcaacttcgtgcccaccaatgtgggttccaaagcctttggcaggcgccgcagggaccttcaagcctgagcagatgaatgactccaggaagaaggttatcatgaaactgaactcaccatttctattaatttctgttggtaagaacttggtgagaatgccccgtggaagatacacatgtttgcatcctaagatactgaaaaaagggcacctttgtcacttgaaaggaatgaaactgaatgcaaaataagctaattccatatttgctgtgcatcatttttatatttaattctatgtccagtaaaagtgatggcatctctcattgacttatctggtagcaaactggttctttcggagccatcctgttgatcatgcagctccaccaaaccttagggggacgtgaaatcactgcctgttgtggtctccgaggacacatggtaatggtgatgctgtgccttgttatctaagaacatgattgtataatttgtttaagaaaatgtcaatattgtgccatttgtgaacttcatcaagattaaaagcatattttgggtacatttgtttcaaaaccttggtgatgcattacaacttgttttcttatgtaataataatgatgatgatgatgataataataaatatttttgagtgc

SEQ ID NO: 58784 - DNA, 4913 bp, Homo sapiens
caacaggcacctggctgcagccaggaaggaccgcacgccctttcgcgcaggagagtggaaggagggagctgtttgccagcaccgaggtcttgcggcacaggcaacgcttgacctgagtcttgcagaatgaaaggcatcacaggaggcctctgcatgatgtggcttccaaagactcaaggaccacccacattacaagtctggattgaggaaggcagaaatggagattcaaacaccacgtcttctattattttattaatcaatctgtagacatgtgtccccactgcagggagtgaactgctccaagggagaaacttctgggagcctccaaactcctagctgtctcatcccttgccctggagagacggcagaaccatggcattttatagctgctgctgggtcctcttggcactcacctggcacacctctgcctacgggccagaccagcgagcccaaaagaagggggacattatccttggggggctctttcctattcattttggagtagcagctaaagatcaagatctcaaatcaaggccggagtctgtggaatgtatcaggtataatttccgtgggtttcgctggttacaggctatgatatttgccatagaggagataaacagcagcccagcccttcttcccaacttgacgctgggatacaggatatttgacacttgcaacaccgtttctaaggccttggaagccaccctgagttttgttgctcaaaacaaaattgattctttgaaccttgatgagttctgcaactgctcagagcacattccctctacgattgctgtggtgggagcaactggctcaggcgtctccacggcagtggcaaatctgctggggctcttctacattccccaggtcagttatgcctcctccagcagactcctcagcaacaagaatcaattcaagtctttcctccgaaccatccccaatgatgagcaccaggccactgccatggcagacatcatcgagtatttccgctggaactgggtgggcacaattgcagctgatgacgactatgggcggccggggattgagaaattccgagaggaagctgaggaaagggatatctgcatcgacttcagtgaactcatctcccagtactctgatgaggaagagatccagcatgtggtagaggtgattcaaaattccacggccaaagtcatcgtggttttctccagtggcccagatcttgagcccctcatcaaggagattgtccggcgcaatatcacgggcaagatctggctggccagcgaggcctgggccagctcctccctgatcgccatgcctcagtacttccacgtggttggcggcaccattggattcgctctgaaggctgggcagatcccaggcttccgggaattcctgaagaaggtccatcccaggaagtctgtccacaatggttttgccaaggagttttgggaagaaacatttaactgccacctccaagaaggtgcaaaaggacctttacctgtggacacctttctgagaggtcacgaagaaagtggcgacaggtttagcaacagctcgacagccttccgacccctctgtacaggggatgagaacatcagcagtgtcgagaccccttacatagattacacgcatttacggatatcctacaatgtgtacttagcagtctactccattgcccacgccttgcaagatatatatacctgcttacctgggagagggctcttcaccaatggctcctgtgcagacatcaagaaagttgaggcgtggcaggtcctgaagcacctacggcatctaaactttacaaacaatatgggggagcaggtgacctttgatgagtgtggtgacctggtggggaactattccatcatcaactggcacctctccccagaggatggctccatcgtgtttaaggaagtcgggtattacaacgtctatgccaagaagggagaaagactcttcatcaacgaggagaaaatcctgtggagtgggttctccagggaggtgcccttctccaactgcagccgagactgcctggcagggaccaggaaagggatcattgagggggagcccacctgctgctttgagtgtgtggagtgtcctgatggggagtatagtgatgagacagatgccagtgcctgtaacaagtgcccagatgacttctggtccaatgagaaccacacctcctgcattgccaaggagatcgagtttctgtcgtggacggagccctttgggatcgcactcaccctctttgccgtgctgggcattttcctgacagcctttgtgctgggtgtgtttatcaagttccgcaacacacccattgtcaaggccaccaaccgagagctctcctacctcctcctcttctccctgctctgctgcttctccagctccctgttcttcatcggggagccccaggactggacgtgccgcctgcgccagccggcctttggcatcagcttcgtgctctgcatctcatgcatcctggtgaaaaccaaccgtgtcctcctggtgtttgaggccaagatccccaccagcttccaccgcaagtggtgggggctcaacctgcagttcctgctggttttcctctgcaccttcatgcagattgtcatctgtgtgatctggctctacaccgcgcccccctcaagctaccgcaaccaggagctggaggatgagatcatcttcatcacgtgccacgagggctccctcatggccctgggcttcctgatcggctacacctgcctgctggctgccatctgcttcttctttgccttcaagtcccggaagctgccggagaacttcaatgaagccaagttcatcaccttcagcatgctcatcttcttcatcgtctggatctccttcattccagcctatgccagcacctatggcaagtttgtctctgccgtagaggtgattgccatcctggcagccagctttggcttgctggcgtgcatcttcttcaacaagatctacatcattctcttcaagccatcccgcaacaccatcgaggaggtgcgttgcagcaccgcagctcacgctttcaaggtggctgcccgggccacgctgcgccgcagcaacgtctcccgcaagcggtccagcagccttggaggctccacgggatccaccccctcctcctccatcagcagcaagagcaacagcgaagacccattcccacagcccgagaggcagaagcagcagcagccgctggccctaacccagcaagagcagcagcagcagcccctgaccctcccacagcagcaacgatctcagcagcagcccagatgcaagcagaaggtcatctttggcagcggcacggtcaccttctcactgagctttgatgagcctcagaagaacgccatggcccacaggaattctacgcaccagaactccctggaggcccagaaaagcagcgatacgctgacccgacaccagccattactcccgctgcagtgcggggaaacggacttagatctgaccgtccaggaaacaggtctgcaaggacctgtgggtggagaccagcggccagaggtggaggaccctgaagagttgtccccagcacttgtagtgtccagttcacagagctttgtcatcagtggtggaggcagcactgttacagaaaacgtagtgaattcataaaatggaaggagaagactgggctagggagaatgcagagaggtttcttggggtcccagggatgaggaatcgccccagactcctttcctctgaggaagaagggataatagacacatcaaatgccccgaatttagtcacaccatcttaaatgacagtgaattgacccatgttccctttaaaattaaaaaaaagaagagccttgtgtttctgtggttgcatttgtcaaagcattgagatctccacggtcagatttgctgttcacccacatctaatgtctcttcctctgttctatcccacccaacagctcagagatgaaactatggctttaaactaccctccagagtgtgcagactgatgggacatcaaatttgccaccactagagctgagagtctgaaagacagaatgtcaccagtcctgcccaatgccttgacaacagactgaattttaaatgttcacaacataaggagaatgtatctcctcctatttatgaaaaccatatgatattttgtctcctacctgctgctgctattatgtaacatccagaaggtttgcacccctcctataccatatgtctgcttctgtccaggacatgatactgatgccatgtttagattccaggatcacaagaatcacctcaaattgttaggaagggactgcataaaccaatgagctgtatctgtaattaatattcctatatgtagctttatccttaggaaaatgcttctgttgtaatagtccatggacaatataaactgaaaaatgtcagtctggtttatataaggcagtattattgagctctatttccccaccccactatcctcactcccataagctaagccttatgtgagccccttcagggactcaagggtccagaagtccctcccatctctaccccaaagaattcctgaagccagatccaccctatccctgtacagagtaagttctcaattattggcctgctaatagctgctagggtaggaaagcgtggttccaagaaagatccaccctcaaatgtcagagctatgttccctccagcagtggtattaatactgccggtcacccaggctctggagccagagagacagaccggggttcaagccatggcttcgtcatttgcaagctgagtgactgtaggcagggaaccttaacctctctaagccacagcttcttcatctttaaaataaggataataatcattccttcccctcagagctcttatgtggattaaacgagataatgtatataaagtactttagcctggtacctagcacacaataagcattcaataaatattagttaatattat

SEQ ID NO: 58785 - DNA, 2350 bp, Homo sapiens
ggccacccagaggctgatgctcaccatggggcgcctgcaactggttgtgttgggcctcacctgctgctgggcagtggcgagtgccgcgaagctgggcgccgtgtacacagaaggtgggttcgtggaaggcgtcaataagaagctcggcctcctgggtgactctgtggacatcttcaagggcatccccttcgcagctcccaccaaggccctggaaaatcctcagccacatcctggctggcaagggaccctgaaggccaagaacttcaagaagagatgcctgcaggccaccatcacccaggacagcacctacggggatgaagactgcctgtacctcaacatttgggtgccccagggcaggaagcaagtctcccgggacctgcccgttatgatctggatctatggaggcgccttcctcatggggtccggccatggggccaacttcctcaacaactacctgtatgacggcgaggagatcgccacacgcggaaacgtcatcgtggtcaccttcaactaccgtgtcggcccccttgggttcctcagcactggggacgccaatctgccaggtaactatggccttcgggatcagcacatggccattgcttgggtgaagaggaatatcgcggccttcgggggggaccccaacaacatcacgctcttcggggagtctgctggaggtgccagcgtctctctgcagaccctctccccctacaacaagggcctcatccggcgagccatcagccagagcggcgtggccctgagtccctgggtcatccagaaaaacccactcttctgggccaaaaaggtggctgagaaggtgggttgccctgtgggtgatgccgccaggatggcccagtgtctgaaggttactgatccccgagccctgacgctggcctataaggtgccgctggcaggcctggagtaccccatgctgcactatgtgggcttcgtccctgtcattgatggagacttcatccccgctgacccgatcaacctgtacgccaacgccgccgacatcgactatatagcaggcaccaacaacatggacggccacatcttcgccagcatcgacatgcctgccatcaacaagggcaacaagaaagtcacggaggaggacttctacaagctggtcagtgagttcacaatcaccaaggggctcagaggcgccaagacgacctttgatgtctacaccgagtcctgggcccaggacccatcccaggagaataagaagaagactgtggtggactttgagaccgatgtcctcttcctggtgcccaccgagattgccctagcccagcacagagccaatgccaagagtgccaagacctacgcctacctgttttcccatccctctcggatgcccgtctaccccaaatgggtgggggccgaccatgcagatgacattcagtacgttttcgggaagcccttcgccacccccacgggctaccggccccaagacaggacagtctctaaggccatgatcgcctactggaccaactttgccaaaacaggggaccccaacatgggcgactcggctgtgcccacacactgggaaccctacactacggaaaacagcggctacctggagatcaccaagaagatgggcagcagctccatgaagcggagcctgagaaccaacttcctgcgctactggaccctcacctatctggcgctgcccacagtgaccgaccaggaggccacccctgtgccccccacaggggactccgaggccactcccgtgccccccacgggtgactccgagaccgcccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggcgccccccccgtgccgcccacgggtgacgccgggcccccccccgtgccgcccacgggtgactccggcgccccccccgtgccgcccacgggtgactccggggccccccccgtgacccccacgggtgactccgagaccgcccccgtgccgcccacgggtgactccggggccccccctgtgccccccacgggtgactctgaggctgcccctgtgccccccacagatgactccaaggaagctcagatgcctgcagtcattaggttttagcgtcccatgagccttggtatcaagaggccacaagagtgggaccccaggggctcccctcccatcttgagctcttcctgaataaagcctcatacccct

SEQ ID NO: 58786 - DNA, 1009 bp, Homo sapiens
cactgcgcccccgaccctagctcagggactgcagaactcaagataccatcccgtttctcctggctgaggaagggaagggaacatccacatcttctgtactcgtccattctgtgtccccggggcctggagtaaagacaccttcaaatgcagagactcttcagattcagctttcctggaaactgatcttcaatgcactaagagaaggagactctcaaaccaaaaatgacctggaggcaccatgtcaggcttctgtttacggtcagtttggcattacagatcatcaatttgggaaacagctatcaaagagagaaacataacggcggtagagaggaagtcaccaaggttgccactcagaagcaccgacagtcaccgctcaactggacctccagtcatttcggagaggtgactgggagcgccgagggctgggggccggaggagccgctcccctactcccgggctttcggagagggtgcgtccgcgcggccgcgctgctgcaggaacggcggtacctgcgtgctgggcagcttctgcgtgtgcccggcccacttcaccggccgctactgcgagcatgaccagaggcgcagtgaatgcggcgccctggagcacggagcctggaccctccgcgcctgccacctctgcaggtgcatcttcggggccctgcactgcctccccctccagacgcctgaccgctgtgacccgaaagacttcctggcctcccacgctcacgggccgagcgccgggggcgcgcccagcctgctactcttgctgccctgcgcactcctgcaccgcctcctgcgcccggatgcgcccgcgcaccctcggtccctggtcccttccgtcctccagcgggagcggcgcccctgcggaaggccgggacttgggcatcgcctttaattttctatgttgtaaataatagatgtgtttagtttaccgtaagctgaagcactgggtgaatatttttattgggtaataaatattttcatgaaagcgcctttggctccagatcctt

SEQ ID NO: 58787 - DNA, 6129 bp, Homo sapiens
aattggaagcaaatgacatcacagcaggtcagagaaaaagggttgagcggcaggcacccagagtagtaggtctttggcattaggagcttgagcccagacggccctagcagggaccccagcgcccgagagaccatgcagaggtcgcctctggaaaaggccagcgttgtctccaaactttttttcagctggaccagaccaattttgaggaaaggatacagacagcgcctggaattgtcagacatataccaaatcccttctgttgattctgctgacaatctatctgaaaaattggaaagagaatgggatagagagctggcttcaaagaaaaatcctaaactcattaatgcccttcggcgatgttttttctggagatttatgttctatggaatctttttatatttaggggaagtcaccaaagcagtacagcctctcttactgggaagaatcatagcttcctatgacccggataacaaggaggaacgctctatcgcgatttatctaggcataggcttatgccttctctttattgtgaggacactgctcctacacccagccatttttggccttcatcacattggaatgcagatgagaatagctatgtttagtttgatttataagaagactttaaagctgtcaagccgtgttctagataaaataagtattggacaacttgttagtctcctttccaacaacctgaacaaatttgatgaaggacttgcattggcacatttcgtgtggatcgctcctttgcaagtggcactcctcatggggctaatctgggagttgttacaggcgtctgccttctgtggacttggtttcctgatagtccttgccctttttcaggctgggctagggagaatgatgatgaagtacagagatcagagagctgggaagatcagtgaaagacttgtgattacctcagaaatgattgaaaatatccaatctgttaaggcatactgctgggaagaagcaatggaaaaaatgattgaaaacttaagacaaacagaactgaaactgactcggaaggcagcctatgtgagatacttcaatagctcagccttcttcttctcagggttctttgtggtgtttttatctgtgcttccctatgcactaatcaaaggaatcatcctccggaaaatattcaccaccatctcattctgcattgttctgcgcatggcggtcactcggcaatttccctgggctgtacaaacatggtatgactctcttggagcaataaacaaaatacaggatttcttacaaaagcaagaatataagacattggaatataacttaacgactacagaagtagtgatggagaatgtaacagccttctgggaggagggatttggggaattatttgagaaagcaaaacaaaacaataacaatagaaaaacttctaatggtgatgacagcctcttcttcagtaatttctcacttcttggtactcctgtcctgaaagatattaatttcaagatagaaagaggacagttgttggcggttgctggatccactggagcaggcaagacttcacttctaatgatgattatgggagaactggagccttcagagggtaaaattaagcacagtggaagaatttcattctgttctcagttttcctggattatgcctggcaccattaaagaaaatatcatctttggtgtttcctatgatgaatatagatacagaagcgtcatcaaagcatgccaactagaagaggacatctccaagtttgcagagaaagacaatatagttcttggagaaggtggaatcacactgagtggaggtcaacgagcaagaatttctttagcaagagcagtatacaaagatgctgatttgtatttattagactctccttttggatacctagatgttttaacagaaaaagaaatatttgaaagctgtgtctgtaaactgatggctaacaaaactaggattttggtcacttctaaaatggaacatttaaagaaagctgacaaaatattaattttgaatgaaggtagcagctatttttatgggacattttcagaactccaaaatctacagccagactttagctcaaaactcatgggatgtgattctttcgaccaatttagtgcagaaagaagaaattcaatcctaactgagaccttacaccgtttctcattagaaggagatgctcctgtctcctggacagaaacaaaaaaacaatcttttaaacagactggagagtttggggaaaaaaggaagaattctattctcaatccaatcaactctatacgaaaattttccattgtgcaaaagactcccttacaaatgaatggcatcgaagaggattctgatgagcctttagagagaaggctgtccttagtaccagattctgagcagggagaggcgatactgcctcgcatcagcgtgatcagcactggccccacgcttcaggcacgaaggaggcagtctgtcctgaacctgatgacacactcagttaaccaaggtcagaacattcaccgaaagacaacagcatccacacgaaaagtgtcactggcccctcaggcaaacttgactgaactggatatatattcaagaaggttatctcaagaaactggcttggaaataagtgaagaaattaacgaagaagacttaaaggagtgcctttttgatgatatggagagcataccagcagtgactacatggaacacataccttcgatatattactgtccacaagagcttaatttttgtgctaatttggtgcttagtaatttttctggcagaggtggctgcttctttggttgtgctgtggctccttggaaacactcctcttcaagacaaagggaatagtactcatagtagaaataacagctatgcagtgattatcaccagcaccagttcgtattatgtgttttacatttacgtgggagtagccgacactttgcttgctatgggattcttcagaggtctaccactggtgcatactctaatcacagtgtcgaaaattttacaccacaaaatgttacattctgttcttcaagcacctatgtcaaccctcaacacgttgaaagcaggtgggattcttaatagattctccaaagatatagcaattttggatgaccttctgcctcttaccatatttgacttcatccagttgttattaattgtgattggagctatagcagttgtcgcagttttacaaccctacatctttgttgcaacagtgccagtgatagtggcttttattatgttgagagcatatttcctccaaacctcacagcaactcaaacaactggaatctgaaggcaggagtccaattttcactcatcttgttacaagcttaaaaggactatggacacttcgtgccttcggacggcagccttactttgaaactctgttccacaaagctctgaatttacatactgccaactggttcttgtacctgtcaacactgcgctggttccaaatgagaatagaaatgatttttgtcatcttcttcattgctgttaccttcatttccattttaacaacaggagaaggagaaggaagagttggtattatcctgactttagccatgaatatcatgagtacattgcagtgggctgtaaactccagcatagatgtggatagcttgatgcgatctgtgagccgagtctttaagttcattgacatgccaacagaaggtaaacctaccaagtcaaccaaaccatacaagaatggccaactctcgaaagttatgattattgagaattcacacgtgaagaaagatgacatctggccctcagggggccaaatgactgtcaaagatctcacagcaaaatacacagaaggtggaaatgccatattagagaacatttccttctcaataagtcctggccagagggtgggcctcttgggaagaactggatcagggaagagtactttgttatcagcttttttgagactactgaacactgaaggagaaatccagatcgatggtgtgtcttgggattcaataactttgcaacagtggaggaaagcctttggagtgataccacagaaagtatttattttttctggaacatttagaaaaaacttggatccctatgaacagtggagtgatcaagaaatatggaaagttgcagatgaggttgggctcagatctgtgatagaacagtttcctgggaagcttgactttgtccttgtggatgggggctgtgtcctaagccatggccacaagcagttgatgtgcttggctagatctgttctcagtaaggcgaagatcttgctgcttgatgaacccagtgctcatttggatccagtaacataccaaataattagaagaactctaaaacaagcatttgctgattgcacagtaattctctgtgaacacaggatagaagcaatgctggaatgccaacaatttttggtcatagaagagaacaaagtgcggcagtacgattccatccagaaactgctgaacgagaggagcctcttccggcaagccatcagcccctccgacagggtgaagctctttccccaccggaactcaagcaagtgcaagtctaagccccagattgctgctctgaaagaggagacagaagaagaggtgcaagatacaaggctttagagagcagcataaatgttgacatgggacatttgctcatggaattggagctcgtgggacagtcacctcatggaattggagctcgtggaacagttacctctgcctcagaaaacaaggatgaattaagtttttttttaaaaaagaaacatttggtaaggggaattgaggacactgatatgggtcttgataaatggcttcctggcaatagtcaaattgtgtgaaaggtacttcaaatccttgaagatttaccacttgtgttttgcaagccagattttcctgaaaacccttgccatgtgctagtaattggaaaggcagctctaaatgtcaatcagcctagttgatcagcttattgtctagtgaaactcgttaatttgtagtgttggagaagaactgaaatcatacttcttagggttatgattaagtaatgataactggaaacttcagcggtttatataagcttgtattcctttttctctcctctccccatgatgtttagaaacacaactatattgtttgctaagcattccaactatctcatttccaagcaagtattagaataccacaggaaccacaagactgcacatcaaaatatgccccattcaacatctagtgagcagtcaggaaagagaacttccagatcctggaaatcagggttagtattgtccaggtctaccaaaaatctcaatatttcagataatcacaatacatcccttacctgggaaagggctgttataatctttcacaggggacaggatggttcccttgatgaagaagttgatatgccttttcccaactccagaaagtgacaagctcacagacctttgaactagagtttagctggaaaagtatgttagtgcaaattgtcacaggacagcccttctttccacagaagctccaggtagagggtgtgtaagtagataggccatgggcactgtgggtagacacacatgaagtccaagcatttagatgtataggttgatggtggtatgttttcaggctagatgtatgtacttcatgctgtctacactaagagagaatgagagacacactgaagaagcaccaatcatgaattagttttatatgcttctgttttataattttgtgaagcaaaattttttctctaggaaatatttattttaataatgtttcaaacatatattacaatgctgtattttaaaagaatgattatgaattacatttgtataaaataatttttatatttgaaatattgactttttatggcactagtatttttatgaaatattatgttaaaactgggacaggggagaacctagggtgatattaaccaggggccatgaatcaccttttggtctggagggaagccttggggctgatcgagttgttgcccacagctgtatgattcccagccagacacagcctcttagatgcagttctgaagaagatggtaccaccagtctgactgtttccatcaagggtacactgccttctcaactccaaactgactcttaagaagactgcattatatttattactgtaagaaaatatcacttgtcaataaaatccatacatttgtgt

SEQ ID NO: 58788 - DNA, 1994 bp, Homo sapiens
gctgccaccgctcctgccactgcagtgctcgagccccgtgcaggggagcttgcgggaggatcgaccgacagacggacgcacgccgaggcactgcgcccccagccccgcgccggtgccaccgcagcccgaccccggccgccagtccagccgcccctcgcccggtgcctaggtgcccggccccacaccgccagctgctcggcgcccgggtccgccatgcgctccgccgctgtcctggctcttctgctctgcgccgggcaagtcactgcgctccctgtgaacagccctatgaataaaggggataccgaggtgatgaaatgcatcgttgaggtcatctccgacacactttccaagcccagccccatgcctgtcagccaggaatgttttgagacactccgaggagatgaacggatcctttccattctgagacatcagaatttactgaaggagctccaagacctcgctctccaaggcgccaaggagagggcacatcagcagaagaaacacagcggttttgaagatgaactctcagaggttcttgagaaccagagcagccaggccgagctgaaagaggcggtggaagagccatcatccaaggatgttatggagaaaagagaggattccaaggaggcagagaaaagtggtgaagccacagacggagccaggccccaggccctcccggagcccatgcaggagtccaaggctgaggggaacaatcaggcccctggggaggaagaggaggaggaggaggaggccaccaacacccaccctccagccagcctccccagccagaaatacccaggcccacaggccgagggggacagtgagggcctctctcagggtctggtggacagagagaagggcctgagtgcagagccagggtggcaggcaaagagagaagaggaggaggaggaggaggaggaggctgaggctggagaggaggctgtccccgaggaagaaggccccactgtagtgctgaacccccacccgagccttggctacaaggagatccggaaaggcgagagtcggtcggaggctctggctgtggatggagctgggaagcctggggctgaggaggctcaggaccccgaagggaagggagaacaggagcactcccagcagaaagaggaggaggaggagatggcagtggtcccgcaaggcctcttccggggtgggaagagcggagagctggagcaggaggaggagcggctctccaaggagtgggaggactccaaacgctggagcaagatggaccagctggccaaggagctgacggctgagaagcggctggaggggcaggaggaggaggaggacaaccgggacagttccatgaagctctccttccgggcccgggcctacggcttcaggggccctgggccgcagctgcgacgaggctggaggccatcctcccgggaggacagccttgaggcgggcctgcccctccaggtccgaggctaccccgaggagaagaaagaggaggagggcagcgcaaaccgcagaccagaggaccaggagctggagagcctgtcggccattgaagcagagctggagaaagtggcccaccagctgcaggcactacggcggggctgagacaccggctggcagggctggccccagggcaccctgtggccctggctctgctgtccccttggcaggtcctggccagatggcccggacgctgcttccggtagggaggcagcctccagcctgcccaagcccaggccaccctatcgccccctacgcgccttgtctcctactcctgactcctacctgccctggaacatcctttgcagggcagccccacaactttaaacattgacgattccttctctgaacacaggcagctttctagaagtttcccttcctccatcctatccactgggcacaactgcaataacttctgaccttttggtgaaagctgagaactcctgactgtaacatattctgtatgaactttatctaaagaaaaataaatctgttctgggctctttcctctg

SEQ ID NO: 58789 - DNA, 539 bp, Homo sapiens
ctgtctcccgccacccacaccagctgtcccactcaccatggagaagatcctgatcctcctgcttgtcgccctctctgtggcctatgcagctcctggcccccgggggatcattatcaacctggagaacggtgagctctgcatgaatagtgcccagtgtaagagcaattgctgccagcattcaagtgcgctgggcctggcccgctgcacatccatggccagcgagaacagcgagtgctctgtcaagacgctctatgggatttactacaagtgtccctgtgagcgtggcctgacctgtgagggagacaagaccatcgtgggctccatcaccaacaccaactttggcatctgccatgacgctggacgctccaagcagtgagactgcccacccactcccacacctagcccagaatgctgtaggccactaggcgcaggggcatctctcccctgctccagcgcatctcccgggctggccacctccttgaccagcatatctgttttctgattgcgctcttcacaattaaaggcctcctgcaaacctt

SEQ ID NO: 58790 - DNA, 3486 bp, Homo sapiens
agcaatcatctggggggctaaatgtgacaaaccgagaagatggccaagatcaacacccaatactcccacccctccaggacccacctcaaggtaaagacctcagaccgagatctcaatcgcgctgaaaatggcctcagcagagcccactcgtcaagtgaggagacatcgtcagtgctgcagccggggatcgccatggagaccagaggactggctgactccgggcagggctccttcaccggccaggggatcgccaggctgtcgcgcctcatcttcttgctgcgcaggtgggctgccaggcatgtgcaccaccaggaccagggaccggactcttttcctgatcgtttccgtggagccgagcttaaggaggtgtccagccaagaaagcaatgcccaggcaaatgtgggcagccaggagccagcagacagagggagaagcgcctggcccctggccaaatgcaacactaacaccagcaacaacacggaggaggagaagaagacgaaaaagaaggatgcgatcgtggtggacccgtccagcaacctgtactaccgctggctgaccgccatcgccctgcctgtcttctataactggtatctgcttatttgcagggcctgtttcgatgagctgcagtccgagtacctgatgctgtggctggtcctggactactcggcagatgtcctgtatgtcttggatgtgcttgtacgagctcggacaggttttctcgagcaaggcttaatggtcagtgataccaacaggctgtggcagcattacaagacgaccacgcagttcaagctggatgtgttgtccctggtccccaccgacctggcttacttaaaggtgggcacaaactacccagaagtgaggttcaaccgcctactgaagttttcccggctctttgaattctttgaccgcacagagacaaggaccaactaccccaatatgttcaggattgggaacttggtcttgtacattctcatcatcatccactggaatgcctgcatctactttgccatttccaagttcattggttttgggacagactcctgggtctacccaaacatctcaatcccagagcatgggcgcctctccaggaagtacatttacagtctctactggtccaccttgacccttaccaccattggtgagaccccaccccccgtgaaagatgaggagtatctctttgtggtcgtagacttcttggtgggtgttctgatttttgccaccattgtgggcaatgtgggctccatgatctcgaatatgaatgcctcacgggcagagttccaggccaagattgattccatcaagcagtacatgcagttccgcaaggtcaccaaggacttggagacgcgggttatccggtggtttgactacctgtgggccaacaagaagacggtggatgagaaggaggtgctcaagagcctcccagacaagctgaaggctgagatcgccatcaacgtgcacctggacacgctgaagaaggttcgcatcttccaggactgtgaggcagggctgctggtggagctggtgctgaagctgcgacccactgtgttcagccctggggattatatctgcaagaagggagatattgggaaggagatgtacatcatcaacgagggcaagctggccgtggtggctgatgatggggtcacccagttcgtggtcctcagcgatggcagctacttcggggagatcagcattctgaacatcaaggggagcaagtcggggaaccgcaggacggccaacatccgcagcattggctactcagacctgttctgcctctcaaaggacgatctcatggaggccctcaccgagtaccccgaagccaagaaggccctggaggagaaaggacggcagatcctgatgaaagacaacctgatcgatgaggagctggccagggcgggcgcggaccccaaggaccttgaggagaaagtggagcagctggggtcctccctggacaccctgcagaccaggtttgcacgcctcctggctgagtacaacgccacccagatgaagatgaagcagcgtctcagccaactggaaagccaggtgaagggtggtggggacaagcccctggctgatggggaagttcccggggatgctacaaaaacagaggacaaacaacagtgaaaatgcagcatctgtctcctgcttcacagggtcgactgtcagggtgaccgtatgtggccgcagctgtgtggcatggaacttggtcagggttgaattccagctctactcaccctttgaaagctgtgtgactgcctgagagaacctgtttcttcacctaaaaaatgggactttttgtctcagtcccagtgaagtgccaggtttgattgtgaagtccgcatgaaacactgcaccaggcagggctttgcaaagtgcaaggtatccccagtccaagtatatgaaaacgtgcacacaggactctcattacttttttatggaatctgcaaggtgtttttaggctttttaatctgattttcttataaatgaaagattatttagtcacctttctcctgtccaacttcaccaccacctgataatgggtatataacaggaagctgaaggtacaacatagtgactaaaattcagacttacacaagacagtttgaggcatatttcttaatctggtatcacctcgtgtgttctttggggccctagaaaccctggcttttgggagtgctatggcaagtagaagttctgccggatggaaagaggctgccccatttgaggtcatttaaaatctgtgaagcaaatccagactccttgccgttcagccactgtgaaaccagaatctgcttcacagaaaaaagcatctcagttaggagaagagacatcccctccttctcacttgccaaagagattcaaagacagcccctatcctccattcttgagtcagggccctaggtgacctattctaactcaaggaggagagctatgtacagggagagcattttagattgaaggttggaatggtgtactaaaccaaaaaagctgacaactgagagttttagaagattagaccattaggaacgtatctttgcaaactgcccattcacccatgaagaggaagcctcaagatcccttggaattgcatcccaaggcaaagcttttggctcaccgaaagctcacagattgcagaaattagcttttttaaaaaacaaaccccagtaaatataatttcattaacattttataacagatttatatttttgagttccgtgattgcaaattatgacctcaaattccatccttcacttatgtaacatgttgcaaattacccaaagatgagtctttcttctttctttcctttttcctttcttcttcctttccttttttctttcttcttccttctttcttcctttttctctctcctcttttcctcctcaaaatgtatatattttaaaagccttaactgttagttatgcctgcattcatatttgcacaggaaaaataaagacctggatttaaaaataaaaaaaaaaaaaaaaa

SEQ ID NO: 58791 - DNA, 2917 bp, Homo sapiens
cccacgcgtccggccttctctctggactttgcatttccattccttttcattgacaaactgactttttttatttctttttttccatctctgggccagcttgggatcctaggccgccctgggaagacatttgtgttttacacacataaggatctgtgtttggggtttcttcttcctcccctgacattggcattgcttagtggttgtgtggggagggagaccacgtgggctcagtgcttgcttgcacttatctgcctaggtacatcgaagtcttttgacctccatacagtgattatgcctgtcatcgctggtggtatcctggcggccttgctcctgctgatagttgtcgtgctctgtctttacttcaaaatacacaacgcgctaaaagctgcaaaggaacctgaagctgtggctgtaaaaaatcacaacccagacaaggtgtggtgggccaagaacagccaggccaaaaccattgccacggagtcttgtcctgccctgcagtgctgtgaaggatatagaatgtgtgccagttttgattccctgccaccttgctgttgcgacataaatgagggcctctgagttaggaaaggctcccttctcaaagcagagccctgaagacttcaatgatgtcaatgaggccacctgtttgtgatgtgcaggcacagaagaaaggcacagctccccatcagtttcatggaaaataactcagtgcctgctgggaaccagctgctggagatccctacagagagcttccactgggggcaacccttccaggaaggagttggggagagagaaccctcactgtggggaatgctgataaaccagtcacacagctgctctattctcacacaaatctaccccttgcgtggctggaactgacgtttccctggaggtgtccagaaagctgatgtaacacagagcctataaaagctgtcggtccttaaggctgcccagcgccttgccaaaatggagcttgtaagaaggctcatgccattgaccctcttaattctctcctgtttggcggagctgacaatggcggaggctgaaggcaatgcaagctgcacagtcagtctagggggtgccaatatggcagagacccacaaagccatgatcctgcaactcaatcccagtgagaactgcacctggacaatagaaagaccagaaaacaaaagcatcagaattatcttttcctatgtccagcttgatccagatggaagctgtgaaagtgaaaacattaaagtctttgacggaacctccagcaatgggcctctgctagggcaagtctgcagtaaaaacgactatgttcctgtatttgaatcatcatccagtacattgacgtttcaaatagttactgactcagcaagaattcaaagaactgtctttgtcttctactacttcttctctcctaacatctctattccaaactgtggcggttacctggataccttggaaggatccttcaccagccccaattacccaaagccgcatcctgagctggcttattgtgtgtggcacatacaagtggagaaagattacaagataaaactaaacttcaaagagattttcctagaaatagacaaacagtgcaaatttgattttcttgccatctatgatggcccctccaccaactctggcctgattggacaagtctgtggccgtgtgactcccaccttcgaatcgtcatcaaactctctgactgtcgtgttgtctacagattatgccaattcttaccggggattttctgcttcctacacctcaatttatgcagaaaacatcaacactacatctttaacttgctcttctgacaggatgagagttattataagcaaatcctacctagaggcttttaactctaatgggaataacttgcaactaaaagacccaacttgcagaccaaaattatcaaatgttgtggaattttctgtccctcttaatggatgtggtacaatcagaaaggtagaagatcagtcaattacttacaccaatataatcaccttttctgcatcctcaacttctgaagtgatcacccgtcagaaacaactccagattattgtgaagtgtgaaatgggacataattctacagtggagataatatacataacagaagatgatgtaatacaaagtcaaaatgcactgggcaaatataacaccagcatggctctttttgaatccaattcatttgaaaagactatacttgaatcaccatattatgtggatttgaaccaaactctttttgttcaagttagtctgcacacctcagatccaaatttggtggtgtttcttgatacctgtagagcctctcccacctctgactttgcatctccaacctacgacctaatcaagagtggatgtagtcgagatgaaacttgtaaggtgtatcccttatttggacactatgggagattccagtttaatgcctttaaattcttgagaagtatgagctctgtgtatctgcagtgtaaagttttgatatgtgatagcagtgaccaccagtctcgctgcaatcaaggttgtgtctccagaagcaaacgagacatttcttcatataaatggaaaacagattccatcataggacccattcgtctgaaaagggatcgaagtgcaagtggcaattcaggatttcagcatgaaacacatgcggaagaaactccaaaccagcctttcaacagtgtgcatctgttttccttcatggttctagctctgaatgtggtgactgtagcgacaatcacagtgaggcattttgtaaatcaacgggcagactacaaataccagaagctgcagaactattaactaacaggtccaaccctaagtgagacatgtttctccaggatgccaaaggaaatgctacctcgtggctacacatattatgaataaatgaggaagggcctgaaagtgacacacaggcctgcatgtaaaaaaa

SEQ ID NO: 58792 - DNA, 3951 bp, Homo sapiens
aggcagaagggtaggctcagggagttcagtggggacaggtcaggatctggacagcggctctatgcctgggggaaggggcaagtcaacatcagggcctgctgatagacaagggacgagcaatgcttgggctcctgattgggaaaaccagggttttagccaaggcagcatagatgctgggaagcagcccgcaggctccagagcttccggttctctgcaggagaaagatgccgcttttggtgggacccatgaagggccagggggctttaagggtggggagggtgcaccaggccaagaggcggctggtggatgccgaagcccatggtccctggatagcaaaggttcaagtcctggaaggggcagttctgttgatgcagaggactcaggtatcctgggcaaggggaattctactgagtgggggaatgccctcaccccaaaacctggggagtccggacctcagggagcctggaatggcttagatggtccctttggcagaaaagcctctagagataggtcaggagggacccaggacctgagctctcagcgaggcaagggacagagaggaggaaagaggtccctcggggagcaggggtccctggaggctgagaatggtgaggtccagggtcctggggccctaaaggaggatgaagggcagggagtggaagaggctgggaggtcaggcaggaggcctggctcactcaggagcaggtctcaggcacagtcaggggctgaggttggaggaggaaagagaaggggagcagacgaggctggaagcatggggtggcagcctatgggagagaactgggggtgcctggaggagatgctgaatgaagatcagagccgggagccccctggtcaccttggtagcaggagaagtggcaaagacggcaggttggacatctatggagagaggagagatgctacccggagttccacatccagatacaagcctggcactggcagtttctccaaggatgcccaaggccccatgggccacttctcccagggcctggctgacatggaagtgcagccgggggaggccgccacactctcctgtaccctcaccagtgacctgggacctggcacctggtttaaggatggcgtcaagctcaccacccaggatggagtcatctttaagcaagacggtctcgtgcacagcctcttcatcacgcatgtgcaggggacccaagctgggaggtacacctttgtagctggtgaccagcagagcgaggccaccctgaccgtccaggattcccctaccattgctccagatgtgacagagaaactgagagagccactggtggtcaaggctgggaagccggtgatagtgaagatccccttccagagccacctccccattcaggctgcctggaggaaggacggggctgaggtggtgggcagcagtgacagggaggcccaggtggacctgggggatggctacacgcggctgtgcctccccagcgcaggcaggaaggactgtggccagtacagcgtgacactgaggagtgagggaggctctgtgcaggccgagctcactctgcaagtcatagacaagcctgatcccccacaaggccccatggaggttcaggattgccatagggctggcgtctgcctccgctggcggcccccaagggacaatgggggccggactgtagagtgctacgtggtggagagacggcaggctggcaggagcacttggctgaaggtgggcgaggcccccgctgacagcaccaccttcacggatgcccatgtggagccaggcaggaagtataccttccgagtgcgggctgtgacctcagagggggctggcgaggccctggagtctgaggagatattggtggctcctgaggctctccccaaggccccttccgcgccagccatcctgtcggcctccagccagggcatcacactgacatggacagcacctcggggccccggcagcgcccacatcctgggctacctgatcgagaggcgtaagaaggggagcaacacctggacggcagtgaacgaccagccggtgcctgagaggaggtggacggtggcggacgtgcggcagggctgtcagtatgagttccgggtcacagctgtggctccctcaggtcccggagagcctggacctccatcggatgccgtctttgctcgggaccccatgagaccccctgggctggtgaggaatctccaagtcacagacagatcgaacaccagcatcactctgagctgggctgggccagacacccaggaaggggatgaagcccaggggtatgtggtggagctgtgcagctcagacagtctccagtggctcccgtgccatgtgggcaccgtgccagtcaccacctacacggccaaggggcttcggcctggagagggctacttcgtgcgggtgacagcagttaatgaaggaggccagagccagcccagtgccctggacacattagtgcaagccatgcctgttactgtctgtcccaagttcctcgtggactccagcaccaaggacttgctgacagtcaaggtcggggacacagttcgtgtgcccgtctcctttgaagccatgcccatgcctgaggtgacctggctgaaggatggcttgcccttgcccaaaagaagtgtgactgtcactaaggatggcctcacccagcttctgatccctgtggctggactctcagacagtggtctctacactgtggtgctgaggaccctgcaggggaaggaggttgcccacagcttccgtatcagggtggcagcatgcccgcaggcccctgggcccatccacctgcaggagaacgtgcctgggacggtgacggccgagtgggaaccctctcctgacgaggcccaggatgtcccgctgcactacgcggtgttcacacgctcctcagcgcacggtccctggcacgaggcagccgaccgcatctacaccaaccgcttcaccctcctgggcatcctccccggccacgaataccacttcagggtggtggccaagaatgagctgggggccagcaaaccctcggacaccagccagccctggtgcatcccccggcagcgcgacaggttcacagtgaaggctccgtgctaccgggagcccgacctgagccagaagccccggttcctggtgggcctgcggtcccacctgctgccccagggctgcgagtgctgcatgagctgtgccgtgcagggctcgccccggccccacgtcacctggttcaagaatgaccgcagcctggaaggaaaccccgcggtgtacagcactgacctgctgggcgtgtgctccctcaccatccccagcgtatccccgaaggacagcggggagtacaaggctgtggctgagaacacgctgggccaggcagtcagcactgccaccctcattgtcatagaacccagcacctagcctcacctcaccctgggatggtcctggacccttgaagcttcacttccgacacctgcactggcccgggaagccaatcccaaggatggaggctgtgcccagagccccaggaaaatgggagtgagaagatgcctggcgaggttttggccaggaggacgtgaagtccttggggaagaaaaacaagggaggagggcattccacctcctggctccaagctaagtcactcaacagaatgacagcgaacctcctggaccctcaccatatgggtttctttcttcttcgcatcaggagatccagagggcacctgcctgcaggatgggccggctccttattttcctgggctgagccgtttggagggagggtgggcacagctgggcctgctgtgaccactgggagggaagaggagaggaggtcagaggacctgggtgaggactagggcatcaaggtcgtgtgtgtgggtgggggcagcctccacctcctggattcaagagattccaggggtgcagcaagtgctttctatgcgtttcttcattaaaacattaggctaataaaaaaaaaaaaaaaaaaaaaaaaaa

SEQ ID NO: 58793 - DNA, 941 bp, Homo sapiens
cttacagaactcccacggacacaccatgattaggaccctgctgctgtccactttggtggctggagccctcagttgtggggtctccacttacgcgcctgatatgtctaggatgcttggaggtgaagaagcgaggcccaacagctggccctggcaggtctccctgcagtacagctccaatggccagtggtaccacacctgcggagggtccctgatagccaacagctgggtcctgacggctgcccactgcatcagctcctccgggatctaccgcgtgatgctgggccagcataacctctacgttgcagagtccggctcgctggccgtcagtgtctctaagattgtggtgcacaaggactggaactccgaccaggtctccaaagggaacgacattgccctgctcaaactggctaaccccgtctccctcaccgacaagatccagctggcctgcctccctcctgccggcaccattctacccaacaactacccctgctacgtcacgggctggggaaggctgcagaccaacggggctctccctgatgacctgaagcagggccggttgctggttgtggactatgccacctgctccagctctggctggtggggcagcaccgtgaagacgaatatgatctgtgctgggggtgatggcgtgatatgcacctgcaacggagactccggtgggccgctgaactgtcaggcatctgacggccggtgggaggtgcatggcatcggcagcctcacgtcggtccttggttgcaactactactacaagccctccatcttcacgcgggtctccaactacaacgactggatcaattcggtgattgcaaataactaaccaaaagaagtccctgggactgtttcagacttggaaaggtcacagaaggaaaataatattatataaagtgacaactatgcaaatcacaaaaaaaaaaaaaaaaaaa

SEQ ID NO: 58794 - DNA, 1055 bp, Homo sapiens
acctgcatttccaccacctgttctgggagtggggcccagtcagccccctttgcttaccttctgccctatattagagccccaggttctgtgcccttttcctatcatcgcaaaactcatgatgctccggctgctcagttccctcctccttgtggccgttgcctcaggctatggcccaccttcctctcgcccttccagccgcgttgtcaatggtgaggatgcggtcccctacagctggccctggcaggtttccctgcagtatgagaaaagcggaagcttctaccacacctgtggcggtagcctcatcgcccccgactgggttgtgactgccggccactgcatctcgagctcccggacctaccaggtggtgttgggcgagtacgaccgtgctgtgaaggagggccccgagcaggtgatccccatcaactctggggacctctttgtgcatccactctggaaccgctcgtgtgtggcctgtggcaatgacatcgccctcatcaagctctcacgcagcgcccagctgggagacgccgtccagctcgcctcactccctccggctggtgacatccttcccaacgagacaccctgctacatcaccggctggggccgtctctataccaacgggccactcccagacaagctgcaggaggccctgctgccggtggtggactatgaacactgctccaggtggaactggtggggttcctccgtgaagaagaccatggtgtgtgctggaggggacatccgctccggctgcaatggtgactctggaggacccctcaactgccccacagaggatggtggctggcaggtccatggcgtgaccagctttgtttctgcctttggctgcaacacccgcaggaagcccacggtgttcactcgagtctccgccttcattgactggattgaggagaccatagcaagccactagaaccaaggcccagctggcagtgctgatcgatcccacatcctgaataaagaataaagatctctcagaaaattccaaaaaaaaaaaaaaaaaaaaaaaaaaaaaaaaaaaaaaaaaaaaaaaaaaaaaa

SEQ ID NO: 58795 - DNA, 5582 bp, Homo sapiens
caagccgccggcccggagagcgcgcggcggcggcggcggcgggacggccccgagcgcgccctccccgtgcggccactcgcagcggcgctggccgggccggcgcgcccgcaggcggctagagcagcggcctcggcctcggcgcgggcttgccccgggccgtagcccgcgagaggcggcgcgggcggccgagggcactgaacggcgtcgcggtacgctcccgggcggcggcgcagcggcagcggcagcggcagcggcagcgcagggggcggaggcagggggcgcccccagccaggatgctgcggttcctgcgccggacctttggccgccgctccatgcagcgctacgcggggcgcggcggggcgcggggccgccgggctgggggacgagcgcgatgggggccacgggggggcccggccgccgccgcctcctcctcggcgctgcccgccgcgcccgggggcagcgtgttcccggcgggcggcgggcccctgctcaccggcggcgcggccgtgcacatctccgccgccggcgccgccaaggccaccctctactgccgcgtcttcctgctcgacgggaccgaagtgagcgtggacctgccgaaacatgccaaaggccaggatttgtttgatcagattgtgtaccacttggaccttgtggaaacagattactttggcctccagttcctcgactctgcccaggttgcgcactggctggatcatgccaaacccataaaaaagcagatgaaaattggacctgcttatgctttacactttcgagttaaatactattcttcagaaccaaacaaccttcgtgaggagtttacaaggtacctgtttgttttacaactcaggcatgacattctttctggaaaattgaaatgcccttatgaaacagctgtggaattagctgctctctgtctacaagcggagcttggggagtgcgagcttccagaacacacaccagagcttgtgtctgagtttcggttcattccaaatcagacagaagcaatggaatttgatatcttccagagatggaaagagtgcaggggaaagagccctgcccaggcggaactctcctatctgaataaagcgaagtggctggaaatgtatggggtagacatgcacgttgtcaggggaagagatggctgtgaatattctcttggactgaccccgacaggcatattaatctttgaaggagctaacaaaataggcttattcttttggcctaaaattaccaaaatggattttaaaaagagcaaattgacactcgtggtggtcgaggatgatgatcagggacgtgagcaagagcacacgtttgtgttccggttagacagtgccaggacctgcaaacacctttggaagtgtgcagttgagcaccacgcattcttccgactgcggacgccaggaaacagcaaatccaatagatccgactttatcaggctgggctctcgcttcagattcagtgggcggacagaatatcaagctacacatggctccaggttacgaagaaccagcacctttgagaggaagcctagtaaacgttatccatcccggagacattcaacgttcaaagcaagcaacccagtgatagcagcccagctctgctctaaaacaaatccggaagtccataattaccagcctcaatatcatcctaatatccatcccagccagccccggtggcatcctcactctccaaatgtcagctacccgctcccttccccagtgcttagcagctcggaccggttgccttttggcattgaggagaatgggggcacaccgttcctcaccgcagcttcaggaaggcatcaccaccagcaccagcatcagcatcagcaccagcaccactcaaactacagcctctcactgaccctggagaacaaagaggggcctctgaggtccccaaactccagcagcaagtcccttacaaaactgagtccaggaacacctgccttgttcagtgaagccgctgcccatctaaagaagctggaactggaaactgtgaaggctgctggaccctggcctcctctgcacatcaacataaacaaggctgaagaaaagaaagtctcggagaaaactcttcagactccacttttgccttcccctgttgcggatcatgtgaagtgtaacattctgaaagcccagttggaaaatgcttcccgagtgaacatccagggtggaaaggaggaatcaccgtttgtaaatatcaataagaaatccagtcttcaggacgctagtgtaagaagtcctattcctattcgtgtggaaactgcccagccagctgtggaaaagccggaaatcaagcctccccgagtgaggaagttaacaagacagtatagttttgatgaagacgacctccctccagacctggccgaggcagtgggagtgaccacatctacaaccacaaacaccacaacggctgccacacaagtctccgtgccgctgccgtcccccaaggtccagaatgtcagctcgcctcacaagtcagaaggcaaaggcctgctgtcccctggggccaagagcccctctgaccgaggaggtgcctttaccctggagccgggtgatcttctgatggatttcacagaagccactcctctggcagagcccgccagcaacccccactgtgcccactctcgctgttctcctccactctctctccccatgaaggaagagaccactggagtttgcatgtaccctccaatcaaaacgaggctgataaaaacattcccggttgatacaatgaccccgtttcctgatactttcaccacagggccacagtttactgcagacttcagagacagtaaattacagtgctgtcctggcccgacttccccgctgatcccagcagcgaccctgaggcctttgacagagaccgtctccacagtgcagaccatttacaccaccccggaaacctgtttctctggcagccagtgcagagacactccggcaggaactggagagagagaagatgatgaaaagactgttgatgaccagactgtgaaattctccccttgtcacctggaagatggcatggtgccttctgtccatcttctttcttcgggctttgtgtgctcactctagcacagcatacaagtgtgtgctttgttcgcccaggtctccatggttagttgaagccaatttctggcttgacttttatgggaaaagttattttatgtctcctaagcattagagtttttctattactctatgtagttgagacaggatttgataagtctaggaaaagaaagatgggaaaacgggattccttttcagaagtacctgtgtgtatctgttaataaccacaggggttaatatgatgtaggatctttactatcaatttcaaccatttgattttgtatgattgaaacttgcaccgagctttgactgtttgttaaagagtcatttttaatgaaagaataattctttattgctggtttttcatttacactgataaatacacagatcttataaagtctttaacattcatttgtattcagatgtgagtagaagaactaaaaaaagaaagttacatatcactatgactgaaggtacttcagcttaatctgaaatataatttaacttgtgaactccttggatatgatattatttggaataaacagaatttatcattgaacccaaagtaggaaatgatagcttacattgtctaaaaatccttacaaggttaagatgattcaatatcaagaatattcagaaaattatttctaaagttgatcgattcatgtcgtattgatagaatcttgaccagaagaaattttgctctttttatatagtttcaagaaatgtgtttttaaatttttattaatgcacttgaacaactttgcaggaataaagcaaccccctaaccacaaaatatccctctaaattagttccctagctttctcaatgaatacacacatatttttacatagctatgatcgttgtgtacattctcctttgttttacttctcggcctaacacttgtctcctcttgtcaacacagattctgctctcaccaatttaaatgtctttatatccatgtaacatgggtaacctcacttcaccccattattagatatttgagttatatctaatttttcactcttataaatagtgctgctatgaatgtctgtaaaaaaaaaaaactgctccttcttttggattattcccttaggaatatctccaaagagggattacaaggtcaaagagcatgaagtattttatagctcttgttttatattgccagattgctttctagaaagatccaatctttgggttggaaggaccttaaaggtcatctagtttagcctccccaccccctctgaatgcttgaatcccctcgacaatttatgatgccaccagcaatgtataagcatttctgtttaccaatagctctgccagtattgggttttgccatttttatttatttttgctagtttaataggtatgtatagttgttcttgaagagttgttttatttcattaattgctagcaaggctgagcacttttccatgtgatgatttactagttgtatttccttgtgtgtaaaatgttcattcatttcttatgaccacttgttaagaggaactgatctcatatatttgtatcagaactgtatttttatgttatattgtatagtttgctctcctgcccctctccttaaaactgaatggtgccaataatttgatactaatgactacaaaaaaaggtaatgcctcatttactagtattgttgtaaaatgaggaatgtatgtgaatattcagataaccgaggattaaccctttaagtgctgaatctttaaaattttaatatatttttttttgagggaaatctttctaaaatgtattacgcacttccctgccttagtaaacagagtatactggagagtatttaaccttttcttgatgagtcatggtcatgattataaacatcagccccttttataccttggtacggtgcagtgatatcattaagagctatcaatatgtgtagggcttggcttggccttttataggatattatgctgttctcactgatggttttttactgctctctgctctgtcagtggagctatccggggcaattgtagcgtttgggtccttttacccctatgtcccccggctatacttttaaaacagctttagctgttctttatcttgtgcacatgatacaaaatatgttcccgtacaatatggggctgtcacttcttgccaacccagcaccctcttcctcttctaacctgctttctgaggcttctgctcttcacctcctgctcgctgatggaaacctccagggcaaagctgaaggtttcttggggaagccaggaaagccagtatttcctatgtgtcagatctgcttggcttccaagaagggatgcatgggctttttggccagtgtttccaggaggctctgggcttcctgcttcttccccgcttcccccagagttcacagatgttgaagtttctgaaggttgacgtcactggaagtctgaccacaaacaagttggctgttactgtatttgaaacccagtacctttggcagctcacctctaaccagtaaaataagaggattccatggtttctttttttttt

SEQ ID NO: 58796 - DNA, 2265 bp, Homo sapiens
gtcagaactaccccggtagcctgacagcaggagctcgagagaagcatggctcagcggtgcgtttgcgtgctggccctggtggctatgctgctcctagttttccctaccgtctccagatcgatgggcccgaggagcggggagcatcaaagggcgtcgcgaatcccttctcagttcagcaaagaggaacgcgtcgcgatgaaagaggcgctgaaaggtgccatccagattccaacagtgacttttagctctgagaagtccaatactacagccctggctgagttcggaaaatacattcataaagtctttcctacagtggtcagcaccagctttatccagcatgaagtcgtggaagagtatagccacctgttcactatccaaggctcggaccccagcttgcagccctacctgctgatggctcactttgatgtggtgcctgcccctgaagaaggctgggaggtgcccccattctctgggttggagcgtgatggcgtcatctatggtcggggcacactggacgacaagaactctgtgatggcattactgcaggccttggagctcctgctgatcaggaagtacatcccccgaagatctttcttcatttctctgggccatgatgaggagtcatcagggacaggggctcagaggatctcagccctgctacagtcaaggggcgtccagctagccttcattgtggacgaggggggcttcatcttggatgatttcattcctaacttcaagaagcccatcgccttgattgcagtctcagagaagggttccatgaacctcatgctgcaagtaaacatgacttcaggccactcttcagctcctccaaaggagacaagcattggcatccttgcagctgctgtcagccgattggagcagacaccaatgcctatcatatttggaagcgggacagtggtgactgtattgcagcaactggcaaatgagtttcccttccctgtcaatataatcctgagcaacccatggctatttgaaccacttataagcaggtttatggagagaaatcccttaaccaatgcaataatcaggaccaccacggcactcaccatattcaaagcaggggtcaagttcaatgtcatccccccagtggcccaggccacagtcaacttccggattcaccctggacagacagtccaagaggtcctagaactcacgaagaacattgtggctgataacagagtccagttccatgtgttgagtgcctttgaccccctccccgtcagcccttctgatgacaaggccttgggctaccagctgctccgccagaccgtacagtccgtcttcccggaagtcaatattactgccccagttacttctattggcaacacagacagccgattctttacaaacctcaccactggcatctacaggttctaccccatctacatacagcctgaagacttcaaacgcatccatggagtcaacgagaaaatctcagtccaagcctatgagacccaagtgaaattcatctttgagttgattcagaatgctgacacagaccaggagccagtttctcacctgcacaaactgtgaggtcaaggggcctgctgggttaggcatgcccgaccccgggacaggactaacccaagggggaaagctagtgttgatgaaacttttgatcaaaaccacattgtaaaacattgcccatctgtcttgctcactcttaaactctcccaagaacaaggccggggtaaggtaaagtcagcagaaatctggcttctcccttcctcccgacatctgcatcccttgatccactggcatttgctgccctcttgtcccttatctgtcttatgctggttatttcactgcttcaccttccaggcttgacttaacaaatgtagatttgagaaatctcaaccagttgttacctgataggagtctttaatttagggcactcttgctgggatgctttctccagagcttatatatttcttcttactagaactttcttcccccttttattcccctctcttcttggactcatgagctgtctcttcatctctcctctctctcctgcatctctccccttactcttcaatttattctacttctggacctggacttacccaaactgtgatactaccataattgtcaccataatcagtcaaataaagtgatctgtgcatcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 58797 - DNA, 1868 bp, Homo sapiens
aacgtcttcccacctttttctcccctctccgtcttctcccctccttcttccccactgcggtcttcccgcatcctcttctgccgtctccctactgtcttcttcccgcaccttctcccccgcagttttttttccccttccccaccgttttcttctcctcagtctctcccattcctcgcagcacgggttcctgtggcggcagcttttccttccatctccttctctccacccgctggcttccagtctccaccttcccgcctattcccccagcagcgtcttcccgccgctccctcttctcccctccccctcctcaccgtcttctcccggcctattaccgccaaccgttttcttcctcaccccgcacccttttcttcccatgtctgccttagtcttcttcccaccctcttctcctctccccatcgccttcttcccaccctcttctcctctccccatcgccttcttcccaccctcttctcctctcccaatcgtcttctttcccagcctcttctccattttcttgccgcctccatatccccaccttcttctcgcagcagcgtcttcctgccgcgcttttctctcccctcaccatcttctcttcctcttccccaccgtcctctccccacgccctcttctcctctcactgtcttctccccgcgccttccccacaaccgttttgtcccccgttttcttcccctcacaccgttttcttcccatgtcctcccaccgtctcgcagcagcgtctgtcagtcgcaatcttcttcccactttcttctctccccctcccatcgtcttttttccccagcctcttattctccgccatcttcttcccctccccaccttctcgcagcagcgacttcctgccgcgtttttctctccccgcaccctcttctcccctcttccactccccaccgtcttcgcccccgatcgtcgtcttgcccacccccttctcgcgctctccaactgcctttcacctagaagcgctccacgcgtgcgcccggctgtgtccctgcgcctggtgtgtctgtgcgcccaggcagccccatgagctgggcccctgagctccgccccaacagccaacaggagacccaggagagtcgctgccagggccatcacggctgccgccgcccccgcccccgccgctacctcagaactgaacagtgttggctgcgggcgaaagacactggggcccggaagactgcggggagagggggaggaggggacggagagggtgggaaagaccttggaaagtgggatggggagaaaggtggggaagaagacagtggggagaaagtgcagggagaagacagtatggtagagaagacagtggaggaaaacggtgaggagaaaggagggtggaaaagaagacgatgaggacaaggccgggcgcggtggctcacgcctgtaatcccagcactttgggaggctgatgcgggcggatcacaaggtcaggagttcgagacctgcctgaccaacatgctgaaacccagtctctactaaaaatacaaaaattagctgggcgtgatggcgagcgcctgtaatccagctactccagcgcctgaggcaggagaatcgcttgagccccggaggcggaggttgcagtgagctgagaactcaccattgcactccagcctggatgacagagaaggtcatgggaacatacagagacctacagggaagacggccatgggacaagggaggcagagtctggagtacgctgcctacagtcacggaatgccaaggacagctggaaaccaccagaagctaagaaggagattttacctgaaagcctctcaaagaaatcaatcatactcacacctcctttttgaatttctggcctcgtgaatggtgaaaaaataaatttctgtcgtctt

SEQ ID NO: 58798 - DNA, 1068 bp, Homo sapiens
atggatttccttcacaggaatggagtgctcataattcagcatttgcagaaggactaccgagcttactacacttttctaaattttatgtccaatgttggagaccccaggaatatctttttcatttattttccactttgttttcaatttaatcagacagttggaaccaagatgatatgggtagcagtcattggggattggttaaatcttatatttaaatggatattatttggtcatcgaccttactggtgggtccaagaaactcagatttacccaaatcactcaagtccatgccttgaacagttccctactacatgtgaaacaggtccaggaagtccatctggccatgcaatgggcgcatcctgtgtctggtatgtcatggtaaccgctgccctgagccacactgtctgtgggatggataagttctctatcactctgcacagactgacctggtcatttctttggagtgttttttggttgattcaaatcagtgtctgcatctccagagtattcatagcaacacattttcctcatcaagttattcttggagtaattggtggcatgctggtggcagaggcctttgaacacactccaggcatccaaacggccagtctgggcacatacctgaagaccaacctctttctcttcctgtttgcagttggcttttacctgcttcttagggtgctcaacattgacctgctgtggtccgtgcccatagccaaaaagtggtgtgctaaccccgactggatccacattgacaccacgccttttgctggactcgtgagaaaccttggggtcctctttggcttgggctttgcaatcaactcagagatgttcctcctgagctgccgagggggaaataactacacactgagcttccggttgctctgtgccttgacctcattgacaatactgcagctctaccatttcctccagatcccgactcacgaagagcatttattttatgtgctgtctttttgtaaaagtgcatccattcccctaactgtggttgctttcattccctactctgttcatatgttaatgaaacaaagcggaaagaagagtcagtag

SEQ ID NO: 58799 - DNA, 2448 bp, Homo sapiens
attcccatggctggccagaggaggaacgctttgtgttctcatcggagctgcatgggaagtctgcatacagcaaagtgacctgcatgcctcaccttatggaaaggatggtgggctctggcctcctgtggctggccttggtctcctgcattctgacccaggcatctgcagtgcagcgaggttatggaaaccccattgaagccagttcgtatgggctggacctggactgcggagctcctggcaccccagaggctcatgtctgttttgacccctgtcagaattacaccctcctggatgaacccttccgaagcacagagaactcagcagggtcccaggggtgcgataaaaacatgagcggctggtaccgctttgtaggggaaggaggagtaaggatgtcggagacctgtgtccaggtgcaccgatgccagacagacgctcccatgtggctgaatgggacccaccctgcccttggggatggcatcaccaaccacactgcctgtgcccattggagtggcaactgctgtttctggaaaacagaggtgctggtgaaggcctgcccaggcgggtaccatgtgtaccggttggaaggcactccctggtgtaatctgagatactgcacagttccacgagacccatccactgtggaggacaagtgtgagaaggcctgccgccccgaggaggagtgccttgccctcaacagcacctggggctgtttctgcagacaggacctcaatagttctgatgtccacagtttgcagcctcagctagactgtgggcccagggagatcaaggtgaaggtggacaaatgtttgctgggaggcctgggtttgggggaggaggtcattgcctacctgcgagacccaaactgcagcagcatcttgcagacagaggagaggaactgggtatctgtgaccagccccgtccaggctagtgcctgcaggaacattctggagagaaatcaaacccatgccatctacaaaaacaccctctccttggtcaatgatttcatcatcagagacaccatcctcaacatcaacttccaatgtgcctacccactggacatgaaagtcagcctccaagctgccttgcagcccattgtaagttccctgaacgtcagtgtggacgggaatggagagttcattgtcaggatggccctcttccaagaccagaactacacgaatccttacgaaggggatgcagttgaactgtctgttgagtccgtgctgtatgtgggtgccatcttggaacaaggggacacctcccggtttaacctggtgttgaggaactgctatgccacccccactgaagacaaggctgaccttgtgaagtatttcatcatcagaaacagctgctcaaatcaacgtgattccaccatccacgtggaggagaatgggcagtcctcggaaagccggttctcagttcagatgttcatgtttgctggacattatgacctagttttcctgcattgtgagattcatctctgtgattctcttaatgaacagtgccagccttcttgctcaagaagtcaagtccgcagtgaagtaccggccatcgacctagcccgggttctagatttggggcccatcactcggagaggtgcacagtctcccggtgtcatgaatggaacccctagcactgcagggttcctggtggcctggcctatggtcctcctgactgtcctcctggcttggctgttctgagagctccgctgagcatctggccttgaagtttgtgttcttccctctggcaatggctcccttcagcacttctgctttccactccaattcacacaggcttggtattaacagaatcaaggccaggctaggttaggaaaagggaagagctttcaccttctttaaaactctcggctgggcgcagtggctcatgcctgtaatcccagcattttgggaggctgaggcaggtggatcacctgaggtcagcagttcaaaatcagcctggccaaaatgctgaaactccgtctctactaaaaatacaaaaattagccaggcatggtggcaggcgcctgtaatcccagctactcgggaggccaaggcaggagaattgctcgaactcagggggtggaggttgcagtgagttgagattgtgccattgcactccagcctgggcaacagagcaagactctgtctcaggaaaaaaaaaaaaaaaaaagaaaagcaacatagtggggtttctgtcaatctgtcctcggctgcccttctcatttgttgatgggaccttgaaagcaagcttgctaggtgccctctgtggctccagcctttaccggaagtgtggtgcatgtttttaacttcagggaagcggtatcctgtcactggggtatgggatgagcatggagaagaggcaccagccacgattccttcctaagcatctcctgttctgactgctcatgaattgaagaaactgacccttgtgttcaaaaaaaaaaaaaaaaaa

SEQ ID NO: 58800 - DNA, 2007 bp, Homo sapiens
attcccatggctggccagaggaggaacgctttgtgttctcatcggagctgcatgggaagtctgcatacagcaaagtgacctgcatgcctcaccttatggaaaggatggtgggctctggcctcctgtggctggccttggtctcctgcattctgacccaggcatctgcagtgcagcgagttccacgagacccatccactgtggaggacaagtgtgagaaggcctgccgccccgaggaggagtgccttgccctcaacagcacctggggctgtttctgcagacaggacctcaatagttctgatgtccacagtttgcagcctcagctagactgtgggcccagggagatcaaggtgaaggtggacaaatgtttgctgggaggcctgggtttgggggaggaggtcattgcctacctgcgagacccaaactgcagcagcatcttgcagacagaggagaggaactgggtatctgtgaccagccccgtccaggctagtgcctgcaggaacattctggagagaaatcaaacccatgccatctacaaaaacaccctctccttggtcaatgatttcatcatcagagacaccatcctcaacatcaacttccaatgtgcctacccactggacatgaaagtcagcctccaagctgccttgcagcccattgtaagttccctgaacgtcagtgtggacgggaatggagagttcattgtcaggatggccctcttccaagaccagaactacacgaatccttacgaaggggatgcagttgaactgtctgttgagtccgtgctgtatgtgggtgccatcttggaacaaggggacacctcccggtttaacctggtgttgaggaactgctatgccacccccactgaagacaaggctgaccttgtgaagtatttcatcatcagaaacagctgctcaaatcaacgtgattccaccatccacgtggaggagaatgggcagtcctcggaaagccggttctcagttcagatgttcatgtttgctggacattatgacctagttttcctgcattgtgagattcatctctgtgattctcttaatgaacagtgccagccttcttgctcaagaagtcaagtccgcagtgaagtaccggccatcgacctagcccgggttctagatttggggcccatcactcggagaggtgcacagtctcccggtgtcatgaatggaacccctagcactgcagggttcctggtggcctggcctatggtcctcctgactgtcctcctggcttggctgttctgagagctccgctgagcatctggccttgaagtttgtgttcttccctctggcaatggctcccttcagcacttctgctttccactccaattcacacaggcttggtattaacagaatcaaggccaggctaggttaggaaaagggaagagctttcaccttctttaaaactctcggctgggcgcagtggctcatgcctgtaatcccagcattttgggaggctgaggcaggtggatcacctgaggtcagcagttcaaaatcagcctggccaaaatgctgaaactccgtctctactaaaaatacaaaaattagccaggcatggtggcaggcgcctgtaatcccagctactcgggaggccaaggcaggagaattgctcgaactcagggggtggaggttgcagtgagttgagattgtgccattgcactccagcctgggcaacagagcaagactctgtctcaggaaaaaaaaaaaaaaaaaagaaaagcaacatagtggggtttctgtcaatctgtcctcggctgcccttctcatttgttgatgggaccttgaaagcaagcttgctaggtgccctctgtggctccagcctttaccggaagtgtggtgcatgtttttaacttcagggaagcggtatcctgtcactggggtatgggatgagcatggagaagaggcaccagccacgattccttcctaagcatctcctgttctgactgctcatgaattgaagaaactgacccttgtgttcaaaaaaaaaaaaaaaaaa

SEQ ID NO: 58801 - DNA, 1998 bp, Homo sapiens
attcccatggctggccagaggaggaacgctttgtgttctcatcggagctgcatgggaagtctgcatacagcaaagtgacctgcatgcctcaccttatggaaaggatggtgggctctggcctcctgtggctggccttggtctcctgcattctgacccaggcatctgcagtgcagcgagacccatccactgtggaggacaagtgtgagaaggcctgccgccccgaggaggagtgccttgccctcaacagcacctggggctgtttctgcagacaggacctcaatagttctgatgtccacagtttgcagcctcagctagactgtgggcccagggagatcaaggtgaaggtggacaaatgtttgctgggaggcctgggtttgggggaggaggtcattgcctacctgcgagacccaaactgcagcagcatcttgcagacagaggagaggaactgggtatctgtgaccagccccgtccaggctagtgcctgcaggaacattctggagagaaatcaaacccatgccatctacaaaaacaccctctccttggtcaatgatttcatcatcagagacaccatcctcaacatcaacttccaatgtgcctacccactggacatgaaagtcagcctccaagctgccttgcagcccattgtaagttccctgaacgtcagtgtggacgggaatggagagttcattgtcaggatggccctcttccaagaccagaactacacgaatccttacgaaggggatgcagttgaactgtctgttgagtccgtgctgtatgtgggtgccatcttggaacaaggggacacctcccggtttaacctggtgttgaggaactgctatgccacccccactgaagacaaggctgaccttgtgaagtatttcatcatcagaaacagctgctcaaatcaacgtgattccaccatccacgtggaggagaatgggcagtcctcggaaagccggttctcagttcagatgttcatgtttgctggacattatgacctagttttcctgcattgtgagattcatctctgtgattctcttaatgaacagtgccagccttcttgctcaagaagtcaagtccgcagtgaagtaccggccatcgacctagcccgggttctagatttggggcccatcactcggagaggtgcacagtctcccggtgtcatgaatggaacccctagcactgcagggttcctggtggcctggcctatggtcctcctgactgtcctcctggcttggctgttctgagagctccgctgagcatctggccttgaagtttgtgttcttccctctggcaatggctcccttcagcacttctgctttccactccaattcacacaggcttggtattaacagaatcaaggccaggctaggttaggaaaagggaagagctttcaccttctttaaaactctcggctgggcgcagtggctcatgcctgtaatcccagcattttgggaggctgaggcaggtggatcacctgaggtcagcagttcaaaatcagcctggccaaaatgctgaaactccgtctctactaaaaatacaaaaattagccaggcatggtggcaggcgcctgtaatcccagctactcgggaggccaaggcaggagaattgctcgaactcagggggtggaggttgcagtgagttgagattgtgccattgcactccagcctgggcaacagagcaagactctgtctcaggaaaaaaaaaaaaaaaaaagaaaagcaacatagtggggtttctgtcaatctgtcctcggctgcccttctcatttgttgatgggaccttgaaagcaagcttgctaggtgccctctgtggctccagcctttaccggaagtgtggtgcatgtttttaacttcagggaagcggtatcctgtcactggggtatgggatgagcatggagaagaggcaccagccacgattccttcctaagcatctcctgttctgactgctcatgaattgaagaaactgacccttgtgttcaaaaaaaaaaaaaaaaaa

SEQ ID NO: 58802 - DNA, 2439 bp, Homo sapiens
attcccatggctggccagaggaggaacgctttgtgttctcatcggagctgcatgggaagtctgcatacagcaaagtgacctgcatgcctcaccttatggaaaggatggtgggctctggcctcctgtggctggccttggtctcctgcattctgacccaggcatctgcagtgcagcgaggttatggaaaccccattgaagccagttcgtatgggctggacctggactgcggagctcctggcaccccagaggctcatgtctgttttgacccctgtcagaattacaccctcctggatgaacccttccgaagcacagagaactcagcagggtcccaggggtgcgataaaaacatgagcggctggtaccgctttgtaggggaaggaggagtaaggatgtcggagacctgtgtccaggtgcaccgatgccagacagacgctcccatgtggctgaatgggacccaccctgcccttggggatggcatcaccaaccacactgcctgtgcccattggagtggcaactgctgtttctggaaaacagaggtgctggtgaaggcctgcccaggcgggtaccatgtgtaccggttggaaggcactccctggtgtaatctgagatactgcacagacccatccactgtggaggacaagtgtgagaaggcctgccgccccgaggaggagtgccttgccctcaacagcacctggggctgtttctgcagacaggacctcaatagttctgatgtccacagtttgcagcctcagctagactgtgggcccagggagatcaaggtgaaggtggacaaatgtttgctgggaggcctgggtttgggggaggaggtcattgcctacctgcgagacccaaactgcagcagcatcttgcagacagaggagaggaactgggtatctgtgaccagccccgtccaggctagtgcctgcaggaacattctggagagaaatcaaacccatgccatctacaaaaacaccctctccttggtcaatgatttcatcatcagagacaccatcctcaacatcaacttccaatgtgcctacccactggacatgaaagtcagcctccaagctgccttgcagcccattgtaagttccctgaacgtcagtgtggacgggaatggagagttcattgtcaggatggccctcttccaagaccagaactacacgaatccttacgaaggggatgcagttgaactgtctgttgagtccgtgctgtatgtgggtgccatcttggaacaaggggacacctcccggtttaacctggtgttgaggaactgctatgccacccccactgaagacaaggctgaccttgtgaagtatttcatcatcagaaacagctgctcaaatcaacgtgattccaccatccacgtggaggagaatgggcagtcctcggaaagccggttctcagttcagatgttcatgtttgctggacattatgacctagttttcctgcattgtgagattcatctctgtgattctcttaatgaacagtgccagccttcttgctcaagaagtcaagtccgcagtgaagtaccggccatcgacctagcccgggttctagatttggggcccatcactcggagaggtgcacagtctcccggtgtcatgaatggaacccctagcactgcagggttcctggtggcctggcctatggtcctcctgactgtcctcctggcttggctgttctgagagctccgctgagcatctggccttgaagtttgtgttcttccctctggcaatggctcccttcagcacttctgctttccactccaattcacacaggcttggtattaacagaatcaaggccaggctaggttaggaaaagggaagagctttcaccttctttaaaactctcggctgggcgcagtggctcatgcctgtaatcccagcattttgggaggctgaggcaggtggatcacctgaggtcagcagttcaaaatcagcctggccaaaatgctgaaactccgtctctactaaaaatacaaaaattagccaggcatggtggcaggcgcctgtaatcccagctactcgggaggccaaggcaggagaattgctcgaactcagggggtggaggttgcagtgagttgagattgtgccattgcactccagcctgggcaacagagcaagactctgtctcaggaaaaaaaaaaaaaaaaaagaaaagcaacatagtggggtttctgtcaatctgtcctcggctgcccttctcatttgttgatgggaccttgaaagcaagcttgctaggtgccctctgtggctccagcctttaccggaagtgtggtgcatgtttttaacttcagggaagcggtatcctgtcactggggtatgggatgagcatggagaagaggcaccagccacgattccttcctaagcatctcctgttctgactgctcatgaattgaagaaactgacccttgtgttcaaaaaaaaaaaaaaaaaa

SEQ ID NO: 58803 - DNA, 774 bp, Homo sapiens
ccagcaggaggcacaggaaaactgcaagccgctctgttcctgggcctcggaagtgatgcctatggcgtcccctcaaaccctggtcctctatctgctggtcctggcagtcactgaagcctggggccaggaggcagtcatcccaggctgccacttgcaccccttcaatgtgacagtgcgaagtgaccgccaaggcacctgccagggctcccacgtggcacaggcctgtgtgggccactgtgagtccagcgccttcccttctcggtactctgtgctggtggccagtggttaccgacacaacatcacctccgtctctcagtgctgcaccatcagtggcctgaagaaggtcaaagtacagctgcagtgtgtggggagccggagggaggagctcgagatcttcacggccagggcctgccagtgtgacatgtgtcgcctctctcgctactagcccatcctctcccctccttcctcccctgggtcacagggcttgacattctggtgggggaaacctgtgttcaagattcaaaaactggaaggagctccagccctgatggttacttgctatggaatttttttaaataaggggagggttgttccagctttgatcctttgtaagattttgtgactgtcacctgagaagaggggagtttctgcttcttccctgcctctgcctggcccttctaaaccaatctttcatcattttacttccctctttgcccttacccctaaataaagcaagcagttcttgaaaaaaaaaaaaaaaaaaaaaaaaaaaaa

SEQ ID NO: 58804 - DNA, 1462 bp, Homo sapiens
gattactagttagcaaatgagggggtaaatattccagtggatacaagcttggactcttttcttgaagctttctttctatcagaagcatttgctgatattgctgacattgaaacattaaaagaaaatttgagaagcaatgggcatcctgaagctgcaagtatttctcattgtgctctctgttgcattgaaccatctgaaagctacacccattgaaagtcatcaggtggaaaagcggaaatgcaacactgccacatgtgcaacgcagcgcctggcaaattttttagttcattccagcaacaactttggtgccattctctcatctaccaacgtgggatccaatacatatggcaagaggaatgcagtagaggttttaaagagagagccactgaattacttgcccctttagaggacaatgtaactctatagttattgttttatgttctagtgatttcctgtataatttaacagtgcccttttcatctccagtgtgaatatatggtctgtgtgtctgatgtttgttgctaggacatataccttctcaaaagattgttttatatgtagtactaactaaggtcccataataaaaagatagtatcttttaaaatgaaatgtttttgctatagatttgtattttaaaacataagaacgtcattttgggacctatatctcagtggcacaggtttaagaacgaaggagaaaaaggtagtttgaaccttggtaaattgtaaacagctaataatgaagttattcttgacatgagaaaatcagtaattggaccaggcgcggtggctcttgcctgtagtcccggcactttgggaggccgaggcaggcagatcacaaggtcaggagttcgagaccagcctgaccaacgtggtgaaaccctgtctctactggaaatacggaaattagccgggggtggtgacatgtgcctgtaatcccagctactcaggaggctaaggcaggagaatcgcttgaacccaggaggcggaggttgcagtgagccgagattgcaccactgcactccagcctgggtggcagagtgagactcgtctcaaaaaaaagaaagaaaattagtaattgtaagtacccctgataagcaaattagtaattgtcaatacccctgttaagcaattcctttttgcagtatatttctgaaatgacagaatgctgttttaaaaacaaagaaataaaatcctgctcctgactcggtcaaaatattttttaaagtctattgtttgttgtgcttgctggtactaagaggctatttaaaagtataaaactgctttgtatccatgagggtttcattgtgtgttagcagcagtgagcttctattaaatgtatatgtcatttattttgtttaagtggctttcagcaaacctcagtcatattcttatgcagggtattgcgaaacaacttgtgttctattaatcgtgtcttcaattaaaagaccacagacttctgg

SEQ ID NO: 58805 - DNA, 2811 bp, Homo sapiens
gcagagtagaggccaagggagggctctgtgccagccccgatgaggacgctgctgaccatcttgactgtgggatccctggctgctcacgcccctgaggacccctcggatctgctccagcacgtgaaattccagtccagcaactttgaaaacatcctgacgtgggacagcgggccggagggcaccccagacacggtctacagcatcgagtataagacgtacggagagagggactgggtggcaaagaagggctgtcagcggatcacccggaagtcctgcaacctgacggtggagacgggcaacctcacggagctctactatgccagggtcaccgctgtcagtgcgggaggccggtcagccaccaagatgactgacaggttcagctctctgcagcacactaccctcaagccacctgatgtgacctgtatctccaaagtgagatcgattcagatgattgttcatcctacccccacgccaatccgtgcaggcgatggccaccggctaaccctggaagacatcttccatgacctgttctaccacttagagctccaggtcaaccgcacctaccaaatgcaccttggagggaagcagagagaatatgagttcttcggcctgacccctgacacagagttccttggcaccatcatgatttgcgttcccacctgggccaaggagagtgccccctacatgtgccgagtgaagacactgccagaccggacatggacctactccttctccggagccttcctgttctccatgggcttcctcgtcgcagtactctgctacctgagctacagatatgtcaccaagccgcctgcacctcccaactccctgaacgtccagcgagtcctgactttccagccgctgcgcttcatccaggagcacgtcctgatccctgtctttgacctcagcggccccagcagtctggcccagcctgtccagtactcccagatcagggtgtctggacccagggagcccgcaggagctccacagcggcatagcctgtccgagatcacctacttagggcagccagacatctccatcctccagccctccaacgtgccacctccccagatcctctccccactgtcctatgccccaaacgctgcccctgaggtcgggcccccatcctatgcacctcaggtgacccccgaagctcaattcccattctacgccccacaggccatctctaaggtccagccttcctcctatgcccctcaagccactccggacagctggcctccctcctatggggtatgcatggaaggttctggcaaagactcccccactgggacactttctagtcctaaacaccttaggcctaaaggtcagcttcagaaagagccaccagctggaagctgcatgttaggtggcctttctctgcaggaggtgacctccttggctatggaggaatcccaagaagcaaaatcattgcaccagcccctggggatttgcacagacagaacatctgacccaaatgtgctacacagtggggaggaagggacaccacagtacctaaagggccagctccccctcctctcctcagtccagatcgagggccaccccatgtccctccctttgcaacctccttcccgtccatgttccccctcggaccaaggtccaagtccctggggcctgctggagtcccttgtgtgtcccaaggatgaagccaagagcccagcccctgagacctcagacctggagcagcccacagaactggattctcttttcagaggcctggccctgactgtgcagtgggagtcctgaggggaatgggaaaggcttggtgcttcctccctgtccctacccagtgtcacatccttggctgtcaatcccatgcctgcccacgccacacactctgcgatctggcctcagacgggtgcccttgagagaagcagagggagtggcatgcagggcccctgccatgggtgcgctcctcaccggagcaaagcagcatgataaggactgcagcgggggagctctggggagcagcttgtgtagacaagcgcgtgctcgctgagccctgcaaggcagaaatgacagtgcaaggaggaaatgcagggaaactcccgaggtccagagccccacctcctaacaccatggattcaaagtgctcagggaatttgcctctccttgccccattcctggccagtttcacaatctagctcgacagagcatgaggcccctgcctcttctgtcattgttcaaaggtgggaagagagcctggaaaagaaccaggcctggaaaagaaccagaaggaggctgggcagaaccagaacaacctgcacttctgccaaggccagggccagcaggacggcaggactctagggaggggtgtggcctgcagctcattcccagccagggcaactgcctgacgttgcacgatttcagcttcattcctctgatagaacaaagcgaaatgcaggtccaccagggagggagacacacaagccttttctgcaggcaggagtttcagaccctatcctgagaatggggtttgaaaggaaggtgagggctgtggcccctggacgggtacaataacacactgtactgatgtcacaactttgcaagctctgccttgggttcagcccatctgggctcaaattccagcctcaccactcacaagctgtgtgacttcaaacaaatgaaatcagtgcccagaacctcggtttcctcatctgtaatgtggggatcataacacctacctcatggagttgtggtgaagatgaaatgaagtcatgtctttaaagtgcttaatagtgcctggtacatgggcagtgcccaataaacggtagctatttaaaaaaaaaaaaa

SEQ ID NO: 58806 - DNA, 2838 bp, Homo sapiens
gggcgcagagctgggccgagccgtcgccggcgccacgcgagtcccgcagccgccgcgcccgggcaatgggccgggggcactgagggccgccggggccgagcgcggaggggggaccgagccagtgccgtgccctcgggccgcgccaacatgccccgcggcttcctggtgaagcgcagcaagaagtccacgcccgtttcctaccgggtccgcggcggcgaggacggcgaccgcgcactgctgctctcgcccagctgcgggggcgcccgcgccgagcccccggcgccgagcccggtccccgggccgctgccgccgccgccgcccgcggagcgcgcccatgcagcgctcgccgccgcgcttgcctgcgcgcctgggccgcagccacccccgcagggcccgcgggccgcgcacttcggcaaccccgaggctgcgcaccccgcgccgctctacagtcccacgcggcccgtgagccgcgagcacgagaagcacaagtacttcgaacgcagcttcaacctgggctcgccggtctcggccgagtccttccccacgcccgccgcgctgctcggagggggcggcggcggcggcgcgagcggagctggcggaggcggcacctgcggcggcgacccgctgctcttcgcgcccgccgagctcaagatgggcacggcgttctcggctggcgccgaggcggcccgcggcccgggccccggccccccactgccccctgccgccgccctgcggcccccgggaaagcggcccccgccccctaccgccgcggagccgcccgccaaggcagtcaaggccccgggcgccaagaagcccaaggccatccgcaagctgcacttcgaggacgaggtgaccacgtcgcccgtgctggggctcaagatcaaggagggcccggtggaggcgccgcggggccgcgcggggggcgcggcgcggccgctgggcgagttcatctgccagctgtgcaaggaggagtacgccgacccgttcgcgctggcgcagcacaaatgctcgcgcatcgtgcgtgtggagtaccgctgtcccgagtgcgccaaggtcttcagctgcccggccaacctggcctcgcaccgccgctggcacaaaccgcggcccgcgcccgccgccgcccgcgcgccggagccagaagcagcagccagggctgaggcgcgggaggcacccggcggcggcagcgaccgggacacgccgagccccggcggcgtgtccgagtcgggctccgaggacgggctctacgagtgccatcactgcgccaagaagttccgccgccaggcctacctacgcaagcacctgctggcgcaccaccaggcgctgcaggccaagggcgcgccgctagcgcccccggccgaggacctactggccttgtaccccgggcccgacgagaaggcgccccaggaggcggccggcgacggcgagggggccggcgtgctgggcctgagtgcgtccgccgagtgccacctgtgcccagtgtgcggagagtcgttcgccagcaagggcgctcaggagcgccacctgcgcctgctgcacgccgcccaggtgttcccctgcaagtactgcccggccaccttctacagctcgcccggccttacgcggcacatcaacaagtgccacccatccgaaaacagacaggtgatcctcctgcaggtgcccgtgcgcccggcctgctagagcgcgccctccaccccggcccccgaactgtgccttcgcttggagacccacaaagagagtgcgccctgcacgccccgaacccgagtccgcgctgggggagcctcgcccccgcccccaccgggtgaaagtgtcgtctccgcttctctcggtgtggcgtgacggtaaccccatactctccttttgactccttttggaacccccacttttacgttgtgtccctccgcctcccccatggcgcaacaggagtcagtctctttctgtacaagggagaaaagctgtacgcgtttgtctcgtggttggaagcctccccttggcggggagaagctttttttcttgctagtattcgctgtgttcatggtctagaaatgcggtctggtctcgcctcgcctaccaatctctgctctctatgtatgtagcgtacgggttgttttgggtgaatcttgaggaataaatgcctttatatttcacaggctgtaaattgaacttcccacacgattagctttattatggcttgtgaactgctggagtctggctttacctttttgtatgtgaacaaatcaaattgcttaaaaaagagttttctttagtatagccacaaatgccttgaactgttgtctgggattgttttgtggggggagggaagggagtgttccgaagatgctgtagtaactgcctcagtgtttcacgtaagactttttggtttgatcatctttgttgaggtaggactatcagttccctctaaatgtatatgttgatttatgagtaattgttatttattctttatttatttatattaattatgaagattatgatattatttgattgcagatttttttggcgcgctgccccctccccaccctgccactcttgacattccactgtgcgttttagaagagagcctttttctaaagggatctgcttaaagttttaacttttatacctatctgagtgaattacagacaacctatcatttattctgcttcgagggtccccagggcccttgtacaaccgacagctcttacttttaaatgcaatctcttttctacatacattattttcttaattgttagctatttatagaaagcttcaatagaactgtttcaactgtataactatttactattcaaataaaatattttcaaagtcaaaaaaaaaaaa

SEQ ID NO: 58807 - DNA, 2397 bp, Homo sapiens
cccccgagccgcgccgagtctgccgccgccgcagcgcctccgctccgccaactccgccggcttaaattggactcctagatccgcgagggcgcggcgcagccgagcagcggctctttcagcattggcaaccccaggggccaatatttcccacttagccacagctccagcatcctctctgtgggctgttcaccaactgtacaaccaccatttcactgtggacattactccctcttacagatatgggagacatgggagatccaccaaaaaaaaaacgtctgatttccctatgtgttggttgcggcaatcagattcacgatcagtatattctgagggtttctccggatttggaatggcatgcggcatgtttgaaatgtgcggagtgtaatcagtatttggacgagagctgtacatgctttgttagggatgggaaaacctactgtaaaagagattatatcaggttgtacgggatcaaatgcgccaagtgcagcatcggcttcagcaagaacgacttcgtgatgcgtgcccgctccaaggtgtatcacatcgagtgtttccgctgtgtggcctgcagccgccagctcatccctggggacgaatttgcgcttcgggaggacggtctcttctgccgagcagaccacgatgtggtggagagggccagtctaggcgctggcgacccgctcagtcccctgcatccagcgcggccactgcaaatggcagcggagcccatctccgccaggcagccagccctgcggccccacgtccacaagcagccggagaagaccacccgcgtgcggactgtgctgaacgagaagcagctgcacaccttgcggacctgctacgccgcaaacccgcggccagatgcgctcatgaaggagcaactggtagagatgacgggcctcagtccccgtgtgatccgggtctggtttcaaaacaagcggtgcaaggacaagaagcgaagcatcatgatgaagcaactccagcagcagcagcccaatgacaaaactaatatccaggggatgacaggaactcccatggtggctgccagtccagagagacacgacggtggcttacaggctaacccagtggaagtacaaagttaccagccaccttggaaagtactgagcgacttcgccttgcagagtgacatagatcagcctgcttttcagcaactggtcaatttttcagaaggaggaccgggctctaattccactggcagtgaagtagcatcaatgtcctctcaacttccagatacacctaacagcatggtagccagtcctattgaggcatgaggaacattcattctgtattttttttccctgttggagaaagtgggaaattataatgtcgaactctgaaacaaaagtatttaacgacccagtcaatgaaaactgaatcaagaaatgaatgctccatgaaatgcacgaagtctgttttaatgacaaggtgatatggtagcaacactgtgaagacaatcatgggattttactagaattaaacaacaaacaaaacgcaaaacccagtatatgctattcaatgatcttagaagtactgaaaaaaaaagacgtttttaaaacgtagaggatttatattcaaggatctcaaagaaagcattttcatttcactgcacatctagagaaaaacaaaaatagaaaattttctagtccatcctaatctgaatggtgctgtttctatattggtcattgccttgccaaacaggagctccagcaaaagcgcaggaagagagactggcctccttggctgaaagagtcctttcaggaaggtggagctgcattggtttgatatgtttaaagttgactttaacaaggggttaattgaaatcctgggtctcttggcctgtcctgtagctggtttattttttactttgccccctccccactttttttgagatccatcctttatcaagaagtctgaagcgactataaaggtttttgaattcagatttaaaaaccaacttataaagcattgcaacaaggttacctctattttgccacaagcgtctcgggattgtgtttgacttgtgtctgtccaagaacttttcccccaaagatgtgtatagttattggttaaaatgactgttttctctctctatggaaataaaaaggaaaaaaaaaaggaaactttttttgtttgctcttgcattgcaaaaattataaagtaatttattatttattgtcggaagacttgccacttttcatgtcatttgacattttttgtttgctgaagtgaaaaaaaaagataaaggttgtacggtggtctttgaattatatgtctaattctatgtgttttgtctttttcttaaatattatgtgaaatcaaagcgccatatgtagaattatatcttcaggactatttcactaataaacatttggcatagat

SEQ ID NO: 58808 - DNA, 1226 bp, Homo sapiens
atgcccagtgctgggctctgcagctgctggggtggccgggtgctgcccctgctgctggcctatgtctgctacctgctgctcggtgccactatcttccagctgctagagaggcaggcggaggctcagtccagggaccagtttcagttggagaagctgcgcttcctggagaactacacctgcctggaccagtgggccatggagcagtttgtgcaggtcatcatggaagcctgggtgaaaggtgtgaaccccaaaggcaactctaccaaccccagcaactgggactttggcagcagtttcttctttgcaggcacagttgtcactaccataggatatgggaacctggcacccagcacagaggcaggtcaggtcttctgtgtcttctatgccctgttgggcatcccgcttaacgtgatcttcctcaaccacctgggcacagggctgcgtgcccatctggccgccattgaaagatgggaggaccgtcccaggcgctcccaggtactgcaagtcctgggcctggctctgttcctgaccctggggacgctggtcattctcatcttcccacccatggtcttcagccatgtggagggctggagcttcagcgagggcttctactttgctttcatcactctcagcaccattggctttggggactatgttgttggcacagaccccagcaagcattatatctcagtgtatcggagcctggcagccatctggatcctcctgggcctggcgtggctggcgctgatcctcccactgggccccctgcttctgcacagatgctgccagctctggctgctcagtctgaggcaaggctgtggagccaaggcggctccaggcaggagacccaggagaggctctacagcagcaagaggagtccaagtcacaccccaggacttccccatatccaagaaaggactgggaagctgaggacccacggactcttcacacagcctagacgcttcctccactccaggtagagggatttcgggggccttctcagaagcaaggagtggacaagcctcttggttaaggctcctcttacctcccaagctcatggacaagtggcaatcagctggggtccctcttttggggtacaaaggaaaggacagaggtgtgggagacccaaggtggtcttgagattgacagacagcaagtccttggagatagcccccgagtccaagaacttaggcaggggccccaagacaataaagttggtctctact

SEQ ID NO: 58809 - DNA, 2499 bp, Homo sapiens
gctgggcaccgttctgttttctttcttttcttaatcctatccaagtatgcagtacgctcttgggtcgtctcatgagacccaggggcatgttggaaagaactgagagaaagagcaacaaagcggcgagtggtgtgagagggcagcacgcgctgtggggcccttccagagaaatgtactgaaaaagtctacgcaatgtctgggatttgctaaacaatacctggaaagcagacaggtctttttgccattcctccaggacatccaccataaggaaaggagaccctggaccaacattctctaagatgtttatatggaccagtggccggacctcttcatcttatagacatgatgaaaaaagaaatatttaccagaaaatcagggaccatgacctcctggacaaaaggaaaacagtcacagcactgaaggcaggagaggaccgagctattctcctgggactggctatgatggtgtgctccatcatgatgtattttctgctgggaatcacactcctgcgctcatacatgcagagcgtgtggaccgaagagtctcaatgcaccttgctgaatgcgtccatcacggaaacatttaattgctccttcagctgtggtccagactgctggaaactttctcagtacccctgcctccaggtgtacgttaacctgacttcttccggggaaaagctcctcctctaccacacagaagagacaataaaaatcaatcagaagtgctcctatatacctaaatgtggaaaaaattttgaagaatccatgtccctggtgaatgttgtcatggaaaacttcaggaagtatcaacacttctcctgctattctgacccagaaggaaaccagaagagtgttatcctaacaaaactctacagttccaacgtgctgttccattcactcttctggccaacctgtatgatggctgggggtgtggcaattgttgccatggtgaaacttacacagtacctctccctactatgtgagaggatccaacggatcaatagataaatgcaaaaatggataaaataatttttgttaaagctcaaatactgttttctttcattcttcaccaaagaaccttaagtttgtaacgtgcagtctgttatgagttccctaatatattcttatatgtagagcaataatgcaaaagctgttctatatgcaaacatgatgtctttattattcaggagaataaataactgttttgtgttggttggtggttttcataatcttatttctgtactggaactagtactttcttctctcattccgccaaaacagggctcagttattcatttgccaagcttcgtggaggaatgtaggtgacatcaatgtgataaagtctgtgttctgagttgtcagatctcttgaagacaatatttttcatcacttattgtttactaaagctacagccaaaaatatttttttttcttattctaaactgagccctatagcaagtgaagggaccagatttcctaattaaaggaagttaggtacttttcttgtattttttaccatatcactgtaaagaagaggggaaacccagccagctactttttttcatcactttttattcataacttcagatttgtaaaactaatttccaaaatataagctgttttcattagccagttctataatatcttcctgtgatttatgtagaaaatgaacacaccccttttccatttaagaccctgctactgtgtgaagagatgatacttacaaggagtgtcattacctgtgagctgactgaatgttggtaggtgctccattacaatccaggaaagtctgtgttactgatatttgtgtggaaatctttatttcacttcaatttaaccattagatggtaaaattaagatgctacttgttggtaaaaattggtggactggtttcaatgggtaaatgtgttgtggcaaattaatgtgttggaatattgctctttgtgaatttgtgcttaagtcaatgaatgtgtagtatctccttctgacaagcattccctattgggattttaaagctatgtgcacagaatattagtctcttctacatgttttatttttctatttataattcccttttttgttgttatattttatacacagaatagatcttttttctaacacatatttgaactgaataacagacttaaagaaagcctttgttcacattgctatttacttttgtgtttgggggaaaatacgagggattgattttaaataaaaaacattccatctttcatttaatatcaatatcaaaagaagaagacaaacatctatctttctcatctatatttaagtacctttttgtaatgtagtatcaaagttttttaggtaatgcaaaattttacaaatcatttgtggaatgaatggtaaaactaatctgatgaaatggaaaattattctgcaatattgtaattcatagtttgacttttcataagcaaataaatccctaggatgtaatcaggacttcaaatgtgtaattaaatttttttaaaaaaaatcta

SEQ ID NO: 58810 - DNA, 2543 bp, Homo sapiens
agtatgaagcagctttaacggagctccagataactaatttcaagcatggctgtctagcgtgcctgtcactcctattgtccttccaaactctttcagacattttgagcagggagtattaaagctatgagttagaaagggttgtgacattaatggtccacaaaggctttaggcacaagaggtaatgatgattaccggtggctatttggaggactgcaccggatcgctgtcattaaaaattaagcgtggcttttgaggaagatgtgacaactaccggaggtctttttgccattcctccaggacatccaccataaggaaaggagaccctggaccaacattctctaagatgtttatatggaccagtggccggacctcttcatcttatagacatgatgaaaaaagaaatatttaccagaaaatcagggaccatgacctcctggacaaaaggaaaacagtcacagcactgaaggcaggagaggaccgagctattctcctgggactggctatgatggtgtgctccatcatgatgtattttctgctgggaatcacactcctgcgctcatacatgcagagcgtgtggaccgaagagtctcaatgcaccttgctgaatgcgtccatcacggaaacatttaattgctccttcagctgtggtccagactgctggaaactttctcagtacccctgcctccaggtgtacgttaacctgacttcttccggggaaaagctcctcctctaccacacagaagagacaataaaaatcaatcagaagtgctcctatatacctaaatgtggaaaaaattttgaagaatccatgtccctggtgaatgttgtcatggaaaacttcaggaagtatcaacacttctcctgctattctgacccagaaggaaaccagaagagtgttatcctaacaaaactctacagttccaacgtgctgttccattcactcttctggccaacctgtatgatggctgggggtgtggcaattgttgccatggtgaaacttacacagtacctctccctactatgtgagaggatccaacggatcaatagataaatgcaaaaatggataaaataatttttgttaaagctcaaatactgttttctttcattcttcaccaaagaaccttaagtttgtaacgtgcagtctgttatgagttccctaatatattcttatatgtagagcaataatgcaaaagctgttctatatgcaaacatgatgtctttattattcaggagaataaataactgttttgtgttggttggtggttttcataatcttatttctgtactggaactagtactttcttctctcattccgccaaaacagggctcagttattcatttgccaagcttcgtggaggaatgtaggtgacatcaatgtgataaagtctgtgttctgagttgtcagatctcttgaagacaatatttttcatcacttattgtttactaaagctacagccaaaaatatttttttttcttattctaaactgagccctatagcaagtgaagggaccagatttcctaattaaaggaagttaggtacttttcttgtattttttaccatatcactgtaaagaagaggggaaacccagccagctactttttttcatcactttttattcataacttcagatttgtaaaactaatttccaaaatataagctgttttcattagccagttctataatatcttcctgtgatttatgtagaaaatgaacacaccccttttccatttaagaccctgctactgtgtgaagagatgatacttacaaggagtgtcattacctgtgagctgactgaatgttggtaggtgctccattacaatccaggaaagtctgtgttactgatatttgtgtggaaatctttatttcacttcaatttaaccattagatggtaaaattaagatgctacttgttggtaaaaattggtggactggtttcaatgggtaaatgtgttgtggcaaattaatgtgttggaatattgctctttgtgaatttgtgcttaagtcaatgaatgtgtagtatctccttctgacaagcattccctattgggattttaaagctatgtgcacagaatattagtctcttctacatgttttatttttctatttataattcccttttttgttgttatattttatacacagaatagatcttttttctaacacatatttgaactgaataacagacttaaagaaagcctttgttcacattgctatttacttttgtgtttgggggaaaatacgagggattgattttaaataaaaaacattccatctttcatttaatatcaatatcaaaagaagaagacaaacatctatctttctcatctatatttaagtacctttttgtaatgtagtatcaaagttttttaggtaatgcaaaattttacaaatcatttgtggaatgaatggtaaaactaatctgatgaaatggaaaattattctgcaatattgtaattcatagtttgacttttcataagcaaataaatccctaggatgtaatcaggacttcaaatgtgtaattaaatttttttaaaaaaaatcta

SEQ ID NO: 58811 - DNA, 2979 bp, Homo sapiens
ccgcggaactggcaggcgtttcagagcgtcagaggctgcggatgagcagacttggaggactccaggccagagactaggctgggcgaagagtcgagcgtgaagggggctccgggccagggtgacaggaggcgtgcttgagaggaagaagttgacgggaaggccagtgcgacggcaaatctcgtgaaccttgggggacgaatgctcaggatgcgggtccccgccctcctcgtcctcctcttctgcttcagagggagagcaggcccgtcgccccatttcctgcaacagccagaggacctggtggtgctgctgggggaggaagcccggctgccgtgtgctctgggcgcctactgggggctagttcagtggactaagagtgggctggccctagggggccaaagggacctaccagggtggtcccggtactggatatcagggaatgcagccaatggccagcatgacctccacattaggcccgtggagctagaggatgaagcatcatatgaatgtcaggctacacaagcaggcctccgctccagaccagcccaactgcacgtgctggtccccccagaagccccccaggtgctgggcggcccctctgtgtctctggttgctggagttcctgcgaacctgacatgtcggagccgtggggatgcccgccctacccctgaattgctgtggttccgagatggggtcctgttggatggagccaccttccatcagaccctgctgaaggaagggacccctgggtcagtggagagcaccttaaccctgacccctttcagccatgatgatggagccacctttgtctgccgggcccggagccaggccctgcccacaggaagagacacagctatcacactgagcctgcagtaccccccagaggtgactctgtctgcttcgccacacactgtgcaggagggagagaaggtcattttcctgtgccaggccacagcccagcctcctgtcacaggctacaggtgggcaaaagggggctctccggtgctcggggcccgcgggccaaggttagaggtcgtggcagacgcctcgttcctgactgagcccgtgtcctgcgaggtcagcaacgccgtgggtagcgccaaccgcagtactgcgctggatgtgctgtttgggccgattctgcaggcaaagccggagcccgtgtccgtggacgtgggggaagacgcttccttcagctgcgcctggcgcgggaacccgcttccacgggtaacctggacccgccgcggtggcgcgcaggtgctgggctctggagccacactgcgtcttccgtcggtggggcccgaggacgcaggcgactatgtgtgcagagctgaggctgggctatcgggcctgcggggcggcgccgcggaggctcggctgactgtgaacgctcccccagtagtgaccgccctgcactctgcgcctgccttcctgaggggccctgctcgcctccagtgtctggttttcgcctctcccgccccagatgccgtggtctggtcttgggatgagggcttcctggaggcggggtcgcagggccggttcctggtggagacattccctgccccagagagccgcgggggactgggtccgggcctgatctctgtgctacacatttcggggacccaggagtctgactttagcaggagctttaactgcagtgcccggaaccggctgggcgagggaggtgcccaggccagcctgggccgtagagacttgctgcccactgtgcggatagtggccggagtggccgctgccaccacaactctccttatggtcatcactggggtggccctctgctgctggcgccacagcaaggcctcagcctctttctccgagcaaaagaacctgatgcgaatccctggcagcagcgacggctccagttcacgaggtcctgaagaagaggagacaggcagccgcgaggaccggggccccattgtgcacactgaccacagtgatctggttctggaggaggaagggactctggagaccaaggacccaaccaacggttactacaaggtccgaggagtcagtgtgagcctgagccttggcgaagcccctggaggaggtctcttcctgccaccaccctccccccttgggcccccagggacccctaccttctatgacttcaacccacacctgggcatggtccccccctgcagactttacagagccagggcaggctatctcaccacaccccaccctcgagctttcaccagctacatcaaacccacatcctttgggcccccagatctggcccccgggactccccccttcccatatgctgccttccccacacctagccacccgcgtctccagactcacgtgtgacatctttccaatggaagagtcctgggatctccaacttgccataatggattgttctgatttctgaggagccaggacaagttggcgaccttactcctccaaaactgaacacaaggggagggaaagatcattacatttgtcaggagcatttgtatacagtcagctcagccaaaggagatgccccaagtgggagcaacatggccacccaatatgcccacctattccccggtgtaaaagagattcaagatggcaggtaggccctttgaggagagatggggacagggcagtgggtgttgggagtttggggccgggatggaagttgtttctagccactgaaagaagatatttcaagatgaccatctgcattgagaggaaaggtagcataggatagatgaagatgaagagcataccaggccccaccctggctctccctgaggggaactttgctcggccaatggaaatgcagccaagatggccatatactccctaggaacccaagatggccaccatcttgattttactttccttaaagactcagaaagacttggacccaaggagtggggatacagtgagaattaccactgttggggcaaaatattgggataaaaatatttatgtttaataataaaaaaaagtcaaagaggcaaaaaaaaaaaa

SEQ ID NO: 58812 - DNA, 874 bp, Homo sapiens
agttcctccacctgctggcccctggacacctctgtcaccatgtggttcctggttctgtgcctcgccctgtccctgggggggactggtgctgcgcccccgattcagtcccggattgtgggaggctgggagtgtgagcagcattcccagccctggcaggcggctctgtaccatttcagcactttccagtgtgggggcatcctggtgcaccgccagtgggtgctcacagctgctcattgcatcagcgacaattaccagctctggctgggtcgccacaacttgtttgacgacgaaaacacagcccagtttgttcatgtcagtgagagcttcccacaccctggcttcaacatgagcctcctggagaaccacacccgccaagcagacgaggactacagccacgacctcatgctgctccgcctgacagagcctgctgataccatcacagatgctgtgaaggtcgtggagttgcccaccgaggaacccgaagtggggagcacctgtttggcttccggctggggcagcatcgaaccagagaatttctcatttccagatgatctccagtgtgtggacctcaaaatcctgcctaatgatgagtgcaaaaaagcccacgtccagaaggtgacagacttcatgctgtgtgtcggacacctggaaggtggcaaagacacctgtgtgggtgattcagggggcccgctgatgtgtgatggtgtgctccaaggtgtcacatcatggggctacgtcccttgtggcacccccaataagccttctgtcgccgtcagagtgctgtcttatgtgaagtggatcgaggacaccatagcggagaactcctgaacgcccagccctgtcccctacccccagtaaaatcaaatgtgcatcc

SEQ ID NO: 58813 - DNA, 584 bp, Homo sapiens
cttccagtgcccccggcgcggcgagggggcagcgctccagtattgctgcggcttcgccgacctcaagtactgctgcagcgagccgggcagctacttcccctacaagcacagctacatgtggagcctcaggtcaaacttgtcagtgtcctaatcccagagaaagagcagaagcctaaaggcaagccaggaagataatgaagaaaaagatcattacttttcaatgaccattggtgccttgattggactaggaattgctgcccttgttttactcgcctttgtcatcagtgtctgtgtcctttgctatttatttctgtatacgaaacctcaaagattagacactggccttaagcttcaacacttagaggcttcttccactcaagaaggcaagtcaaatggaaaaaccaaagccctcaattcaaatgcagcatcaaatgcaacaaatgaaacatactatgaagctgatgatataattcaagaaaaaacaatggatgcaacacaaatccacattgcttattaactaaaaattctgtgttttaaatgcttactggagagatgggacaataaaaataaagcgtgcacttgaa

SEQ ID NO: 58814 - DNA, 2614 bp, Homo sapiens
agctaaggtctccaggctgctgatgaagtgagggaaagtggaggagagtcggcgccgagatgggcggataaaaggagcgaccgctcagcagcgagagggagaggcgagagtaaggcgcccagacaccatgtggacaaggggaggagagaaatcagaggtggcgcgcgaaggctgagcgcccaggcagccagagcccagatcggaagagccgagtccgggcagaggggtccgcgggctctggaggtgctggacgggtgcgatccgagagcagaccggggccctcgcgagcctctcccggcccctgcccgcgatgagcgaggccagccgactgtgctccggctactacagcctcaaccagagcttcgtggagcccttccagtgcccccggcgcggcgagggggcagcgctccagtattgctgcggcttcgccgacctcaagtactgctgcagcgagccgggcagctacttcccctacaagcacagctacatgtggagcctcagcattggtgccttgattggactaggaattgctgcccttgttttactcgcctttgtcatcagtgtctgtgtcctttgctatttatttctgtatacgaaacctcaaagattagacactggccttaagcttcaacacttagaggcttcttccactcaagaaggcaagtcaaatggaaaaaccaaagccctcaattcaaatgcagcatcaaatgcaacaaatgaaacatactatgaagctgatgatataattcaagaaaaaacaatggatgcaacacaaatccacattgcttattaactaaaaattctgtgttttaaatgcttactggagagatgggacaataaaaataaagcgtgcacttgaaacggtttgtaatattgcttttcaaaaattcgtcactcacaaagcaagacacagctgcatttttgatcattcagttactttattaaacgcacattaaggttttattggttttcctttgtataaatttatttgctaattaagatgtttctgtatcacatgagattatgctaattattcaggagaaattaaataatttatcaataacaagataagcagtcctatctcagtgaagaacagtgagaagtttatgtcacattaccagcatttctcaactttctgatacttacaggcagttattcttatgagatggtactggataggtaaatatcaagggaactgtcttaaaaactagaggtgacttgttcttaaatctcttagaagtcaacccacatctttttagatttttctgggcacaaacaatatactcagtaacaaaaaaatcacaatgtataatctgtacaataaatattttgtttcaagagataagcataacaaaaaatcctttgctgatatatttcctaaataatctgtataatgaaagctacaaaacaaatgagttctctggtcccacctaatgctatcacattaataccacctagaaatctagaaataaaactaatttctgcaaattataatttttaaagatttttattcataagtgtgttttctattataacacagacctggttttgtaacagaattcaacagaaaaaaaaagggaattattttaagcagctctactgagcatatctactatgtcctgtagtttttgtagtcagaaactagcatttcagacaagatctggcacatttagggtggtatggccatagccaaaaactagcatttcaaaatgtgctgaatacagcttctctggtctgatatataaaaaagaataccttatttttcttgggcatgcaaagctcagggttacaaacttttcgtcattagcctgtcaaaatttctaccaagtactaaggttatcttctagaccagaattaagagaagtttctgtgatgatggaaatgttctttctatatctgcactaatatggtagccaccagtcacatgtggctactgaacacttaagatgtggctaatgcaactgaaaaaataaaatttttcatttatttaattaatttaaataaccctatgtggctatactggcaccatagtgccagatcactattgcaacaacctactgccaaagttgaacttcacattcaaaaatacaattttgcaaaggtttaaatactaaaattgcttaaagtatatgttaagtttgaaaattaagacatttccattataaaaatgacattttacacggccataaaaacaaagaattttcacttattttttgtgaaagtttataaagcttttatgggtgcttcttgatctttgatacaactttgattttaaagtatcccagaaaatttgctatctttacagtaatttaataatattaccatattgtctcaggtgaaaatctaggttgagaaaaatttagttaaggcactggcaccattctacttttgttgctcatggccaaggactataaatggcacaagaagcaagaaacagacagagctagcaaaatgctcactgccccaactcctcccaatttgtgggaaaggcatagtggggtcaggcatgactggatgcatcatgggttgtgctatagaagaggcaccccaattctctgccactctacctatttttagaggagttgggaggagatactgagatcagaagactggc

SEQ ID NO: 58815 - DNA, 552 bp, Homo sapiens
aagaacaagtctcattttgatacattttatgtttgaccagaagggctccgcagttcaattgcttagtttccagaactaaaaaccctggatgttatgtataaaataaactcgagaagactttgaaggatggaaaaaaaggatgcagaactattggaaccttacaacgagaggaacagcataatgatttcaactgacaagttttctgcaagaaagatgcttctctggtatctgctgagatcatttgaaatcatggtagaacgcccagaattatgggctcttcttgaaattggatatcatcaaacgaggcactaattacagaacaattaacaaaagcctaaaagggtgtaatggagaatttctaatgaatcctgacttatcatggctgaaagaagacttgaagttggattaatgtagaaacactggaattctactgaaggagctggtgcttgatttgatagaaaaaaagaattattacactgttctattccctttttcagtttgtaaaactcctcagacaattgttttctaagaaaggattaaactcctatatga

SEQ ID NO: 58816 - DNA, 2614 bp, Homo sapiens
agctaaggtctccaggctgctgatgaagtgagggaaagtggaggagagtcggcgccgagatgggcggataaaaggagcgaccgctcagcagcgagagggagaggcgagagtaaggcgcccagacaccatgtggacaaggggaggagagaaatcagaggtggcgcgcgaaggctgagcgcccaggcagccagagcccagatcggaagagcccagtccgggcagaggggtccgcgggctctggaggtgctggacgggtgcgatccgagagcagaccggggccctcgcgagcctctcccggcccctgcccgcgatgagcgaggccagccgactgtgctccggctactacagcctcaaccagagcttcgtggagcccttccagtgcccccggcgcggcgagggggcagcgctccagtattgctgcggcttcgccgacctcaagtactgctgcagcgagccgggcagctacttcccctacaagcacagctacatgtggagcctcagcattggtgccttgattggactaggaattgctgcccttgttttactcgcctttgtcatcagtgtctgtgtcctttgctatttatttctgtatacgaaacctcaaagattagacactggccttaagcttcaacacttagagccttcttccactcaagaaggcaagtcaaatggaaaaaccaaagccctcaattcaaatgcagcatcaaatgcaacaaatgaaacatactatgaagctgatgatataattcaagaaaaaacaatggatgcaacacaaatccacattgcttattaactaaaaattctgtgttttaaatgcttactggagagatgggacaataaaaataaagcgtgcacttgaaacggtttgtaatattgcttttcaaaaattcgtcactcacaaagcaagacacagctgcatttttgatcattcagttactttattaaacgcacattaaggttttattggttttcctttgtataaatttatttgctaattaagatgtttctgtatcacatgagattatgctaattattcaggagaaattaaataatttatcaataacaagataagcagtcctatctcagtgaagaacagtgagaagtttatgtcacattaccagcatttctcaactttctgatacttacaggcagttattcttatgagatggtactggataggtaaatatcaagggaactgtcttaaaaactagaggtgacttgttcttaaatctcttagaagtcaacccacatctttttagatttttctgggcacaaacaatatactcagtaacaaaaaaatcacaatgtataatctgtacaataaatattttgtttcaagagataagcataacaaaaaatcctttgctgatatatttcctaaataatctgtataatgaaagctacaaaacaaatgagttctctggtcccacctaatgctatcacattaataccacctagaaatctagaaataaaactaatttctgcaaattataatttttaaagatttttattcataagtgtgttttctattataacacagacctggttttgtaacagaattcaacagaaaaaaaaagggaattattttaagcagctctactgagcatatctactatgtcctgtagtttttgtagtcagaaactagcatttcagacaagatctggcacatttagggtggtatggccatagccaaaaactagcatttcaaaatgtgctgaatacagcttctctggtctgatatataaaaaagaataccttatttttcttgggcatgcaaagctcagggttacaaacttttcgtcattagcctgtcaaaatttctaccaagtactaaggttatcttctagaccagaattaagagaagtttctgtgatgatggaaatgttctttctatatctgcactaatatggtagccaccagtcacatgtggctactgaacacttaagatgtggctaatgcaactgaaaaaataaaatttttcatttatttaattaatttaaataaccctatgtggctatactggcaccatagtgccagatcactattgcaacaacctactgccaaagttgaacttcacattcaaaaatacaattttgcaaaggtttaaatactaaaattgcttaaagtatatgttaagtttgaaaattaagacatttccattataaaaatgacattttacacggccataaaaacaaagaattttcacttattttttgtgaaagtttataaagcttttatgggtgcttcttgatctttgatacaactttgattttaaagtatcccagaaaatttgctatctttacagtaatttaataatattaccatattgtctcaggtgaaaatctaggttgagaaaaatttagttaaggcactggcaccattctacttttgttgctcatggccaaggactataaatggcacaagaagcaagaaacagacagagctagcaaaatgctcactgccccaactcctcccaatttgtgggaaaggcatagtggggtcaggcatgactggatgcatcatgggttgtgctatagaagaggcaccccaattctctgccactctacctatttttagaggagttgggaggagatactgagatcagaagactggc

SEQ ID NO: 58817 - DNA, 584 bp, Homo sapiens
cttccagtgcccccggcgcggcgagggggcagcgctccagtattgctgcggcttcgccgacctcaagtactgctgcagcgagccgggcagctacttcccctacaagcacagctacatgtggagcctcaggtcaaacttgtcagtgtcctaatcccagagaaagagcagaagcctaaaggcaagccaggaagataatgaagaaaaagatcattacttttcaatgaccattggtgccttgattggactaggaattgctgcccttgttttactcgcctttgtcatcagtgtctgtgtcctttgctatttatttctgtatacgaaacctcaaagattagacactggccttaagcttcaacacttagagccttcttccactcaagaaggcaagtcaaatggaaaaaccaaagccctcaattcaaatgcagcatcaaatgcaacaaatgaaacatactatgaagctgatgatataattcaagaaaaaacaatggatgcaacacaaatccacattgcttattaactaaaaattctgtgttttaaatgcttactggagagatgggacaataaaaataaagcgtgcacttgaa

SEQ ID NO: 58818 - DNA, 3400 bp, Homo sapiens
tcgcgccaaacttgaccgcgcgttctgctgtaacgagcgggctcggaggtcctcccgctgctgtcatggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattaatatgaaggtgttttctagtttaagttgttccccctccctctgaaaaaaataccatttatgagacattcttgctataactaagtgcttctccaagaccccaactgagtccccagcacctgctatagtgagctgccattccacacccatcacatgtggcactcttgccagtccttgacattgtcgggcttttcacatgttggtaatatttattaaagatgaagatccacatacccttcaactgagcagtttcactagtggaaataccaaaagattcctacgtgtatatccagaggtttgtagataaatgttgccaccttgtttgtaacagtggaaaattgaaaacaacctggaagtccagtgatgggaaaatgagtatgtttctgtcttagattggggaacccaaagcagattgcaagactgaaatttcagtgaaagcagtgtatttgctaggtcataccagaaatcatcaattgaggtacggagaaactgaactgagaaggtaagaaaagcaatttaaagtcagcgagcaggttctcattgataacaagctccatactgctgagatacagggaaatggaggggggaaagctggagtattgatcccgcccccctccttggttgtcagctccctgtcctgtgtgtgggcggaacatagtccagctgctctatagcaagtctcaggtgtttgcagtaagaagctgctggcatgcacgggaacagtgaatgccaaacacttaaagcaattcgatgtttaagtatgtaagttcttttttttttagacagcgtttcgctcttgttgcccaggctagcatgcaatggtgtgacctcggcttactgcaacctccgccttcccagattcaagcgattctcctgcctcaggctcccaagtagctgggaccgggtgcgcgccaccacgcccggctaatttttgtattttgtatttttggtagagatggggtttcgccatgttggtcaggctagtctcgaactcgtgaccgcaagcgattcacccacctcagcctcccaaagtgctgggattaccggcttgagccaccacacccggcacatcttcattctttttatgtagtaaaaagtataaggccacacatggtttatttgaagtattttacaatttaaaaaaatacagaagcaggaaaaccaattataagttcaagtgagggatgatggttgcttgaaccaaagggttgcatgtagtaagaaattgtgatttaagatatattttaaagttataagtagcaggatattctgatggagtttgactttggttttgggcccacggagtttcagatgcctttgagaaatgaatgaagtagagagaaaataaaagaaaaactagccaggcacagtggctcacgcctgtaatcccagcgctttgggaggctaaggcaggcagatcacttgagaccagcttgggcaacatggcgaagccccatctctacaaaaaacacagaaattagctgggcattgtggcgcacacctgtattcccatctactcaggaagctgagatggaagaattaattgagcccacgagttcaaggctgcagtgagtcgtgattgtgccactgcactccagccggggtgacagaagagaccttgtctcgaaaaggaatctgaaaacaatggaaccatgccttcataattctagaaagttattttcaactgataaatctatattcacccaaataatcaagggtgaaggtaaaataatacatttttagacaagcaaagactcaggggttacctccatgtgccctttttagggaagctgttggagaaaatactccagcaaaatgaaggagtacacaaaccagagaatgacatgaatccagcaaataggatccaacacaggcaatattccagctatggagctagctttaaaaaggaacagtaaaaatattaatcggttagctgggtggaatggcccatgcctgtagtcccagctactcgggaggctcagcagcaggacgacttgagcccaagagttccagaccagcctggccaccttagtgagatcccttctcttaaaaataataacttattgccagatttggggcatttggaaagaagttcattgaagataaagcaaaagtaaaaaaaaaaaaaaaaaaaaaacaaggggaaagggttggttaggcaatcattctagggcagaaagaagtacaggataggaagagcataatacactgtttttctcaacaaggagcagtatgtacacagtcataatgatgtgactgcttagcccctaaatatggtaactactctgggacaatatgggaggaaaagtgaagattgtgatggtgtaagagctaaatcctcatctgtcatatccagaaatcactatataatacataataatgaaatgactaagttatgtgaggaaaaaaacagaagacattgctaaaagagttaaaagtcattgctctggagaattaggagggatggggcaggggactgttaggatgcattataaactgaaaagcctttttaaaattttatgtattaatatatgcattcacttgaaaaactaaaaaaaaacaataatttggaaaaacccatgaaggtaactaacggaaggaaaaactaagagaatgaaaagtatttgcctctggaaagaacaactggcaggactgttgttttcattgtaagacttttggagccatttaattgtacttaaccattttcatctatttctttaataagaacaattccatcttaataaagagttacacttgttaataaaaaaaaaaaa

SEQ ID NO: 58819 - DNA, 3500 bp, Homo sapiens
tcgcgccaaacttgaccgcgcgttctgctgtaacgagcgggctcggaggtcctcccgctgctgtcatggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattaatatgaaggtgttttctagtttaagttgttccccctccctctgaaaaaagtatgtatttttacattagaaaaggttttttgttgactttagatctataattatttctaagcaactagtttttattccccactactcttgtctctatcagataccatttatgagacattcttgctataactaagtgcttctccaagaccccaactgagtccccagcacctgctatagtgagctgccattccacacccatcacatgtggcactcttgccagtccttgacattgtcgggcttttcacatgttggtaatatttattaaagatgaagatccacatacccttcaactgagcagtttcactagtggaaataccaaaagattcctacgtgtatatccagaggtttgtagataaatgttgccaccttgtttgtaacagtggaaaattgaaaacaacctggaagtccagtgatgggaaaatgagtatgtttctgtcttagattggggaacccaaagcagattgcaagactgaaatttcagtgaaagcagtgtatttgctaggtcataccagaaatcatcaattgaggtacggagaaactgaactgagaaggtaagaaaagcaatttaaagtcagcgagcaggttctcattgataacaagctccatactgctgagatacagggaaatggaggggggaaagctggagtattgatcccgcccccctccttggttgtcagctccctgtcctgtgtgtgggcggaacatagtccagctgctctatagcaagtctcaggtgtttgcagtaagaagctgctggcatgcacgggaacagtgaatgccaaacacttaaagcaattcgatgtttaagtatgtaagttcttttttttttagacagcgtttcgctcttgttgcccaggctagcatgcaatggtgtgacctcggcttactgcaacctccgccttcccagattcaagcgattctcctgcctcaggctcccaagtagctgggaccgggtgcgcgccaccacgcccggctaatttttgtattttgtatttttggtagagatggggtttcgccatgttggtcaggctagtctcgaactcgtgaccgcaagcgattcacccacctcagcctcccaaagtgctgggattaccggcttgagccaccacacccggcacatcttcattctttttatgtagtaaaaagtataaggccacacatggtttatttgaagtattttacaatttaaaaaaatacagaagcaggaaaaccaattataagttcaagtgagggatgatggttgcttgaaccaaagggttgcatgtagtaagaaattgtgatttaagatatattttaaagttataagtagcaggatattctgatggagtttgactttggttttgggcccacggagtttcagatgcctttgagaaatgaatgaagtagagagaaaataaaagaaaaactagccaggcacagtggctcacgcctgtaatcccagcgctttgggaggctaaggcaggcagatcacttgagaccagcttgggcaacatggcgaagccccatctctacaaaaaacacagaaattagctgggcattgtggcgcacacctgtattcccatctactcaggaagctgagatggaagaattaattgagcccacgagttcaaggctgcagtgagtcgtgattgtgccactgcactccagccggggtgacagaagagaccttgtctcgaaaaggaatctgaaaacaatggaaccatgccttcataattctagaaagttattttcaactgataaatctatattcacccaaataatcaagggtgaaggtaaaataatacatttttagacaagcaaagactcaggggttacctccatgtgccctttttagggaagctgttggagaaaatactccagcaaaatgaaggagtacacaaaccagagaatgacatgaatccagcaaataggatccaacacaggcaatattccagctatggagctagctttaaaaaggaacagtaaaaatattaatcggttagctgggtggaatggcccatgcctgtagtcccagctactcgggaggctcagcagcaggacgacttgagcccaagagttccagaccagcctggccaccttagtgagatcccttctcttaaaaataataacttattgccagatttggggcatttggaaagaagttcattgaagataaagcaaaagtaaaaaaaaaaaaaaaaaaaaaacaaggggaaagggttggttaggcaatcattctagggcagaaagaagtacaggataggaagagcataatacactgtttttctcaacaaggagcagtatgtacacagtcataatgatgtgactgcttagcccctaaatatggtaactactctgggacaatatgggaggaaaagtgaagattgtgatggtgtaagagctaaatcctcatctgtcatatccagaaatcactatataatacataataatgaaatgactaagttatgtgaggaaaaaaacagaagacattgctaaaagagttaaaagtcattgctctggagaattaggagggatggggcaggggactgttaggatgcattataaactgaaaagcctttttaaaattttatgtattaatatatgcattcacttgaaaaactaaaaaaaaacaataatttggaaaaacccatgaaggtaactaacggaaggaaaaactaagagaatgaaaagtatttgcctctggaaagaacaactggcaggactgttgttttcattgtaagacttttggagccatttaattgtacttaaccattttcatctatttctttaataagaacaattccatcttaataaagagttacacttgttaataaaaaaaaaaaa

SEQ ID NO: 58820 - DNA, 686 bp, Homo sapiens
ttcttaaatctaaaaagagcctctcacctgaggccttcacctgagagctggagcctgtgcgatggattatctggacagggaccccaatgaacagggctctgctggagtgaggaagctgactgagggaagaaccagaaggctgccaaaatacaattgtgtgcctttaaaggaaataacaacaagaattaggagcgccctggaggcaaggtctgctgctggggaaaccaaaccacagtaacttcagaaatatatacttggaatatgtcatgtattaatgggtaaagacaccgtggatatgaaggaaatcacctatgggagaatattaagaagagaagaaggggctgctggctgtagtgaaatgtataaaaaggagagtgtgatcctagtttctgtctctaactatgagttacttgtgattaacttcaaatattctctccataagaagaggcccagaagaagaagatgagcttcagttattctagcacaactgctgtgatatttgtaaatattcaaaacctataataaaatgtataaaaggaaactccatttgaaatgatttgaaatctcacatggaaatctattttttttaaatcagagcttagtaagagaaaataacagaacattgtaataattgaattacaaaaacaactgaattttggaaaatttattttctctcatgtgatgtg

SEQ ID NO: 58821 - DNA, 552 bp, Homo sapiens; identical to SEQ ID NO: 58815

SEQ ID NO: 58822 - DNA, 1078 bp, Homo sapiens
atggctttcctctggctcctctcctgctgggccctcctgggtaccaccttcggctgcggggtccccgccatccaccctgtgctcagcggcctgtccaggatcgtgaatggggaggacgccgtccccggctcctggccctggcaggtgtccctgcaggacaaaaccggcttccacttctgcgggggctccctcatcagcgaggactgggtggtcaccgctgcccactgcggggtcaggacctccgacgtggtcgtggccaacaagacccctgacaagctgcagcaggcagccctgcccctcctgtccaatgccgaatgcaagaagtcctggggcaggaggatcaccgacgtgatgatctgtgccggggccagtggcgtctcctcctgcatgggcgactctggcggccccctggtctgccaaaaggatggagcctggaccctggtgggcattgtgtcctggggcagcgacacctgctccacctccagccctggcgtgtacgcccgtgtcaccaagctcataccttgggtgcagaagatcctggctgccaactgagcccgcggctccctccgaccctgctccccacagagcctcagtaaacccatggaacacacgtcggcgctgtccgtcttctgttttggggcctccaaggcctcactccactccggaacctgggcccccactgggctggactgggctgggctaggcatgggcggcctctgggaggacccttccttagtcccctctcccaccactcaggctcctgcttcccagagagtggccaggaacacacgggcagatgaaaaggggtgcagagacagacgggggatctggctggtggggaccgggtggaccttggcccccatcctcagcacctgcccccaggcgacaggttcttgccacccacccttgctctcttgctctgggccctgcaggagggcgtgggcagcgtgggggctgtggggggatgagctcactctggccccacagacctgtggctccaaggaatcttcccacggccactcctagtggctgccagacatacgctggagccaggagcgttatcaacgcaaggactggt

SEQ ID NO: 58823 - DNA, 1006 bp, Homo sapiens
aatatcagcactggattgtagaatgtgttgctgattttgaccttgtattcaagttaactgttgcccttggtatctgtacatatctttgatttcagtctttactacacgtggcttggtcacttcatggctaaaaacatgcttgtggaagaccagtctggctcggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctccgaagggatttggaggggttcaggtctctccaccaaatgaaaatgttgcaatttacaaccctttcagaccttggtgggaaagataccaaccagttagctataaattatgcacaagatctggaaatgaagatgaatttagaaacatggtgactagatgtaacaatgttggggttcgtatttatgtggatgctgtaattaatcatatgtgtggtaacgctgtgagtgcaggaacaagcagtacctgtggaagttacttcaaccctggaagtagggactttccagcagtcccatattctggatgggatttcaatgatggtaaatgtaaaactggaagtggagatatcgagaactacaatgatgctactcaggtcagagattgtcgtctgactggtcttcttgatcttgcactggagaaggattacgtgcgttctaagattgccgaatatatgaaccatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtacatcaatacttatatgcctataaaatatcatcttattcgttagaaaattaa

SEQ ID NO: 58824 - DNA, 686 bp, Homo sapiens; identical to SEQ ID NO: 58820

SEQ ID NO: 58825 - DNA, 552 bp, Homo sapiens
aagaacaagtctcattttgatacattttatgtttgaccagaagggctccgcagttcaattgcttagcttccagaactaaaaaccctggatgttatgtataaaataaactcgagaagactttgaaggatggaaaaaaaggatgcagaactattggaaccttacaacgagaggaacagcataatgatttcaactgacaagttttctgcaagaaagatgcttctctggtatctgctgagatcatttgaaatcatggtagaacgcccagaattatgggctcttcttgaaattggatatcatcaaacgaggcactaattacagaacaattaacaaaagcctaaaagggtgtaatggagaatttctaatgaatcctgacttatcatggctgaaagaagacttgaagttggattaatgtagaaacactggaattctactgaaggagctggtgcttgatttgatagaaaaaaagaattattacactgttctattccctttttcagtttgtaaaactcctcagacaattgttttctaagaaaggattaaactcctatatga

SEQ ID NO: 58826 - DNA, 1101 bp, Homo sapiens
atgattcatagtatcaattgcagaattcactgtgcttgtagtaaacactattctgatcttctacgtgaagcttgggcaacattttacttcacagagatagctgcctataccaagattcaagaatcttttgtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttggacaaactgcataatctaaacagtaactggttcccggaaggtagtaaacctttcatttaccaggaggtaattgatctgggtggtgagccaattaaaagcagtgactactttggtaatggccgggtgacagaattcaagtatggtgcaaaactcggcacagttattcgcaagtggaatggagagaagatgtcttacttaaagaactggggagaaggttggggtttcatgccttctgacagagcgcttgtctttgtggataaccatgacaatcaacgaggacatggcgctggaggagcctctatacttaccttctgggatgctaggctgtacaaaatggcagttggatttatgcttgctcatccttatggatttacacgagtaatgtcaagctaccgttggccaagatattttgaaaatggaaaaggttgtgatttagtaatgcaggttatattaaaggaataa

SEQ ID NO: 58827 - DNA, 1763 bp, Homo sapiens
aaatggctcgtcaccttggataccaatgttttacatcagggattggtcactcctgctgctgtcagcactgtaaacactgctggggggagtcagcccaagtccccaccccccagccaggtctcatagagggaattgttcttcaggctcggaggggcctgcctgtcactgcgcccccgaccctagctcagggactgcagaactcaagataccatcccgtttctcctggctgaggaagggaagggaacatccacatcttctgtactcgtccattctgtgtccccggggcctggagtaaagacaccttcaaatgcagagactcttcagattcagctttcctggaaactgatcttcaatgcactaagagaaggagactctcaaaccaaaaatgacctggaggcaccatgtcaggcttctgtttacggtcagtttggcattacagatcatcaatttgggaaacagctatcaaagagagaaacataacggcggtagagaggaagtcaccaaggttgccactcagaagcaccgacagtcaccgctcaactggacctccagtcatttcggagaggtgactgggagcgccgagggctgggggccggaggagccgctcccatactcctgggctttcggagagggtgcgtccgcgcggccgcgctgctgcaggaacggcggtacctgcgtgctgggcagcttctgcgtgtgcccggcccacttcaccggccgctactgcgagcatgaccagaggcgcagtgaatgcggcgccctggagcacggagcctggaccctccgcgcctgccacctctgcaggtgcatcttcggggccctgcactgcctccccctccagacgcctgaccgctgtgacccgaaagacttcctggcctcccacgctcacgggccgagcgccgggggcgcgcccagcctgctactcttgctgccctgcgcactcctgcaccgcctcctgcgcccggatgcgcccgcgcaccctcggtccctggtcccttccgtcctccagcgggagcggcgcccctgcggaaggccgggacttgggcatcgcctttaattttctatgttgtaaataatagatgtgtttagtttaccgtaagctgaagcactgggtgaatatttttattgggtaataaatattttcatgaaagcgcctttggctccagatccttgggagagggacacgtgtgtccccagcaccactgtgaccggtaggtagagacagcagaacaacagcgagaaggagccaaagctggagccagaaagcctggcaccgccaccttcccctgacagttagcaccttcctttcacaacatctcccttaagggggaagcgtctgctgtggaacccaccgcaaggcaacgcaggcagagttcagcctgaagagcgccaggccagcctcctctgtcttccgagcaccgcttctcaggtcgcttcccaatctgaggaggctgtcgtgtccacaaccagtccagggggatgtgcgccactagctgaggacgccaggcccggcgacaccacaaaggcttggccatgcggaatgtgccctcaagagcacacacttcgggtagaaggcacttgcattgagctcttcagctttttaaatccactgtagttcatgagcctgtgtgacacaattacttttacattttatattgtcaattagtttattggcattttcaatcttttcaactattggctatgaaaatatgaatttaacgtaacattcaaatgagtattaaagaaaaataaagtagaacttc

SEQ ID NO: 58828 - DNA, 1033 bp, Homo sapiens
aaatggctcgtcaccttggataccaatgttttacatcagggattggtcactcctgctgctgtcagcactgtaaacactgctggggggagtcagcccaagtccccaccccccagccaggtctcatagagggaattgttcttcaggctcggaggggcctgcctgtcactgcgcccccgaccctagctcagggactgcagaactcaagataccatcccgtttctcctggctgaggaagggaagggaacatccacatcttctgtactcgtccattctgtgtccccggggcctggagtaaagacaccttcaaatgcagagactcttcagattcagctttcctggaaactgatcttcaatgcactaagagaaggagactctcaaaccaaaaatgacctggaggcaccatgtcaggcttctgtttacggtcagtttggcattacagatcatcaatttgggaaacagctatcaaagagagaaacataacggcggtagagaggaagtcaccaaggttgccactcagaagcaccgacagtcaccgctcaactggacctccagtcatttcggagaggtgactgggagcgccgagggctgggggccggaggagccgctcccatactcctgggctttcggagagggtgcgtccgcgcggccgcgctgctgcaggaacggcggtacctgcgtgctgggcagcttctgcgtgtgcccggcccacttcaccggccgctactgcgagcatgaccagaggcgcagtgaatgcggcgccctggagcacggagcctggaccctccgcgcctgccacctctgcaggtgcatcttcggggccctgcactgcctccccctccagacgcctgaccgctgtggtaagaggccctgtgattcggtccccagctcacccccgcacgcggttgcgccttcattgcggctcaccctccataccgatccacagtgcatcttccagtgccaggccacatagcatttagcaaagtagatcgattcatcattgaagaaagtcgcattcattgggaatcatatagtg

SEQ ID NO: 58829 - DNA, 1538 bp, Homo sapiens
aaatggctcgtcaccttggataccaatgttttacatcagggattggtcactcctgctgctgtcagcactgtaaacactgctggggggagtcagcccaagtccccaccccccagccaggtctcatagagggaattgttcttcaggctcggaggggcctgcctgtcactgcgcccccgaccctagctcagggactgcagaactcaagataccatcccgtttctcctggctgaggaagggaagggaacatccacatcttctgtactcgtccattctgtgtccccggggcctggagtaaagacaccttcaaatgcagagactcttcagattcagctttcctggaaactgatcttcaatgcactaagagaaggagactctcaaaccaaaaatgacctggaggcaccatgtcaggcttctgtttacggtcagtttggcattacagatcatcaatttgggaaacagctatcaaagagagaaacataacggcggtagagaggaagtcaccaaggttgccactcagaagcaccgacagtcaccgctcaactggacctccagtcatttcggagaggtgactgggagcgccgagggctgggggccggaggagccgctcccatactcctgggctttcggagaggacccgaaagacttcctggcctcccacgctcacgggccgagcgccgggggcgcgcccagcctgctactcttgctgccctgcgcactcctgcaccgcctcctgcgcccggatgcgcccgcgcaccctcggtccctggtcccttccgtcctccagcgggagcggcgcccctgcggaaggccgggacttgggcatcgcctttaattttctatgttgtaaataatagatgtgtttagtttaccgtaagctgaagcactgggtgaatatttttattgggtaataaatattttcatgaaagcgcctttggctccagatccttgggagagggacacgtgtgtccccagcaccactgtgaccggtaggtagagacagcagaacaacagcgagaaggagccaaagctggagccagaaagcctggcaccgccaccttcccctgacagttagcaccttcctttcacaacatctcccttaagggggaagcgtctgctgtggaacccaccgcaaggcaacgcaggcagagttcagcctgaagagcgccaggccagcctcctctgtcttccgagcaccgcttctcaggtcgcttcccaatctgaggaggctgtcgtgtccacaaccagtccagggggatgtgcgccactagctgaggacgccaggcccggcgacaccacaaaggcttggccatgcggaatgtgccctcaagagcacacacttcgggtagaaggcacttgcattgagctcttcagctttttaaatccactgtagttcatgagcctgtgtgacacaattacttttacattttatattgtcaattagtttattggcattttcaatcttttcaactattggctatgaaaatatgaatttaacgtaacattcaaatgagtattaaagaaaaataaagtagaacttc

SEQ ID NO: 58830 - DNA, 1648 bp, Homo sapiens
aaatggctcgtcaccttggataccaatgttttacatcagggattggtcactcctgctgctgtcagcactgtaaacactgctggggggagtcagcccaagtccccaccccccagccaggtctcatagagggaattgttcttcaggctcggaggggcctgcctgtcactgcgcccccgaccctagctcagggactgcagaactcaagataccatcccgtttctcctggctgaggaagggaagggaacatccacatcttctgtactcgtccattctgtgtccccggggcctggagtaaagacaccttcaaatgcagagactcttcagattcagctttcctggaaactgatcttcaatgcactaagagaaggagactctcaaaccaaaaatgacctggaggcaccatgtcaggcttctgtttacggtcagtttggcattacagatcatcaatttgggaaacagctatcaaagagagaaacataacggcggtagagaggaagtcaccaaggttgccactcagaagcaccgacagtcaccgctcaactggacctccagtcatttcggagaggtgactgggagcgccgagggctgggggccggaggagccgctcccatactcctgggctttcggagaggtgaatgcggcgccctggagcacggagcctggaccctccgcgcctgccacctctgcaggtgcatcttcggggccctgcactgcctccccctccagacgcctgaccgctgtgacccgaaagacttcctggcctcccacgctcacgggccgagcgccgggggcgcgcccagcctgctactcttgctgccctgcgcactcctgcaccgcctcctgcgcccggatgcgcccgcgcaccctcggtccctggtcccttccgtcctccagcgggagcggcgcccctgcggaaggccgggacttgggcatcgcctttaattttctatgttgtaaataatagatgtgtttagtttaccgtaagctgaagcactgggtgaatatttttattgggtaataaatattttcatgaaagcgcctttggctccagatccttgggagagggacacgtgtgtccccagcaccactgtgaccggtaggtagagacagcagaacaacagcgagaaggagccaaagctggagccagaaagcctggcaccgccaccttcccctgacagttagcaccttcctttcacaacatctcccttaagggggaagcgtctgctgtggaacccaccgcaaggcaacgcaggcagagttcagcctgaagagcgccaggccagcctcctctgtcttccgagcaccgcttctcaggtcgcttcccaatctgaggaggctgtcgtgtccacaaccagtccagggggatgtgcgccactagctgaggacgccaggcccggcgacaccacaaaggcttggccatgcggaatgtgccctcaagagcacacacttcgggtagaaggcacttgcattgagctcttcagctttttaaatccactgtagttcatgagcctgtgtgacacaattacttttacattttatattgtcaattagtttattggcattttcaatcttttcaactattggctatgaaaatatgaatttaacgtaacattcaaatgagtattaaagaaaaataaagtagaacttc

SEQ ID NO: 58831 - DNA, 1062 bp, Homo sapiens
atggccgcggagctggcgatgggcgccgagctgcccagcagcccgctggccatcgagtacgtcaacgacttcgacctgatgaagttcgaggtgaagaaggagcctcccgaggccgagcgcttctgccaccgcctgccgccaggctcgctgtcctcgacgccgctcagcacgccctgctcctccgtgccctcctcgcccagcttctgcgcgcccagcccgggcaccggcggcggcggcggcgcggggggcggcggcggctcgtctcaggccgggggcgcccccgggccgccgagcgggggccccggcgccgtcgggggcacctcggggaagccggcgctggaggatctgtactggatgagcggctaccagcatcacctcaaccccgaggcgctcaacctgacgcccgaggacgcggtggaggcgctcatcggcagcggccaccacggcgcgcaccacggcgcgcaccacccggcggccgccgcagcctacgaggctttccgcggcccgggcttcgcgggcggcggcggagcggacgacatgggcgccggccaccaccacggcgcgcaccacgccgcccaccatcaccacgccgcccaccaccaccaccaccaccaccaccaccatggcggcgcgggacacggcggtggcgcgggccaccacgtgcgcctggaggagcgcttctccgacgaccagctggtgtccatgtcggtgcgcgagctgaaccggcagctccgcggcttcagcaaggaggaggtcatccggctcaagcagaagcggcgcacgctcaagaaccgcggctacgcgcagtcctgccgcttcaagcgggtgcagcagcggcacattctggagagcgagaagtgccaactccagagccaggtggagcagctgaagctggaggtggggcgcctggccaaagagcgggacctgtacaaggagaaatacgagaagctggcgggccggggcggccccgggagcgcgggcggggccggtttcccgcgggagccttcgccgccgcaggccggtcccggcggggccaagggcacggccgacttcttcctgtag

SEQ ID NO: 58832 - DNA, 2339 bp, Homo sapiens
gggcgcctccgggcctctgcggagccctgggcagctctgagctcgcggaggcgtggccggtgcgcggggcccgcggcgcgcggggatgggggtctcggtggatgtgcaccaggtgtacaagtaccccttcgagcaggtggtcgccagctttctccgaaaggtttccacgctttgagaaggactgaatgagatcatgcgcatggcagcttctctaggatagcaccctgcgtgaacacagtagctgctcagttaagtctttgatgggtgtgatcctgattcagcttgatcaattctgcagtcatactggattgtgtttgaaaaggtgtccagaaaaacctggccatctgcctcctgtcttcccagtaccccaaccccatggataaaaatgtcatctcagtaaaaatcatggaggaaaaaagagatgaatcaacaggggtcatctacagaaagaggattgcaatctgtcagaacgtggttccagaaattttaaggaaggtgagcattttgaaagtacctaatatccaattagaagaggagtcatggctcaatcctcgggaaagaaacatggccatacggagtcactgccttacgtggacacagtatgcatccatgaaggaagagtctgtcttccgggaaagtatggaaaacccaaattggacagagttcattcaaagaggcaggatttcaatcacaggggttggatttctcaactgtgttttagaaacttttgccagcacattcttacgacagggagcccagaagggaattagaatcatggagatgctgctaaaggaacagtgtggtgcccccttagctgaataaagaatcatcagagagctgtatccatgtctacttttttatttatttattttttttttgagaatcacttcttggccacagcacatcacagacacagtttctggaatacaggtttgaggatacagtgttggcagcttcaagaagagaagaccttcttgccaggacataaaatgataccctcctctgggagcctgcttcgaatagtgggactcagggagataagaccttcttgctggatttttatgacacaatctctttataattttacaaataaaggaaaaaagacccatgtaagatatgtgtgcccttcctcagggtgttctgctggttgtctgatgatggtgtcagggcagctaaggacaggataaaggcctggagagggtgcttgtgcccttatgttatcagcaccgttgttcctaggattcgtgaggggattctggaaccaataagggagttgaactggtacctgattcacgggtggactggaacaaacaggaatgtaccagacctatgttgaagctaagccgtatttataacaatgtttaagattctcagaaatcaggagatttttatcctatccataagtaatatgtaactgccataagtatagcttttagaatgtaatatgtaaactgcgatttggtcctctggaaaaaaaaaaatgaaatgaagagtgggaaggcagtttcttttctgctaattcgttctgtgatggtgagcaagcaaatcattaacctctctgttttttattgggcaaatggggataatcaggcacaggtctttccgccaatgcgttatgatgattaaagaaggtaattttgtgcagggttttaagtcaacagacagacctgggtttgaatccaagtgctggcacctacttgctcagtgatcatgaacacaattttaaatctttctgaatctcatttaaaaaaatttgtgaaacaagatgatagaattaattttgtgagattgttggactgatttgagatcatgcctatgaagtacctagcacactgcctagtacatagtagaagtccaggaaatggaagccattattatgtaaaacgttttgcaaaggtactttttaactgtaacgtaaagtggtactactgtttgaaacttagatggcagtagtttgcatttctcgtgatcagaagccaaaatataaatacatactacctaaaaaatcttgaagagaggtaataatttgaaattcatcttcttaagataaaaatcagggcagggtgtggtggcttatgcctgtaatcccagtactttgggaggccgaggcgggtggatcacaaggtcaggagttcgagaccagcctggccaatatggtgaaaccccgtctctactaaaaatacaaaaaaattagctgggcgtggtggcgcatgcctgtaatcctagctacttgggagtctgaggcaggagaattgcttgaactcaggaggtgaaggttgcagtaagctgagattgtgccactgcaccccagcctgggtgacagagcaagactccatcac

SEQ ID NO: 58833 - DNA, 2140 bp, Homo sapiens
agctctgagctcgcggaggcgtggccggtgcgcggggcccgcggcgcgcggggatgggggtctcggtggatgtgcaccaggtgtacaagtaccccttcgagcaggtggtcgccagctttctccgaaagtaccccaaccccatggataaaaatgtcatctcagtaaaaatcatggaggaaaaaagagatgaatcaacaggggtcatctacagaaagaggattgcaatctgtcagaacgtggttccagaaattttaaggaagtccttaagcactctggtgattctttgttggaaaaaggtgagcattttgaaagtacctaatatccaattagaagaggagtcatggctcaatcctcgggaaagaaacatggccatacggagtcactgccttacgtggacacagtatgcatccatgaaggaagagtctgtcttccgggaaagtatggaaaacccaaattggacagagttcattcaaagaggcaggatttcaatcacaggggttggatttctcaactgtgttttagaaacttttgccagcacattcttacgacagggagcccagaagggaattagaatcatggagatgctgctaaaggaacagtgtggtgcccccttagctgaataaagaatcatcagagagctgtatccatgtctacttttttatttatttattttttttttgagaatcacttcttggccacagcacatcacagacacagtttctggaatacaggtttgaggatacagtgttggcagcttcaagaagagaagaccttcttgccaggacataaaatgataccctcctctgggagcctgcttcgaatagtgggactcagggagataagaccttcttgctggatttttatgacacaatctctttataattttacaaataaaggaaaaaagacccatgtaagatatgtgtgcccttcctcagggtgttctgctggttgtctgatgatggtgtcagggcagctaaggacaggataaaggcctggagagggtgcttgtgcccttatgttatcagcaccgttgttcctaggattcgtgaggggattctggaaccaataagggagttgaactggtacctgattcacgggtggactggaacaaacaggaatgtaccagacctatgttgaagctaagccgtatttataacaatgtttaagattctcagaaatcaggagatttttatcctatccataagtaatatgtaactgccataagtatagcttttagaatgtaatatgtaaactgcgatttggtcctctggaaaaaaaaaaatgaaatgaagagtgggaaggcagtttcttttctgctaattcgttctgtgatggtgagcaagcaaatcattaacctctctgttttttattgggcaaatggggataatcaggcacaggtctttccgccaatgcgttatgatgattaaagaaggtaattttgtgcagggttttaagtcaacagacagacctgggtttgaatccaagtgctggcacctacttgctcagtgatcatgaacacaattttaaatctttctgaatctcatttaaaaaaatttgtgaaacaagatgatagaattaattttgtgagattgttggactgatttgagatcatgcctatgaagtacctagcacactgcctagtacatagtagaagtccaggaaatggaagccattattatgtaaaacgttttgcaaaggtactttttaactgtaacgtaaagtggtactactgtttgaaacttagatggcagtagtttgcatttctcgtgatcagaagccaaaatataaatacatactacctaaaaaatcttgaagagaggtaataatttgaaattcatcttcttaagataaaaatcagggcagggtgtggtggcttatgcctgtaatcccagtactttgggaggccgaggcgggtggatcacaaggtcaggagttcgagaccagcctggccaatatggtgaaaccccgtctctactaaaaatacaaaaaaattagctgggcgtggtggcgcatgcctgtaatcctagctacttgggagtctgaggcaggagaattgcttgaactcaggaggtgaaggttgcagtaagctgagattgtgccactgcaccccagcctgggtgacagagcaagactccatcac

SEQ ID NO: 58834 - DNA, 2104 bp, Homo sapiens
agctctgagctcgcggaggcgtggccggtgcgcggggcccgcggcgcgcggggatgggggtctcggtggatgtgcaccaggtgtacaagtaccccttcgagcaggtggtcgccagctttctccgaaagtaccccaaccccatggataaaaatgtcatctcagtaaaaatcatggaggaaaaaagagatgaatcaacaggggtcatctacagaaagaggattgcaatctgtcagaacgtggttccagaaattttaaggaaggtgagcattttgaaagtacctaatatccaattagaagaggagtcatggctcaatcctcgggaaagaaacatggccatacggagtcactgccttacgtggacacagtatgcatccatgaaggaagagtctgtcttccgggaaagtatggaaaacccaaattggacagagttcattcaaagaggcaggatttcaatcacaggggttggatttctcaactgtgttttagaaacttttgccagcacattcttacgacagggagcccagaagggaattagaatcatggagatgctgctaaaggaacagtgtggtgcccccttagctgaataaagaatcatcagagagctgtatccatgtctacttttttatttatttattttttttttgagaatcacttcttggccacagcacatcacagacacagtttctggaatacaggtttgaggatacagtgttggcagcttcaagaagagaagaccttcttgccaggacataaaatgataccctcctctgggagcctgcttcgaatagtgggactcagggagataagaccttcttgctggatttttatgacacaatctctttataattttacaaataaaggaaaaaagacccatgtaagatatgtgtgcccttcctcagggtgttctgctggttgtctgatgatggtgtcagggcagctaaggacaggataaaggcctggagagggtgcttgtgcccttatgttatcagcaccgttgttcctaggattcgtgaggggattctggaaccaataagggagttgaactggtacctgattcacgggtggactggaacaaacaggaatgtaccagacctatgttgaagctaagccgtatttataacaatgtttaagattctcagaaatcaggagatttttatcctatccataagtaatatgtaactgccataagtatagcttttagaatgtaatatgtaaactgcgatttggtcctctggaaaaaaaaaaatgaaatgaagagtgggaaggcagtttcttttctgctaattcgttctgtgatggtgagcaagcaaatcattaacctctctgttttttattgggcaaatggggataatcaggcacaggtctttccgccaatgcgttatgatgattaaagaaggtaattttgtgcagggttttaagtcaacagacagacctgggtttgaatccaagtgctggcacctacttgctcagtgatcatgaacacaattttaaatctttctgaatctcatttaaaaaaatttgtgaaacaagatgatagaattaattttgtgagattgttggactgatttgagatcatgcctatgaagtacctagcacactgcctagtacatagtagaagtccaggaaatggaagccattattatgtaaaacgttttgcaaaggtactttttaactgtaacgtaaagtggtactactgtttgaaacttagatggcagtagtttgcatttctcgtgatcagaagccaaaatataaatacatactacctaaaaaatcttgaagagaggtaataatttgaaattcatcttcttaagataaaaatcagggcagggtgtggtggcttatgcctgtaatcccagtactttgggaggccgaggcgggtggatcacaaggtcaggagttcgagaccagcctggccaatatggtgaaaccccgtctctactaaaaatacaaaaaaattagctgggcgtggtggcgcatgcctgtaatcctagctacttgggagtctgaggcaggagaattgcttgaactcaggaggtgaaggttgcagtaagctgagattgtgccactgcaccccagcctgggtgacagagcaagactccatcac

SEQ ID NO: 58835 - DNA, 1116 bp, Homo sapiens
cgtgggatgttagcggtgggggcaatggagggcacccggcagagcgcattcctgctcagcagccctcccctggccgccctgcacagcatggccgagatgaagaccccgctgtaccctgccgcgtatcccccgctgcctgccggccccccctcctcctcgtcctcgtcgtcgtcctcctcgtcgccctccccgcctctgggcacccacaacccaggcggcctgaagcccccggccacgggggggctctcatccctcggcagccccccgcagcagctctcggccgccaccccacacggcatcaacaatatcctgagccggccctccatgcccgtggcctcgggggccgccctgccctccgcctcgccctccggttcctcctcctcctcttcctcgtccgcctctgcctcctccgcctctgccgccgccgcggctgctgccgcggccgcagccgccgcctcatccccggcggggctgctggccggactgccacgctttagcagcctgagcccgccgccgccgccgcccgggctctacttcagccccagcgccgcggccgtggccgccgtgggccggtaccccaagccgctggctgagctgcctggccggacgcccatcttctggcccggagtgatgcagagcccgccctggagggacgcacgcctggcctgtacccctcatcaaggatccattttgttggacaaagacgggaagagaaaacacacgagacccactttttccggacagcagatcttcgccctggagaagactttcgaacaaacaaaatacttggcggggcccgagagggctcgtttggcctattcgttggggatgacagagagtcaggtcaaggtctggttccagaaccgccggaccaagtggaggaagaagcacgctgccgagatggccacggccaagaagaagcaggactcggagacagagcgcctcaagggggcctcggagaacgaggaagaggacgacgactacaataagcctctggatcccaactcggacgacgagaaaatcacgcagctgttgaagaagcacaagtccagcagcggcggcggcggcggcctcctactgcacgcgtccgagccggagagctcatcctgaacgccg

SEQ ID NO: 58836 - DNA, 5054 bp, Homo sapiens
actcagcctggagaccgaagcgcttcactgagcgctcgccgccgcccagcctctcctctcgcgcctcctagctcttcgcagagcaaccaggagccaggagtggtctagagcccgagggtgggaagggggagtctgtctggcttttctcctatcttgcttctttttcctcttcccttcccactcttgttcaagcgagtgtgtgagctatggagcgaagagcctggagtctgcagtgcactgctttcgtcctcttttgcgcttggtgtgcactgaacagtgcaaaagcgaaaaggcaatttgtcaatgaatgggcagcggagatccccgggggcccggaagcagcctcggccatcgccgaggagctgggctatgaccttttgggtcagattggttcacttgaaaatcactacttattcaaacataaaaaccaccccagaaggtctcgaaggagtgcctttcatatcactaagagattatctgatgatgatcgtgtgatatgggctgaacaacagtatgaaaaagaaagaagtaaacgttcagctctaagggactcagcactaaatctcttcaatgatcccatgtggaatcagcaatggtacttgcaagataccaggatgacggcagccctgcccaagctggaccttcatgtgatacctgtttggcaaaaaggcattacgggcaaaggagttgttatcaccgtactggatgatggtttggagtggaatcacacggacatttatgccaactatgatccagaggctagctatgattttaatgataatgaccatgatccatttccccgatatgatcccacaaacgagaacaaacacgggaccagatgtgcaggagaaattgccatgcaagcaaataatcacaaatgcggggttggagttgcatacaattccaaagttggaggcataagaatgctggatggcattgtgacggatgctattgaggccagttcaattggattcaatcctggacacgtggatatttacagtgcaagctggggccctaatgatgatgggaaaactgtggaggggcctggccggctagcccagaaggcttttgaatatggtgtcaaacaggggagacaggggaaggggtccatcttcgtctgggcttcgggaaacggggggcgtcagggagataattgtgactgtgatggctacacagacagcatctacaccatctccatcagcagtgcctcccagcaaggcctatccccctggtacgctgagaagtgctcctccacactggccacctcttacagcagcggagattacaccgaccagagaatcacgagcgctgacctgcacaatgactgcacggagacgcacacaggcacctcggcctctgcacctctggctgctggcatcttcgctctggccctggaagcaaacccaaatctcacctggcgagatatgcagcacctggttgtctggacctctgagtatgacccgctggccaataaccctggatggaaaaagaatggagcaggcttgatggtgaatagtcgatttggatttggcttgctaaatgccaaagctctggtggatttagctgaccccaggacctggaggagcgtgcctgagaagaaagagtgtgttgtaaaggacaatgactttgagcccagagccctgaaagctaatggagaagttatcattgaaattccaacaagagcttgtgaaggacaagaaaatgctatcaagtccctggagcatgtacaatttgaagcaacaattgaatattcccgaagaggagaccttcatgtcacacttacttctgctgctggaactagcactgtgctcttggctgaaagagaacgggatacatctcctaatggctttaagaactgggacttcatgtctgttcacacatggggagagaaccctataggtacttggactttgagaattacagacatgtctggaagaattcaaaatgaaggaagaattgtgaactggaagctgattttgcacgggacctcttctcagccagagcatatgaagcagcctcgtgtgtacacgtcctacaacactgttcagaatgacagaagaggggtggagaagatggtggatccaggggaggagcagcccacacaagagaaccctaaggagaacaccctggtgtccaaaagccccagcagcagcagcgtagggggccggagggatgagttggaggagggagccccttcccaggccatgctgcgactcctgcaaagtgctttcagtaaaaactcaccgccaaagcaatcaccaaagaagtccccaagtgcaaagctcaacatcccttatgaaaacttctacgaagccctggaaaagctgaacaaaccttcccagcttaaagactctgaagacagtctgtataatgactatgttgatgttttttataacactaaaccttacaagcacagagacgaccggctgcttcaagctctggtggacattctgaatgaggaaaattaaaataagtgtgtggtcccaagttggaaatattcatgcttcttccttaccctgcgattttgcctgtgtctgaagtggttgttttgtcatgaattcttatgcttataatatcctttgtggcaccttttctttttctccctaaactgtacatgtgaaggggatgagctcaagcaggaagttcaacttccagaattgatcataggtatttcaaaacacatctttcctgtctgcacaagtgaagtgttttgttctttctggagtcacagttgacaaaaagctcttacactacattagaacactgcattagagcccatttcaattctcaaaagaaaaggcaaaacctgggatatcaattaatttgaaaacataatctgcaaagaatgagaaggagtcagaaactgtttctgtagcttgttccctgtcttgtccatgtggttcttcaaattttgatgccaagaaagtatttggtaggcctaatgaaggagttcactgtaagactcattccctagatctttctattccaaagtgccactcattcctgtagtcaaaatctggtcatgttggtcaaaagctggattatttagatctagaaacagatcttgaaatctgaatgctctggtttgagcaattttcgaacattctttgcctggtgcactgtgtctgtggtgccagaggcgtccgtggatccagaggtggttatgactcgtgctgcatgcctggtctttcctctgtttctccttctgaaagttttctatacctgtctcctttctcagccacaaaataaatgttgggagaaatgatatataccactttcccagaaaaaaaaaaacttacacttgggacttggcaaattcctagtcacaatttttttcagcagtaacaggaaaccacttatcacatggagacctaatgtaataatagaaaaatactcataatagggagaaaccaagagaagttttgtttttgtttttttccaactgtgttcattagaacagcgtgttctaagtatttgaaactgaatgtttattccttgatactaaaagttcttctccaatcctatcactgatagtgtccaaattctcaccaaattgctcctaagcttcaaatcagaagcagaaactggcaggccatggaccttaattgtccctcaggtagattttgtttggtatgcagaatgtttttaaaatatgagtggttattgaaaatatgatgtttcacataaaacctcattctcggacccatctttgctcatggcaacagttagctggagctgagtagcagctgcctgattagatgactctcagtccccatggcaccctgctccatgttacctagagcaggcacttgattccttgctgggcagtatccaataggcatttgattttgcccactcctacactaagcgaatgtgtacaaagtgtaaatgcattaggaaaaacaaactacccgcatcttctgttaggcaggatctgtacaataataattatgagtttgcttatgtaatctcacctcacctggatgatcactaatactaattcatttattactaaccttctggcttccttctctcaatatgcttacaaagtctccagtcacctacaatgctggctttctcccactgagtttgctgtttgcaatttttccatgaagtttgaacttcataaggtaattcatggcattgaactggttcatgaaaagaacactagagtctgtcatttgctttggcttgaagtatggttggtaacacaaattttcacctgctcttctaccatttgaatttgtgtagagggtgtttgcagagcaatgcccgtaatgcttagagaatgttctcctaaaagacttgcggaatcactctgtccttggaagtttcatatattgtttgatatgaagtgttagatagaatttccaatattggagcatatcaaaaagtattaaaactaaaaaggaccagagaattcttagattggcccggaaaggccaataaagagttagaatgaaaactcattacttttccattcccaatctagtgctagatgtataaatctttcttttgattcttcctaacaaaatattttctgggttaaaaccccagccaactcattgggttgtagccaaaggttcactctcaagaagctttaatatttaaataaaatcatattgaatgtttccaacctggagtataatattcagatataaaacagttttgtcagtctttcttagtgcctgtgtggatttttgtgaaaatgtcaaagagaaaacttatatactatttcccttgaaattttaaactatattttctttacaggtatttataatataccaatgcttttatcaaacagaattttaaagagcataataaattatattaaagaaccaaaagttttcctgagaataagaaagtttcacccaataaaatatttttgaaaggcatgttcctctgtcaatgaaaaaaagtacatgtatgtgttgtgatattaaaagtgacatttgtctaatagcctaatacaacatgtagctgagtttaacatgtgtggtcttggtattcttaagggaacttccacattatacatttgatgtattgaccagaat

SEQ ID NO: 58837 - DNA, 1659 bp, Homo sapiens
agcagtacaggcagaagctggcggctcatggcttcgtgcccatggggtcaggaacagggagcgaggagcccctcggaggagcctccagaggaggaaatccccaaggaggatgggatcttggtgctgagccgccacaccctgggcctggccctgcgggagcaccctgccctgctggtggaattctatgccccgtggtgtgggcactgccaggccctggcccccgagtacagcaaggcagctgccgtgctcgcggccgagtcaatggtggtcacgctggccaaggtggatgggcccgcgcagcgcgagctggctgaggagtttggtgtgacggagtaccctacgctcaagttcttccgcaatgggaaccgcacgcaccccgaggagtacacaggaccacgggacgctgagggcattgccgagtggctgcgacggcgggtggggcccagtgccatgcggctggaggatgaggcggccgcccaggcgctgatcggtggccgggacctagtggtcattggcttcttccaggacctgcaggacgaggacgtggccaccttcttggccttggcccaggacgccctggacatgacctttggcctcacagaccggccgcggctctttcagcagtttggcctcaccaaggacactgtggttctcttcaagaagtttgatgaggggcgggcagacttccccgtggacgaggagcttggcctggacctgggggatctgtcgcgcttcctggtcacacacagcatgcgcctggtcacggagttcaacagccagacgtctgccaagatcttcgcggccaggatcctcaaccacctgctgctgtttgtcaaccagacgctggctgcgcaccgggagctcctagcgggctttggggaggcagctccccgcttccgggggcaggtgctgttcgtggtggtggacgtggcggccgacaatgagcacgtgctgcagtactttggactcaaggctgaggcagcccccactctgcgcttggtcaaccttgaaaccactaagaagtatgcgcctgtggatgggggccctgtcaccgcagcgtccatcactgctttctgccatgcagtcctcaacggccaagtcaagccctatctcctgagccaggagataccccctgattgggatcagcggccagttaagaccctcgtgggcaagaattttgagcaggtggcttttgacgaaaccaagaatgtgtttgtcaagttctatgccccgtggtgcacccactgcaaggagatggcccctgcctgggaggcattggctgagaagtaccaagaccacgaggacatcatcattgctgagctggatgccacggccaacgagctggatgccttcgctgtgcacggcttccctactctcaagtacttcccagcagggccaggtcggaaggtgattgaatacaaaagcaccagggacctggagactttctccaagttcctggacaacgggggcgtgctgcccacggaggagtccccggaggagccagcagccccgttcccggagccaccggccaactccactatggggtccaaggaggaactgtagctgcccccgtgtcacccccgccatcactgctggacaggagccacccccttgggtaccagagggagctgtgcattgtgaataaagagtgagcttggt

SEQ ID NO: 58838 - DNA, 4153 bp, Homo sapiens
atggccttttcctacctgtttgccacctgtgcccgcggcctccttccccgccggccgcgctccggagcctccgggccgcggtggagcgagggcccaggcgaggcgagggccgggcggcgggcgccgggccccgcggccggcacgacggagcccccgtacggccggcggcagcggttggcggcggcccccggcccccggcgcgggaagcggcggcggggcggcggcggcggtggcggtggcggtggcggcgacggtggcagcgccatggagccgggggaggtgaaggaccggatcctggagaacatctcgctgtcggtgaagaagttgcagagctattttgctgcatgtgaggatgagatccctgccatccggaaccatgacaaggtcctacagcgtctgtgtgagcacctggaccacgccctgctgtacggactgcaagacctctcctctggctactgggtgctcgtggtgcattttactcggagagaggccatcaagcagatcgaggtgctgcagcacgtggccaccaacctggggcgcagccgtgcctggctgtacctggccctcaacgagaactccttggagagctacctgcggttgttccaggagaacctgggcctgctgcataagtactacgtcaagaatgccctggtctgcagccacgatcacctgacgctcttcctgaccttggtgtccgggctagagttcattcgtttcgagctggatctggatgccccttacctagacctggccccctacatgcccgactactacaaacctcagtacctgctggactttgaagaccgccttcccagctcggtccacggctcagacagtctgtccctcaactctttcaactccgtcacctccaccaacctggagtgggatgacagtgcgattgccccatctagtgaggattatgattttggagatgtgtttccagcagtgccgtctgtacccagcacagactgggaagatggagacctcacagacacggtcagtggtccccgctccacagcctccgacctgaccagcagcaaggcctccaccaggagccccacccagcgccagaaccccttcaacgaggagccggcagagactgtgtcctcctctgacaccacccccgtgcacaccacctctcaggagaaggaggaggcccaggccctggacccgccggatgcctgcacggagctcgaggtcatcagggtcaccaagaagaagaaaattggcaagaagaaaaagagcagatcagatgaggaggcaagtccactccaccccgcctgcagccagaagaaatgtgccaagcagggggacggtgacagccgcaacggcagcccaagccttgggcgggactcgccagacactatgcttgcctccccccaggaggagggagaggggccgagcagcaccacggagagcagcgagcgctccgagccgggcctgctgatccctgagatgaaggacacctccatggagcgcttggggcagcccctgagcaaggttatcgaccagctcaacgggcagctggaccccagcacctggtgctcccgtgctgagcccccagaccagtcctttcggaccggctctcccggggatgccccggagaggccgccgctttgcgactttagtgaggggctttcagccccaatggacttctaccgctttaccgtcgagagtccaagcactgttacatcaggtggcggccaccatgaccctgcagggcttggccaaccgctgcatgttcctagtagccctgaggctgctggccaagaagaagagggaggaggaggagagggacagacgcctcggcccctagaggataccacgagggaggctcaggagctggaggcccagctgtccctggtcagggaggggcctgtgtctgagccagagcctgggacccaggaggttctctgccagctcaagcgagaccagcccagcccgtgtctgagtagcgctgaggattctggggtggatgagggacaggggagcccttcggagatggtccattcctcggagttcagagtagacaacaatcacctgctcctgctcatgatccacgtgttccgagaaaacgaagagcagctgttcaaaatgatccggatgagcaccgggcacatggagggcaacctgcagctgctgtacgtgctgctcacagactgctatgtctacctgctccggaaaggggccacagagaagccatacctggtggaagaggccgtttcttacaatgaacttgactatgtgtcggttggccttgaccagcagacggtgaagctggtgtgcaccaaccgcaggaagcagtttctgctggacacggctgatgtggcgctggctgagttctttttggcttctttgaagtcagccatgatcaaaggctgtcgagaacctccctaccccagcatcctgacggatgccaccatggagaagctggcactggccaaatttgtggcccaagaatcgaagtgtgaggcatctgctgtcaccgtgcgcttctacggccttgtgcactgggaggaccccacagacgagtccctgggccccacgccctgccactgctcaccccccgagggcaccatcaccaaagaaggcatgctgcactacaaggcgggcacctcctacctgggcaaggaacactggaagacgtgcttcgtggtgctcagcaacgggatcctctaccagtacccggaccgcaccgacgtcatccctctgctctcggtgaacatggggggggagcagtgcggtggctgccggagagccaacaccacggatcggccccacgccttccaggtcattctctccgaccggccctgcctggagctaagtgccgagagcgaggccgagatggccgagtggatgcagcatctctgccaggctgtgtccaaaggggtcatcccccagggcgtagctcccagcccctgcataccctgctgcctggtcctcacggatgaccgcctctttacgtgccatgaggattgccagaccagcttcttccgctctttgggcacagccaagctgggcgacatcagcgccgtctccaccgagccgggcaaggagtactgcgtcttggagttctcccaggacagccagcagctcctcccgccctgggtcatctacctgagctgcacttctgaactggaccgattgctgtctgcactgaactctgggtggaaaaccatctatcaggtggacctcccccacacggcgatccaggaagcctccaacaagaagaaattcgaggatgccttgagcctcatccacagcgcctggcagcggagcgacagtctctgccgcggccgagcctcccgagacccctggtgctgaggcagagctggttggcgtccctggtgggcaggaaaggaaggcacgccagccggcaggcacactgtcacggctgttgtcatgctgtcgggagcctacagtccacccctgccctgggcggcagaaccaccgagtgtggcttaagacagggtccctccactccagggatccagatcaggtgcccggcacccctgggcatcctgcccgacaggtagcgaatggaggtcgctgggggcagagggtccgagccctgtgggctctgcggatgcacgccctcctcccgggcctccgcctcagtctgcagaatttctgccgagtggcaccgagaacaccatccatctaaggacgaacaaaagaaccaggagggcgggacccccctcttcctctcctgggttgggggctggggccctgagtgcccagccatccttgttcgtgtttgaacactctcctggccacgtggggaagcgggaacacggggtgtctgcgcatgtttcctcctcctagctccatcactgcgcacacagctgcctgcctcgccagatgcaggggggcgggcagccctccctggctgccaggaggctctgcatgcccacagtcctgccctgcctgtcccctcaacccggcagtgcctgtagcaccgaggagcaaagggggtggatggggggcttggagaagggcggagcccaccagcctggcatccatgttgacatcttctgactgtcccctgcttggctggagccaggcccttccctagagtttcgtcaagagcctcctggggaaggggtcaggtggtttgggttttgttttttaaaataaaatagacatgttatat

SEQ ID NO: 58839 - DNA, 4153 bp, Homo sapiens; identical to SEQ ID NO: 58838

SEQ ID NO: 58840 - DNA, 457 bp, Homo sapiens
ggcaggtgctcgcttggtctagtgcccatttactctggactccggatggctgccgcacgcctctgcctctccctgctgctcctgtccacctgcgtggctctgttactacagccactgctgggtgcccagggagccccactggagccagtgtacccaggggacaatgccacaccagagcagatggcccagtatgcagctgatctccgtagatacatcaacatgctgaccaggcctaggtatgggaaaagacacaaagaggacacgctggccttctcggagtgggggtccccgcatgctgctgtccccagggagctcagcccgctggacttataatgccaccttctgtctcctacgactccatgagcagcgccagcccagctctcccctctgcacccttggctctggccaaagcttgctccctgctcccacacaggctcaataaagcaagtcaaagcca

SEQ ID NO: 58841 - DNA, 807 bp, Homo sapiens
acactctaccaccatgaatccattcctgatccttgcctttgtgggagctgctgttgctgtcccctttgacgatgatgacaagattgttgggggctacacctgtgaggagaattctctcccctaccaggtgtccctgaattctggctcccacttctgcggtggctccctcatcagcgaacagtgggtggtatcagcagctcactgctacaagacccgcatccaggtgagactgggagagcacaacatcaaagtcctggaggggaatgagcagttcatcaatgcggccaagatcatccgccaccctaaatacaacagggacactctggacaatgacatcatgctgatcaaactctcctcacctgccgtcatcaatgcccgcgtgtccaccatctctctgcccaccgcccctccagctgctggcactgagtgcctcatctccggctggggcaacactctgagctttggtgctgactacccagacgagctgaagtgcctggatgctccggtgctgacccaggctgagtgtaaagcctcctaccctggaaagattaccaacagcatgttctgtgtgggcttccttgagggaggcaaggattcctgccagcgtgactctggtggccctgtggtctgcaacggacagctccaaggagttgtctcctggggccatggctgtgcctggaagaacaggcctggagtctacaccaaggtctacaactatgtggactggattaaggacaccatcgctgccaacagctaaagcccccggtccctctgcagtctctataccaataaagtggccctgctctc

SEQ ID NO: 58842 - DNA, 3649 bp, Homo sapiens
gcggcaagccccgcctcagcccctctggcaggctcccgccagcgtcgctgcggctccggcccgggagcgagcgcccggagctcggaaagatgcggcgcccgcggcggcctgggggtctcgggggatccgggggtctccggctgctcctctgcctcctgctgctgagcagccgcccggggggctgcagcgccgttagtgcccacggctgtctatttgaccgcaggctctgctctcacctggaagtctgtattcaggatggcttgtttgggcagtgccaggtgggagtggggcaggcccggccccttttgcaagtcacctccccagttctccaacgcttacaaggtgtgctccgacaactcatgtcccaaggattgtcctggcacgatgacctcacccagtatgtgatctctcaggagatggagcgcatccccaggcttcgccccccagagccccgtccaagggacaggtctggcttggcacccaagagacctggtcctgctggagagctgcttttacaggacatccccactggctccgcccctgctgcccagcatcggcttccacaaccaccagtgggcaaaggtggagctggggccagctcctctctgtcccctctgcaggctgagctgctcccgcctctcttggagcacctgctgctgcccccacagcctccccacccttcactgagttacgaacctgccttgctgcagccctacctgttccaccagtttggctcccgtgatggctccagggtctcagagggctccccagggatggtcagtgtcggccccctgcccaaggctgaagcccctgccctcttcagcagaactgcctccaagggcatatttggggaccaccctggccactcctacggggaccttccagggccttcacctgcccagctttttcaagactctgggctgctctatctggcccaggagttgccagcacccagcagggccagggtgccaaggctgccagagcaagggagcagcagccgggcagaggactccccagagggctatgagaaggaaggactaggggatcgtggagagaagcctgcttccccagctgtgcagccagatgcggctctgcagaggctggccgctgtgctggcgggctatggggtagagctgcgtcagctgacccctgagcagctctccacactcctgaccctgctgcagctactgcccaagggtgcaggaagaaatccgggaggggttgtaaatgttggagctgatatcaagaaaacaatggaggggccggtggagggcagagacacagcagagcttccagcccgcacatcccccatgcctggacaccccactgccagccctacctccagtgaagtccagcaggtgccaagccctgtctcctctgagcctcccaaagctgccagaccccctgtgacacctgtcctgctagagaagaaaagcccactgggccagagccagcccacggtggcaggacagccctcagcccgcccagcagcagaggaatatggctacatcgtcactgatcagaagcccctgagcctggctgcaggagtgaagctgctggagatcctggctgagcatgtgcacatgtcctcaggcagcttcatcaacatcagtgtggtgggaccagccctcaccttccgcatccggcacaatgagcagaacctgtctttggctgatgtgacccaacaagcagggctggtgaagtctgaactggaagcacagacagggctccaaatcttgcagacaggagtgggacagagggaggaggcagctgcagtccttccccaaactgcgcacagcacctcacccatgcgctcagtgctgctcactctggtggccctggcaggtgtggctgggctgctggtggctctggctgtggctctgtgtgtgcggcagcatgcgcggcagcaagacaaggagcgcctggcagccctggggcctgagggggcccatggtgacactacctttgagtaccaggacctgtgccgccagcacatggccacgaagtccttgttcaaccgggcagagggtccaccggagccttcacgggtgagcagtgtgtcctcccagttcagcgacgcagcccaggccagccccagctcccacagcagcaccccgtcctggtgcgaggagccggcccaagccaacatggacatctccacgggacacatgattctggcatacatggaggatcacctgcggaaccgggaccgccttgccaaggagtggcaggccctctgtgcctaccaagcagagccaaacacctgtgccaccgcgcagggggagggcaacatcaaaaagaaccggcatcctgacttcctgccctatgaccatgcccgcataaaactgaaggtggagagcagcccttctcggagcgattacatcaacgccagccccattattgagcatgaccctcggatgccagcctacatagccacgcagggcccgctgtcccataccatcgcagacttctggcagatggtgtgggagagcggctgcaccgtcatcgtcatgctgaccccgctggtggaggatggtgtcaagcagtgtgaccgctactggccagatgagggtgcctccctctaccacgtatatgaggtgaacctggtgtcggagcacatctggtgcgaggactttctggtgcggagcttctacctgaagaacgtgcagacccaggagacgcgcacgctcacgcagttccacttcctcagctggccggcagagggcacaccggcctccacgcggcccctgctggacttccgcaggaaggtgaacaagtgctaccggggccgctcctgccccatcatcgtgcactgcagtgatggtgcggggaggaccggcacctacatcctcatcgacatggtcctgaaccgcatggcaaaaggagtgaaggagattgacatcgctgccaccctggagcatgtccgtgaccagcggcctggccttgtccgctctaaggaccagtttgaatttgccctgacagccgtggcggaggaagtgaatgccatcctcaaggccctgccccagtgagaccctggggccccttggcgggcagcccagcctctgtccctctttgcctgtgtgagcatctctgtgtacccactcctcactgccccaccagccacctcttgggcatgctcagcccttcctagaagagtcaggaagggaaagccagaaggggcacgcctgcccagcctcgcatgccagagcctggggcatcccagagcccagggcatcccatgggggtgctgcagccaggaggagaggaaaggacatgggtagcaattctacccagagccttctcctgcctacattccctggcctggctctcctgtagctctcctggggttctgggagttccctgaacatctgtgtgtgtccccctatgctccagtatggaagaatggggtggagggtcgccacacccggctccccctgcttctcagccccgggcctgcctctgactcacacttgggcgctctgccctccctggcctcacgcccagcctcctcccaccaccctcccaccatgcgctgctcaacctctctccttctggcgcaagagaacatttctagaaaaaactacttttgtaccagtgtgaataaagttagtgtgttgtctgtgcagctgcaaaaaaaaaaaaaaaaaaa

SEQ ID NO: 58843 - DNA, 3538 bp, Homo sapiens
ggctggggctccgctggggaaccggccgagcggcgcgcgcggaggtgtccggcggccaggaggatggccaaggtcccgaagctggaagacaccttcctgcaggcgcagcctgcgccccaactgtccccggggatccaggaagactgctgtgtgcagctcctgggcaagggcttgctagtctatccggaagaaacagtgtacctggcggccgaagggcagcccgggggcgagcagggcggcggggagaaaggcgaagacccggagctgccgggggcagtgaaatcagaaatgcacttaaacaatggtaacttttcctctgaagaagaggacgccgacaaccacgacagcaaaaccaaagcagcggatcaatacctgtctcagaagaaaaccatcacgcagattgtgaaggataaaaagaagcagacacagctcacgctgcagtggcttgaagagaattacattgtatgtgaaggagtttgcttaccacggtgcattctttatgcacactacttagatttctgtaggaaagagaaattagagccagcctgtgcggccacctttggaaagacaattcgccagaagtttcccctcctaacaacaaggcggcttggaacaagaggccattcaaagtatcattactatgggattggcatcaaagagagcagtgcatattaccactccgtttattctggaaagggcttgacaaggttttctggaagcaagctaaagaatgagggtggcttcactcgtaaatattcgcttagctcaaaaactggaacacttcttccagaattccccagcgctcaacaccttgtataccaaggatgcatttctaaggacaaggttgatacgctcataatgatgtacaaaactcactgccagtgtatcctggacaatgcaattaatggaaactttgaagagatccagcattttttattacacttttggcaaggaatgcctgaccatctccttcccctgctcgaaaatcctgttatcattgatattttctgtgtttgtgactcaattctttataaggttcttacagatgtactcattcctgcaacaatgcaagaaatgcctgaaagcttattagcagacataagaaattttgctaaaaattgggaacagtgggttgtttcatccttggaaaacttgccagaagctctaactgacaagaaaatacctattgtgcgaagatttgtatcttctctgaaacgacaaacatctttcttacatcttgcccagattgccagaccagctctctttgaccagcatgtcgttaattctatggtgtctgatattgaaagggttgatttgaacagcattggctctcaagcccttcttaccatttcaggcagcacagacactgaatctggtatctacactgaacatgactctatcactgtgttccaagaactgaaggatctccttaagaagaatgccactgtggaggcttttattgaatggttggatactgtggtagaacagagagttattaagaccagcaaacaaaatggaaggtcattaaagaagagagctcaagactttctgttaaagtggagtttttttggtgctcgagtaatgcataatctcaccttgaacaatgcatccagttttggttcttttcatttgattcgaatgcttctcgatgaatacattctcctggccatggagacccagtttaataatgacaaagagcaggagttacagaatttattggacaagtatatgaagaattcagatgcgagtaaagctgctttcactgcttctccgagttcatgctttctggccaaccgtaataaagggagcatggtttccagcgacgctgtgaagaatgaaagccacgtggagacaacctatctccctctgccatccagtcaacctggaggcctaggccctgctctgcaccagttccctgctgggaacacagacaacatgccgctcacaggtcaaatggagctttcacagattgctggtcatctgatgacaccacccatttctccagccatggcaagccgaggaagtgtcattaaccaaggaccaatggcagggaggcccccaagtgtgggcccagtactgtcagctccatcacactgctccacatacccagagcccatttatcccgctctccctcaagccaatcatgacttttatagcaccagctctaactaccagactgtgtttagggcacagccccactccacatcaggactctatcctcatcacaccgagcatggtcgatgcatggcttggactgaacagcagctttcaagagacttcttcagtggcagctgtgcggggtctccatataactcccggccaccgtctagctatggcccatccctgcaagcccaggattcacacaatatgcagtttttaaatacaggaagcttcaatttcttgagcaacacaggagctgccagctgccaaggagcaacactgcctcctaattcaccaaatggatactatggaagcaacataaactacccagagtctcacaggctcggatcaatggtgaatcagcacgtttctgtcatcagcagcattcgttcactgcccccctacagtgacatccacgatccacttaacattttagatgacagtggtagaaaacagaccagctcgttttacacagacacatcatctccagttgcatgtcgaactccagtcctagcttccagtttgcaaaccccaattccttcttcctcatcccaatgtatgtatggaacttccaaccagtatccagctcaagaaaccctggactcccatggaacaagcagtagagaaatggtgtcctctttaccacctatcaacactgtgttcatgggaacagcagctggaggcacttaaaccaccaatgtgggagggggtgctaaaactttaaaaaaaatctctactgtgcaaatatcattattcactcagacttccataagagtaaataaaaatgaatatgcagtggctgacattgttttaaagtcactggtactatggacaactccatagtgaatggagatacttgcagagcttgtcatgcacactaagagtttaaaatgtgagctcattattaatcatagtttcaaaattatcaaataaaaccagtgaagatctgaagatgcaaacatttcaactatgaagatttacatttcactttctaatttattaaacatctgtgtgcctttttatctttggtttcttttaaaaagtatatttaatgcctttacaatacctttaatttattaggatctcagaatcattgtttactatcccttatttgacaaaaagtcaaatgtgtatgttctacctccaacggaaatgtttacaaggtcaagacttaattcaattcagacaagaccaaagttgcttgacttcaattcctgtgcattagtgtgatgatttctgtcacatagcagcattccgattctatgtaactgaatggagatgataagtgctttcccctctttatttaaaaaagattaaaaggaataaaagaaataaaaaaaaaaaaaaaaaaaaaaaaaaaagaaaaaaaaaaaaaaaa

SEQ ID NO: 58844 - DNA, 3371 bp, Homo sapiens
agcgggttccattcccgggggattggagtagcgttggagtcaccgacgccatcccctcccgcctctggcgtagcaggagcatgcgcttccttcctcacttcctctccaggagggagcgagagtaaagctacgccctggcgcgcagtctccgcgtcacaggaacttcagcacccacagggcggacagcgctcccctctacctggagacttgactcccgcgcgccccaaccctgcttatcccttgaccgtcgagtgtcagagatcctgcagccgcccagtcccggcccctctcccgccccacacccaccctcctggctcttcctgtttttactcctccttttcattcataacaaaagctacagctccaggagcccagcgccgggctgtgacccaagccgagcgtggaagaatggggttcctcgggaccggcacttggattctggtgttagtgctcccgattcaagctttccccaaacctggaggaagccaagacaaatctctacataatagagaattaagtgcagaaagacctttgaatgaacagattgctgaagcagaagaagacaagattaaaaaaacatatcctccagaaaacaagccaggtcagagcaactattcttttgttgataacttgaacctgctaaaggcaataacagaaaaggaaaaaattgagaaagaaagacaatctataagaagctccccacttgataataagttgaatgtggaagatgttgattcaaccaagaatcgaaaactgatcgatgattatgactctactaagagtggattggatcataaatttcaagatgatccagatggtcttcatcaactagacgggactcctttaaccgctgaagacattgtccataaaatcgctgccaggatttatgaagaaaatgacagagccgtgtttgacaagattgtttctaaactacttaatctcggccttatcacagaaagccaagcacatacactggaagatgaagtagcagaggttttacaaaaattaatctcaaaggaagccaacaattatgaggaggatcccaataagcccacaagctggactgagaatcaggctggaaaaataccagagaaagtgactccaatggcagcaattcaagatggtcttgctaagggagaaaacgatgaaacagtatctaacacattaaccttgacaaatggcttggaaaggagaactaaaacctacagtgaagacaactttgaggaactccaatatttcccaaatttctatgcgctactgaaaagtattgattcagaaaaagaagcaaaagagaaagaaacactgattactatcatgaaaacactgattgactttgtgaagatgatggtgaaatatggaacaatatctccagaagaaggtgtttcctaccttgaaaacttggatgaaatgattgctcttcagaccaaaaacaagctagaaaaaaatgctactgacaatataagcaagcttttcccagcaccatcagagaagagtcatgaagaaacagacagtaccaaggaagaagcagctaagatggaaaaggaatatggaagcttgaaggattccacaaaagatgataactccaacccaggaggaaagacagatgaacccaaaggaaaaacagaagcctatttggaagccatcagaaaaaatattgaatggttgaagaaacatgacaaaaagggaaataaagaagattatgacctttcaaagatgagagacttcatcaataaacaagctgatgcttatgtggagaaaggcatccttgacaaggaagaagccgaggccatcaagcgcatttatagcagcctgtaaaaatggcaaaagatccaggagtctttcaactgtttcagaaaacataatatagcttaaaacacttctaattctgtgattaaaattttttgacccaagggttattagaaagtgctgaatttacagtagttaaccttttacaagtggttaaaacatagctttcttcccgtaaaaactatctgaaagtaaagttgtatgtaagctgagattttgtatacagaatccttatttcctcatagacttatattttataatcagaatatgttgctttgaaaaagcctctaatggactgaccttaaaactcatccttcttccactgtctcatccacataagcactccccgaagaattaagggggttctgttttcaaggcatgccaagtactaaagcaccttgcagagcgtgtctattacaagatgtcatttccaccagcagttcccttaggggagctgaaataaattcacattttctcaaagtctcatagctttggaggagccatctgcttttttggctgctctttttagctggctttttattaggctcagtgacataaaaaggatccaggtaaatgggtataggatttgctggatttactaacaatttccccctgttcttaacacttcctattagtgacttttcagacattgagtttacttataaagagagatatttatgtactctctaagaagacaaatgaggtcataaacactgcataaagcaaggcaaaaatgtatgccacatctcagttatctaaactagattagatccaagccaagttttctcaacagagagcaaagggccaggcagtaaggtagaaatagagataaaaatcattccttccttgtgatccaaagctggtcgagcagctttcctggaggaaaaggttaatgaacttcaggtccctgcaactcagcccccaccacaaacacagccctggaaacatacagtggcgcaaggtcctcttgaaatgttaatggttaatgttcccaaaccagagaatgctttgaaaatgtatcattcagtgtaaattaattacatacatatttttctatatatttgtttcaaactgtaaaaataacataatatgtaatttgtgtattagtgagaggtgaagccagctggacttcctgggtcgagtggggccttggagaacttttctgtcttacaagaggattgtaaaatgcacccatcagtgctctgtaaaacacaccaatcagcgctctgtagctagcaataggtttgtaaaatgcacccatcagcactctgtaaaacgcaccaatcagcactctgtaaaatgcaccaatcagcaggattctaaaagtagacaatcacagggaggattgaaaaaaagggcactctgatagggcaaaaacggaacatgggaggggacaaataagggaataaaatctggccaccccagccagcagcagcaacctgttcaggtcgcctgccgctgtggaagctttgtccttttgctcttcataataaaccttgctactgttcaaaaaaaaaaaaaaaaaaaaaaaaaaaaaaaaaaaaaaaaaaaaaaaaaaaaaaaaa

SEQ ID NO: 58845 - DNA, 1492 bp, Homo sapiens
cagccgctggttttgctgagggctgagggacggctcagcgacgccacggccagcagcgctcgcgtcctccccagcaacagttactcaaagctaatcagatagcgaaagaagcaggagagcaagtcaagaaatacggtgaaggagtccttcccaaagttgtctaggtccttccgcgccggtgcctggtcttcgtcgtcaacaccatggacagctcccgggaaccgactctggggcgcttggacgccgctggcttctggcaggtctggcagcgctttgatgcggatgaaaaaggttacatagaagagaaggaactcgatgctttctttctccacatgttgatgaaactgggtactgatgacacggtcatgaaagcaaatttgcacaaggtgaaacagcagtttatgactacccaagatgcctctaaagatggtcgcattcggatgaaagagcttgctggtatgttcttatctgaggatgaaaactttcttctgctctttcgccgggaaaacccactggacagcagcgtggagtttatgcagatttggcgcaaatatgacgctgacagcagtggctttatatcagctgctgagctccgcaacttcctccgagacctctttcttcaccacaaaaaggccatttctgaggctaaactggaagaatacactggcaccatgatgaagatttttgacagaaataaagatggtcggttggatctaaatgacttagcaaggattctggctcttcaggaaaacttccttctccaatttaaaatggatgcttgttctactgaagaaaggaaaagggactttgagaaaatctttgcctactatgatgttagtaaaacaggagccctggaaggcccagaagtggatgggtttgtcaaagacatgatggagcttgtccagcccagcatcagcggggtggaccttgataagttccgcgagattctcctgcgtcactgcgacgtgaacaaggatggaaaaattcagaagtctgagctggctttgtgtcttgggctgaaaatcaacccataatcccagactgctttgccttttgctcttactatgtttctgtgatcttgctggtagaattgtatctgtgcattgatgttgggaacacagtgggcaaactcacaaatggtgtgctattcttgggcaagaacagggacgctagggccttccttccaccggcgtgatctatccctgtctcactgaaagcccctgtgtagtgtctgtgttgttttcccttgaccctgggctttcctatcctcccaaagactcagctcccctgttagatggctctgcctgtccttccccagtcaccagggtgggggggacaggggcagctgagtgcattcattttgtgcttttcttgtgggctttctgcttagtctgaaaggtgtgtggcattcatggcaatcctgtaacttcaacatagatttttttgtgtgtgtggaaataaatctgcaattggaaacaaaaaaaaaaaaaaa

SEQ ID NO: 58846 - DNA, 1703 bp, Homo sapiens
acgaggccggccggagcccgggaccctgcgcggggcgctgagctcccgagcgggcagagggcacgggcaggcggacgtcggggcgccctcggggaacgtgcgggcaccatgcgtccccacctgtcgccgccgctgcagcagctactactgccggtgctgctcgcctgcgccgcgcactcgactggagcccttccccgactatgtgacgtgctacaagtgctgtgggaagagcaagaccagtgcctgcaggaactctccagagagcagacaggagacctgggcacggagcagccagtgccaggttgtgaggggatgtgggacaacataagctgctggccctcttctgtgccgggccggatggtggaggtggaatgcccgagattcctccggatgctcaccagcagaaatggttccttgttccgaaactgcacacaggatggctggtcagaaaccttccccaggcctaatctggcctgtggcgttaatgtgaacgactcttccaacgagaagcggcactcctacctgctgaagctgaaagtcatgtacaccgtgggctacagctcctccctggtcatgctcctggtcgcccttggcatcctctgtgctttccggaggctccactgcactcgcaactacatccacatgcacctgttcgtgtccttcatccttcgtgccctgtccaacttcatcaaggacgccgtgctcttctcctcagatgatgtcacctactgcgatccgcacagggcgggctgcaagctggtcatggtgctgttccagtactgcatcatggccaactactcctggctgctggtggaaggcctctaccttcacacactcctcgccatctccttcttctctgaaagaaagtacctccagggatttgtggcattcggatggggttctccagccatttttgttgctttgtgggctattgccagacactttctggaagatgttgggtgctgggacatcaatgccaacgcatccatctggtggatcattcgtggtcctgtgatcctctccatcctgattaatttcatccttttcataaacattctaagaatcctgatgagaaaacttagaacccaagaaacaagaggaaatgaagtcagccattataagcgcctggccaggtccactctcctgctgatccccctctttggcatccactacatcgtcttcgccttctccccagaggacgctatggagatccagctgttttttgaactagcccttggctcattccagggactggtggtggccgtcctctactgcttcctcaatggggaggtgcagctggaggttcagaagaagtggcagcaatggcacctccgtgagttcccactgcaccccgtggcctccttcagcaacagcaccaaggccagccacttggagcagagccagggcacctgcaggaccagcatcatctgagaggctggagcagggtcacccacggacagagaccaagagaggtcctgcgaaggctgggcactgctgtgggacagccagtcttcccagcagacaccctgtgtcctccttcagctgaagatgcccctccccaggccttggactcttccgaagggatgtgaggcactgtggggcaggacaagggcctgggatttggttcgtttgctcttctgggaagagaagttcaggggtcccagaaagggacagggaaataaatggtgcctgggatgagattc

SEQ ID NO: 58847 - DNA, 1152 bp, Homo sapiens
cgctcctcgggctgcccctcggttgacaatggtctccaggatggtctctaccatgctatctggcctactgttttggctggcatctggatggactccagcatttgcttacagcccccggacccctgaccgggtctcagaagcagatatccagaggctgcttcatggtgttatggagcaattgggcattgccaggccccgagtggaatatccagctcaccaggccatgaatcttgtgggcccccagagcattgaaggtggagctcatgaaggacttcagcatttgggtccttttggcaacatccccaacatcgtggcagagttgactggagacaacattcctaaggactttagtgaggatcaggggtacccagaccctccaaatccctgtcctgttggaaaaacagatgatggatgtctagaaaacacccctgacactgcagagttcagtcgagagttccagttgcaccagcatctctttgatccggaacatgactatccaggcttgggcaagtggaacaagaaactcctttacgagaagatgaagggaggagagagacgaaagcggaggagtgtcaatccatatctacaaggacagagactggataatgttgttgcaaagaagtctgtcccccatttttcagatgaggataaggatccagagtaaagagaagatgctagacgaaaacccacattacctgttaggcctcagcatggcttatgtgcacgtgtaaatggagtccctgtgaatgacagcatgtttcttacatagataattatggatacaaagcagctgtatgtagatagtgtattgtcttcacaccgatgattctgctttttgctaaattagaataagagcttttttgtttcttgggtttttaaaatgtgaatctgcaatgatcataaaaattaaaatgtgaatgtcaacaataaaaagcaagactatgaaaggctcagatttcttgcagtttaaaatggtgtctgaggttgtactattttggccaagtctgtagaaagctgtcatttgattttgattatgtagttcatccagcccttgggcattgttatacaccagtaaagaaggctgtactcaagaggaggagctgacacatttcacttggctgcgtcttaataaacatgaatgcaagcattggc

SEQ ID NO: 58848 - DNA, 2473 bp, Homo sapiens
gagacacgggagcgcttggcacgcggagccagagccggagctgcagccgcagcgggagccgggggagctcaggggccgcaggagccgggccggagtgagcgcacctcgcggggccctcggggcaggtgggtgagcgccacccggagtcccgcgcgcaactttcagggcgcactcggcggggcggctgcgcggctgccgggactcggcgcgggactgcatggaggccaaggagaagcagcatctgttggacgccaggccggcaatccggtcatacacgggatctctgtggcaggaaggggctggctggattcctctgccccgacctggcctggacttgcaggccattgagctggctgcccagagcaaccatcactgccatgctcagaagggtcctgacagtcactgtgaccccaagaaggggaaggcccagcgccagctgtatgtagcctctgccatctgcctgttgttcatgatcggagaagtcgttggtgggtacctggcacacagcttggctgtcatgactgacgcagcacacctgctcactgactttgccagcatgctcatcagcctcttctccctctggatgtcctcccggccagccaccaagaccatgaactttggctggcagagagctgagatcttgggagccctggtctctgtactgtccatctgggtcgtgacgggggtactggtgtacctggctgtggagcggctgatctctggggactatgaaattgacggggggaccatgctgatcacgtcgggctgcgctgtggctgtgaacatcataatggggttgacccttcaccagtctggccatgggcacagccacggcaccaccaaccagcaggaggagaaccccagcgtccgagctgccttcatccatgtgatcggcgactttatgcagagcatgggtgtcctagtggcagcctatattttatacttcaagccagaatacaagtatgtagaccccatctgcaccttcgtcttctccatcctggtcctggggacaaccttgaccatcctgagagatgtgatcctggtgttgatggaagggacccccaagggcgttgacttcacagctgttcgtgatctgctgctgtcggtggagggggtagaagccctgcacagcctgcatatctgggcactgacggtggcccagcctgttctgtctgtccacatcgccattgctcagaatacagacgcccaggctgtgctgaagacagccagcagccgcctccaagggaagttccacttccacaccgtgaccatccagatcgaggactactcggaggacatgaaggactgtcaggcatgccagggcccctcagactgactgctcagccaggcaccaactggggcatgaacaggacctgcaggtggctggactgagtgtcccccaggcccagccaggactttgcctaccccagctgtgttgtaaaccaggtccccctcctgacctctgccccactccaggaatggagctcttcccagcctcccatctgactacagccagggtggggactcagcgggtataaagctagtgtgaccctgctcttccagctcctgggccagctctggaagggctgtatttgggcctaatcctcagcaactgttctaccactcgcaggggcaaaggtggtgagccacgggacgtccaaggggaggctggccccagcgcgcccatactgcctgcctcatgccccattctcagcctggctggcctttgcctttatgaatctgagcccctccatctgcctatagcaataggcacgggggtgaggaccctcacactctcatttgagcctccctgaggcagggagccaggaggcacctgaggcctatctgtgccttagtcacttcagctatgagccaaatgttccctttcctggaggggagaggcttcttactaggtaagagacaggtttcctctttccttatttcctcagctgtgccaacacaaaaaacaactttggcacaggtggtgggcagggggtagagagatttcagcttgggttctgcactaacagcctccaagccccctggcacttctgttgccctgagagtgtcccaggggattcagagtctccagaaagatatggctgggccaactctgttgcctacctggcctgacccagtcggagcctgacatggtggagggaaagggagacaagtggggctgcactcggtccagaggccagctaggagggaaaccgcagcttcctggggcttgtgtgtgaagattcctgacttaggggtggcttttgtttacaagatgcaagaggggaaacctgtccccgactcatcgagacaacatgcccagttatcagggagtcctgtgtcacaaggtctgtctctgccattgtaagcaagtgccttgggcgagctggcctctgccccacagtctcatctgtacaccgacagggttgatgcctccctcacagggttgagaacaagagccagttggccaagt

SEQ ID NO: 58849 - DNA, 2326 bp, Homo sapiens
gagacacgggagcgcttggcacgcggagccagagccggagctgcagccgcagcgggagccgggggagctcaggggccgcaggagccgggccggagtgagcgcacctcgcggggccctcggggcaggtgggtgagcgccacccggagtcccgcgcgcaactttcagggcgcactcggcggggcggctgcgcggctgccgggactcggcgcgggactgcatggaggccaaggagaagcagcatctgttggacgccaggccggcaatccggtcatacacgggatctctgtggcaggaaggggctggctggattcctctgccccgacctggcctggacttgcaggccattgagctggctgcccagagcaaccatcactgccatgctcagaagggtcctgacagtcactgtgaccccaagaaggggaaggcccagcgccagctgtatgtagcctctgccatctgcctgttgttcatgatcggagaagtcgttgagatcttgggagccctggtctctgtactgtccatctgggtcgtgacgggggtactggtgtacctggctgtggagcggctgatctctggggactatgaaattgacggggggaccatgctgatcacgtcgggctgcgctgtggctgtgaacatcataatggggttgacccttcaccagtctggccatgggcacagccacggcaccaccaaccagcaggaggagaaccccagcgtccgagctgccttcatccatgtgatcggcgactttatgcagagcatgggtgtcctagtggcagcctatattttatacttcaagccagaatacaagtatgtagaccccatctgcaccttcgtcttctccatcctggtcctggggacaaccttgaccatcctgagagatgtgatcctggtgttgatggaagggacccccaagggcgttgacttcacagctgttcgtgatctgctgctgtcggtggagggggtagaagccctgcacagcctgcatatctgggcactgacggtggcccagcctgttctgtctgtccacatcgccattgctcagaatacagacgcccaggctgtgctgaagacagccagcagccgcctccaagggaagttccacttccacaccgtgaccatccagatcgaggactactcggaggacatgaaggactgtcaggcatgccagggcccctcagactgactgctcagccaggcaccaactggggcatgaacaggacctgcaggtggctggactgagtgtcccccaggcccagccaggactttgcctaccccagctgtgttgtaaaccaggtccccctcctgacctctgccccactccaggaatggagctcttcccagcctcccatctgactacagccagggtggggactcagcgggtataaagctagtgtgaccctgctcttccagctcctgggccagctctggaagggctgtatttgggcctaatcctcagcaactgttctaccactcgcaggggcaaaggtggtgagccacgggacgtccaaggggaggctggccccagcgcgcccatactgcctgcctcatgccccattctcagcctggctggcctttgcctttatgaatctgagcccctccatctgcctatagcaataggcacgggggtgaggaccctcacactctcatttgagcctccctgaggcagggagccaggaggcacctgaggcctatctgtgccttagtcacttcagctatgagccaaatgttccctttcctggaggggagaggcttcttactaggtaagagacaggtttcctctttccttatttcctcagctgtgccaacacaaaaaacaactttggcacaggtggtgggcagggggtagagagatttcagcttgggttctgcactaacagcctccaagccccctggcacttctgttgccctgagagtgtcccaggggattcagagtctccagaaagatatggctgggccaactctgttgcctacctggcctgacccagtcggagcctgacatggtggagggaaagggagacaagtggggctgcactcggtccagaggccagctaggagggaaaccgcagcttcctggggcttgtgtgtgaagattcctgacttaggggtggcttttgtttacaagatgcaagaggggaaacctgtccccgactcatcgagacaacatgcccagttatcagggagtcctgtgtcacaaggtctgtctctgccattgtaagcaagtgccttgggcgagctggcctctgccccacagtctcatctgtacaccgacagggttgatgcctccctcacagggttgagaacaagagccagttggccaagt

SEQ ID NO: 58850 - DNA, 5373 bp, Homo sapiens
agcagtttttgtaggtgaaaacaatgaagccaggtaatattgcaaggaggctgtaattttagcagacctaccaacaacactgatgtaggaagctcattattttaatttctggagccttttaattttttctttagaaagtgtataaataattgcagtgctgctttgcttccaaaactgggcagtgagttcaacaacaacgacaacaacagccgcagctcatcctggccgtcatggagtttcttgaaagaacgtatcttgtgaatgataaagctgccaagatgtatgctttcacactagaaagtgtggaactccaacagaaaccggtgaataaagatcagtgtcccagagagagaccagaggagctggagtcaggaggcatgtaccactgccacagtggctccaagcccacagaaaagggggcgaatgagtacgcctatgccaagtggaaactctgttctgcttcagcaatatgcttcattttcatgattgcagaggtcgtgggtgggcacattgctgggagtcttgctgttgtcacagatgctgcccacctcttaattgacctgaccagtttcctgctcagtctcttctccctgtggttgtcatcgaagcctccctctaagcggctgacatttggatggcaccgagcagagatccttggtgccctgctctccatcctgtgcatctgggtggtgactggcgtgctagtgtacctggcatgtgagcgcctgctgtatcctgattaccagatccaggcgactgtgatgatcatcgtttccagctgcgcagtggcggccaacattgtactaactgtggttttgcaccagagatgccttggccacaatcacaaggaagtacaagccaatgccagcgtcagagctgcttttgtgcatgcccttggagatctatttcagagtatcagtgtgctaattagtgcacttattatctactttaagccagagtataaaatagccgacccaatctgcacattcatcttttccatcctggtcttggccagcaccatcactatcttaaaggacttctccatcttactcatggaaggtgtgccaaagagcctgaattacagtggtgtgaaagagcttattttagcagtcgacggggtgctgtctgtgcacagcctgcacatctggtctctaacaatgaatcaagtaattctctcagctcatgttgctacagcagccagccgggacagccaagtggttcggagagaaattgctaaagcccttagcaaaagctttacgatgcactcactcaccattcagatggaatctccagttgaccaggaccccgactgccttttctgtgaagacccctgtgactagctcagtcacaccgtcagtttcccaaatttgacaggccaccttcaaacatgctgctatgcagtttctgcatcatagaaaataaggaaccaaaggaagaaattcatgtcatggtgcaatgcacattttatctatttatttagttccattcaccatgaaggaagaggcactgagatccatcaatcaattggattatatactgatcagtagctgtgttcaattgcaggaatgtgtatatagattattcctgagtggagccgaagtaacagctgtttgtaactatcggcaataccaaattcatctcccttccaataatgcatcttgagaacacataggtaaatttgaactcaggaaagtcttactagaaatcagtggaagggacaaatagtcacaaaattttaccaaaacattagaaacaaaaaataaggagagccaagtcaggaataaaagtgactctgtatgctaacgccacattagaacttggttctctcaccaagctgtaatgtgatttttttttctactctgaattggaaatatgtatgaatatacagagaagtgcttacaactaatttttatttacttgtcacattttggcaataaatccctcttatttctaaattctaacttgtttatttcaaaactttatataatcactgttcaaaaggaaatattttcacctaccagagtgcttaaacactggcaccagccaaagaatgtggttgtagagacccagaagtcttcaagaacagccgacaaaaacattcgagttgaccccaccaagttgttgccacagataatttagatatttacctgcaagaaggaataaagcagatgcaaccaattcattcagtccacgagcatgatgtgagcactgctttgtgctagacattgggcttagcattgaaactataaagaggaatcagacgcagcaagtgcttctgtgttctggtagcaactcaacactatctgtggagagtaaactgaagatgtgcaggccaacattctggaaatcctatgtcaatgggtttggtttggaacctggacttctgcatttttaaaagttacccagagatgcttctaaagatgagccatagtctagaagattgtcaaccacaggagttcattgagtgggacagctagacacatacattggcagctacaatagtatcatgaattgcaatgatgtagtggggtataaaaggaaagcgatggatattgccggatgggcatggccagtgatgtttcacgtcattgaggtgacagctctgctggactttgaattacatatggaggctctccaggaagacgaagaagagaaggacattctaggcaaaaagaagactaggcacaaggcacacttatgtttgtctgttagcttttagttgaaaaagcaaaatacatgatgcaaagaaacctctccacgctgtgatttttaaaactacatactttttgcaactttatggttatgagtattgtagagaacaggagataggtcttagatgatttttatgttgttgtcagactctagcaaggtactagaaacctagcaggcattaataattgttgaggcaatgactctgaggctatatctgggccttgtcattatttatcatttatatttgtatttttttctgaaatttgagggccaagaaaacattgactttgactgaggaggtcacatctgtgccatctctgcaaatcaatcagcaccactgaaataactacttagcattctgctgagctttccctgctcagtagagacaaatatactcatcccccacctcagtgagcttgtttaggcaaccaggattagagctgctcaggttcccaacgtctcctgccacatcgggttctcaaaatggaaagaatggtttatgccaaatcacttttcctgtctgaaggaccactgaatggttttgtttttccatattttgcataggacgccctaaagactaggtgacttggcaaacacacaagtgttagtataattctttgcttctgcttctttttgaaaatcatgtttagatttgattttaagtcagaaattcactgaatgtcaggtaatcattatggagggagatttgtgtgtcaaccaaagtaattgtcccatggccccagggtatttctgttgtttccctgaaattctgcttttttagtcagctagattgaaaactctgaacagtagatgtttatatggcaaaatgcaagacaatctacaagggagattttaaggattttgagatgaaaaaacagatgctactcaggggctttatgaaccatccatcaattctgaagttctgactctcccattaccctttccctggtgtggtcagaactccaggtcactggaagttagtggaatcatgtagttgaattctttacttcaagacattgtattctctccagctatcaaaacattaatgatcttttatgtcttttttttgttattgttatactttaagttctggggtacatgtgcggaacatgtaggtttgttacataggtatacatgtgccatggtggtttgctgcactcatcaacctgtcatctacattcttttatgtctgtctttcaaagcaacactctgttcttctgagtagtgaaatcaggtcaactttaccaccagcctccatttttaatatgcttcaccatcatccagcacctacttaagatttatctagggctctgtggtgatgttaggacccataaaagaaatttatgccttccatatgtttggttacagatgggaaatgggaatgttgaaggacatgaaagaaaggatgtttacacattaagcatcagttctgaagctagattgtctgagtttgaatcttagctcttccctttattagctctgtgacctcgagctagttacttaaatgctctgatcctctatttcctgatcagtgaaacctccctattcaaatgtgtgagagtttaataaattaggacacttaaaaatgttggagcagtgcatagcatgtagtgttcagtacatgttaaatgttgttttttattatgtacaaacatgagtgggcacagaattttaaatcatctcaacttttgagaaattttgagttatcaacaccgttcccacaagacagtggcaaaattattggtgagaattaaacagctgtttctcagaggaagcaatggaggcttgctgggataaaggcatttactgagaggctgttacctagtgagagtgatgaattaattaaaatagtcgaatccctttctgactgtctctgaaagcttccgcttttatctttgaagagcagaattgtcactccaaggacatttattaataaaaagaacaactgtccagtgcaatgaaggcaaagtcataggtctcccaagtcttaccccattcctgtgaaatatcaagttcttggcttttctctgtcatgtagcctcaactttctctgaccgggtgcatttctttctctggtttctaaattgccagtggcaaatttggatcacttacttaatatctgttaaattttgtgacccaacaaagtcttttagcactgtggtgtcaaaaagaaaaacacctcccaggcatatacattttatagattcctggagaatgttgctctccagctccatccccacccaatgaaatatgatccagagagtcttgcaaagagacaagcctcattttccacaattagctctaaagtgcctccaggaaatgattttctcagctcatctctctgtattccctgttttggatcacagggcaatctgtttaaatgactaattacagaaatcattaaaggcaccaagcaaatgtcatctctgaatacacacatcccaagctttacaaatcctgcctggcttgacagtgatgaggccacttaacagtccagcgcaggcggatgttaaaaaaaataaaaaggtgaccatctgcggtttagttttttaactttctgatttcacacttaacgtctgtcattctgttactgggcacctgtttaaattctattttaaaatgttaatgtgtgttgtttaaaataaaatcaagaaagagaga

SEQ ID NO: 58851 - DNA, 665 bp, Homo sapiens
gggagacggttgagagcacacaagccgctttaggagcgaggttcggagccatcgctgctgcctgctgatccgcgcctagagtttgaccagccactctccagctcggctttcgcggcgccgagatgctgtcctgccgcctccagtgcgcgctggctgcgctgtccatcgtcctggccctgggctgtgtcaccggcgctccctcggaccccagactccgtcagtttctgcagaagtccctggctgctgccgcggggaagcaggaactggccaagtacttcttggcagagctgctgtctgaacccaaccagacggagaatgatgccctggaacctgaagatctgtcccaggctgctgagcaggatgaaatgaggcttgagctgcagagatctgctaactcaaacccggctatggcaccccgagaacgcaaagctggctgcaagaatttcttctggaagactttcacatcctgttagctttcttaactagtattgtccatatcagacctctgatccctcgcccccacaccccatctctcttccctaatcctccaagtcttcagcgagacccttgcattagaaactgaaaactgtaaatacaaaataaaattatggtgaaattatgaaaaatgtgaaaaaaaaaaaaaaaaaaaaaaaaaaaaaaaaaaa

SEQ ID NO: 58852 - DNA, 6183 bp, Homo sapiens
ctttttgtagggagaagggcaggatgtttttaactgaatgtgacctcaggggaatactagagaaaataataaaatttctgaatggggcagcgtggagaaatcctaagagaaatagcataagagcattttggaacacatccaggaaaagataactttcgacacacctgtagacgttcgccaggtaaaggagtgatggaaactctccagttcagatccagtagcttttagggaaggaactacagttgctgacttaagttgaagaagcatctatttaatgtctggtcaaatcctacaagaaacacagaaatctatgattaaaaagctgagcactttgatatactgcaaagggtagagaaggcaggacggtagaaattttctgcaagaaagaatgaatttcaggatttatcactaaataagacaaagtcatttatttagtccccctgacacagcagggcaaactgagttgacatacaagttacctggagaaaaagagagcaattccaggacttcctcttcagcctaaaagaaggtaccagatctgtgcactggggcgatgtggaagagacctgcttattgcccctgatgtaagctccagtaagaaaagacgtcaagtacaagtactaggaaatcactttatacatctgtttataggaatgacctcaggactttgtgttcatgttatagatggatgcagaggctgaagataaaacgctgcgtactcgctctaaaggaaccgaggtgccaatggattcactaatccaggagctcagtgttgcctatgattgctccatggcaaagaagagaacagctgaagatcaggctttgggggttccagtcaacaaaaggaaatccctgctaatgaagccccgacactacagcccaaaagcagactgccaagaagaccgcagtgacaggacagaggacgatggccccttggaaacacatggtcactctaccgcagaggaaatcatgataaaacctatggatgaaagtcttctttcaactgcacaagaaaactccagtaggaaggaagacagatactcttgttatcaagagctcatggtcaagtctttaatgcacttggggaaatttgaaaaaaatgtatctgttcagactgtaagtgaaaatttaaatgacagtggcatccagtctttaaaagcagagagcgatgaagcagacgagtgctttctgattcattctgatgatggaagagacaagattgatgattctcagccacccttctgctcctctgatgacaatgaaagtaactctgaaagtgcagaaaatggctgggacagtggctccaacttctcagaagaaaccaaaccacctagagtcccaaagtatgttttaacagatcataaaaaagacctattggaagttcctgaaataaaaactgaaggtgacaaatttatcccttgtgagaacaggtgtgattctgaaacagaaaggaaagacccgcagaatgctctcgcagaacccctggatggcaatgcccagccctcattccctgacgttgaggaggaagatagcgagagcctggcagtaatgacggaagagggtagtgacctggaaaaggccaaggggaatttaagtttgctggagcaggcaattgctctgcaggctgagcgaggttgtgttttccataacacctacaaagagctggataggttcctgctggagcacctagcaggggaaaggaggcaaaccaaagttatcgacatgggtggaagacaaatctttaacaataaacattcaccaaggcctgaaaagagggagaccaagtgcccgatccctggatgtgatggcacgggacacgtgacagggctctacccgcaccaccgcagcctttcggggtgcccccacaaagtgcgggttcccctggaaattcttgccatgcatgaaaatgtgctcaagtgtcccacgccgggatgcacaggaaggggtcatgtgaacagcaaccgcaacacccacaggagtctttctggttgtccaattgctgcagctgaaaaattggcaatgtcccaggataaaaatcagcttgattctccccaaactgggcagtgtcctgaccaggcccacaggacaagtttggtgaagcaaattgaattcaatttcccgtcacaagccatcacctctcccagagccacagtgtcaaaagaacaagagaagtttggaaaagtaccatttgattatgccagttttgatgcccaagttttcggtaaacgccctctcatacaaacagtgcaaggacgaaaaacaccaccatttcctgaatcaaagcattttccaaatccagtgaaatttcctaatcgactgcctagtgcaggcgcccacacccagagccctggccgtgccagctcttatagctacggtcaatgtagtgaagacacccacatagcagcagctgctgccatcctgaacctttccacccgctgcagggaagccacagacatcctctccaacaagccacagagtctgcatgccaagggagccgaaatagaagtggatgaaaatggcacattggacttaagcatgaaaaaaaatcgaatcctggacaagtctgcacccctaacttcctctaacacttctattccaactccttcctcttccccattcaaaacaagcagcattctggtcaatgcagcattctatcaggctctttgtgaccaagagggctgggacactcctatcaactatagcaaaactcacgggaagacagaggaggagaaagagaaagacccagtgagctctctagaaaatttagaggaaaaaaagtttcctggagaggcctctataccaagccctaaacccaagcttcatgcaagagatctcaaaaaggaactaatcacctgtccaacaccaggatgtgatggaagtggccacgtgacaggaaactatgcatctcatcgcagtgtttctggatgtcctttagcagataagactctaaaatccctcatggctgccaactctcaggagcttaagtgtccaaccccaggctgcgatggctcggggcacgtgactggaaactatgcttcccacagaagcttgtccggatgccctcgtgcaaggaaaggtggtgtcaaaatgacccctaccaaggaagaaaaagaagaccctgaactgaaatgtcctgtgatagggtgtgatggccaaggtcacatatcaggtaaatacacatcacaccgcacagcttctggctgtcctctggctgccaagagacagaaggagaatcctctcaatggagcctccctctcctggaaactgaacaaacaagagctaccacattgtcccttgccaggctgcaatgggctgggccatgtaaataatgtttttgtcacccaccgaagcttatctggatgtcctctcaatgcacaagttatcaaaaagggcaaggtttctgaagaactcatgaccatcaagctcaaagcaactgggggaatagagagtgatgaagaaattaggcatttggatgaagaaataaaggaactgaatgaatccaaccttaaaattgaagcagatatgatgaaacttcagacccagatcacatctatggagagcaacttaaagacgatagaggaggagaacaaactcatagaacagaacaatgaaagtctgctgaaagagctggcaggtctaagccaagctctcatttcaagccttgctgacatccagcttccacagatgggacctatcagtgagcagaattttgaagcatatgtaaatacactcacagatatgtacagcaatctggaacgggactattccccggaatgcaaagctctactggaaagtatcaaacaggcagtgaagggtatccatgtgtaggatcacagcgctgccgggcaacagaagttaccaacagcagtaaactccagatggatctgttagaggttcatgtactgctaaggcgtggaggttgccgtactgcatttacaatttgcaacattgcactaattttattttccccagctgatataaaaaggaaagaaaaactatgatagacttcttggattaaaagcaatgcagtcaattattagatcttatttattttcatatgtttttcttttatttcttcattgtactcttcttttgtaaagtatatgtaaaataaatgtgacatttttataatttatttattactaatcaaagagttttttatcttttaactgcattttgaagtctgccgtatttttacaagtgtgtttattaatttattttccaataggatttaaatagaaatgctattctcaagtcatctttcttgctgggttttaatgaggaaacaggaaagggtgaaggaaatccttgtctaaggactgcactatagttgagtttgatttttattgcacacttcttcccccacctttcactgatttttgtatttataaatgaatttgcggtaaggtgagctgcacggaaggaataagaagacaaatggcgcccactagtggggaatccgcactcacaaaagcacaggatgctggaaaacagcctgctcagaatttgttagcaataattaaatatagcaatcagcaaagtattcgacttggctggacggttttcgttaatatgaattatttatttgaaatgttttaaagaaacataagcctttttagtgatgcagatttgtctgtttgtttttcaagtcatatcagatcgttggcaactcgtatcccaagatgaaaaataagacttggtgtgaccagccaggctttcctgccatatgttggtacaatatacaagtgacaatattggtgtagatttgtacttagcaaatacaaacacatccaaatgaaaaattttgtagataccatatcccctgaaatagcatttatcttactgggttgactggaaaggaatggaaaatatagtaacacatgaaaaaatgctactccaatctgaatgattacttcaaacactggcaccttgggtctcacccaccataggaaacaagacaacattcaatttgatagaaatcttgccacaaaacttcaaatgctacaaaatatacacacacactcacacacacaggcatactcacacacagacacacacacacacacacacacagactcatccacacttcaaattgagcccacaatcttgaatttctgaacggatcagagtttcatagtttctatagtaaaggcaatgtctatttcagggattgtaaagtagttaagcattgtttcaaaagtttttttatatttattttttttaaggaaaaggtatagacaaccagctaaactgcctttttggtgtgcacacacatttcatgtgcagacgtgcctctgtgtaaatgtacacatgaacttcatgtgggcttaattttctgtgctataaacaaaagtgtttattttttattaacctcatggatatttagatggaaagtgatggcattcacaggcttgatgtattccactgttattactgttacctgcacaaatgaaaaacaatactcaacagtaattccactcccatgaaactttggtcattgttatgcattaagtggggcttatctttggtttggagttcatttgaactcttgaaccttagtttagtgaagatgaactgtctgttcttaggtagaaacggtgtttatttaaaaatcagttttaaaaaatgagctaccatatgtgctgtctattataaatgggacaccaaacaaaattttctattacagttgtgtacttgcaaacattttgctatacagtacttcatagatgcatacaaatgagctcacttattacaaagacaaacgtttaatttgctaaatattttaacaagtttgttatatattttatttaatttaaaagaaatctcttaccaacctacatatttattactataatttgctatgacttcaggttaatttatttgtgtttgcatagtttgagcaggatgttttgtgaagtatgtttgtatttatttgcctactttgtacttgatgtgttttgtaatgtgcactgaatttgttttcttttcaactatgttaatgatcaatactgtaaattgggtcttttgtaaacaaaaaggcaatgatgtatgcattttttttaatttgaggtagtttgtttgtatactgtttctccaaacacttaatatttcttacatcaaagcaacaaaattgtgttcagtgctgtacatttggtgtatggtaggaaataaaaattgataacg

SEQ ID NO: 58853 - DNA, 710 bp, Homo sapiens
caccctgtgatctgtcacttttatatacacacaggggaggggaccgtttccatagagagggaatatcacagcccacttaggaacaataccggagaagcaggagccgagaccccggagcagccacaagttcatggggacgtgcacggggccgccctcctggccctgaagctgcgccggcctccctgagcgtttcgctgcggagggaagtccactctcggggagagatgctgatgccggtccacttcctgctgctcctgctgctgctcctggggggccccaggacaggcctcccccacaagttctacaaagccaagcccatcttcagctgcctcaacaccgccctgtctgaggctgagaagggccagtgggaggatgcatccctgctgagcaagaggagcttccactacctgcgcagcagagacgcctcttcgggagaggaggaggagggcaaagagaaaaagactttccccatctctggggccaggggtggagccagaggcacccggtacagatacgtgtcccaagcacagcccaggggaaagccacgccaggacacggccaagagtccccaccgcaccaagttcaccctgtccctcgacgtccccaccaacatcatgaacctcctcttcaacatcgccaaggccaagaacctgcgtgcccaggcggccgccaatgcccacctgatggcgcaaattgggaggaagaagtag

SEQ ID NO: 58854 - DNA, 2545 bp, Homo sapiens
ccagcgtgctgaagccggagcgagctagccgcccggagccgcgccgacccagctgagcccagcccacgggacgccagacctcgaccgtcgctcctaccccggccaccgctcggagccgaggcggacgcgtcccgatcttcccctgtccccaccctgccccgaccctcctctccacctctcgcgtcgtgacaccagcgtctccggcagcctcttggtcatgaaagccctcagattgtcggcttccgccctcttctgccttctgctgatcaacgggttaggggcagcaccccctggtcgccctgaggcgcagcctcctcctctcagctctgagcataaagagccggtagccggggacgcagtgcccgggccaaaggatggcagcgccccagaggtccgaggcgctcggaattccgagccgcaggacgagggagagcttttccagggcgtggatccccgggcgctggccgcggtgctgctgcaggcactcgaccgtcccgcctcacccccggcaccaagcggctcccagcaggggccggaggaagaagcagctgaagctctgctgaccgagaccgtgcgcagccagacccacagcctcccggcgccggagagcccggagcccgcggctccgcctcgccctcagactccggagaatgggcccgaggcgagcgatccctccgaggagctcgaggcgctagcgtccctgctccaggaactgcgagatttcagtccaagtagcgccaagcgccagcaggagacggcggcagcagagacggaaacccgcacgcacacgctgacccgagtgaatctggagagcccggggccagagcgcgtatggcgcgcttcctggggagagttccaggcgcgtgtcccggagcgcgcgcccctgccgcccccggccccctctcaattccaggcgcgtatgcccgacagcgggccccttcccgaaacccacaagttcggggaaggagtgtcctcccccaaaacacacctaggcgaggcattggcacccctgtccaaggcgtaccaaggcgtggccgccccgttccccaaggcgcgccggccggagagcgcactcctgggcggctccgaggcgggcgagcgccttctccagcaagggctggcgcaggtggaggccgggcggcggcaggcggaggccacgcggcaggccgcggcgcaggaagagcggctggccgacctcgcctcggacctgctgctccagtatttgctgcagggcggggcccggcagcgcggcctcgggggtcgggggctgcaggaggcggcggaggagcgagagagtgcaagggaggaggaggaggcggagcaggagagacgcggcggggaggagagggtgggggaagaggatgaggaggcggccgaggcggaggcagaggcggaggaggcggagagggcgcggcagaacgcgctcctgttcgcggaggaggaggacggggaagccggcgccgaggacaagcgctcccaggaggagacgccgggccaccggcggaaggaggccgaggggacagaggagggcggggaggaggaggacgacgaggagatggatccgcagacgatcgacagcctcattgagctgtccaccaaactccacctgccagcggacgacgtggtcagcatcatcgaggaggtggaggagaagcggaagcggaagaagaacgcccctcccgagcccgtgccgcccccccgtgccgcccccgcccccacccacgtccgctccccgcagcccccgccccccgcccccgctcccgcacgagacgagctgccggactggaacgaggtgctcccgccctgggatcgggaggaggacgaggtgtacccgccagggccgtaccaccctttccccaactacatccggccgcggacactgcagccgccctcggccttgcgccgccgccactaccaccacgccttgccgccttcgcgccactatcccggccgggaggcccaggcgcggcgcgcgcaggaggaggcggaggcggaggagcgccggctgcaggagcaggaggagctggagaattacatcgagcacgtgctgctccggcgcccgtgactgcccttcccggtcccgcccccgcgcgcccccgccgcgcgcgcgcgccggcgcccccctccgtgttgcccgctccccctcggtgtttgcatgcgccccggccctgccccttggccctgcccctgtccccgggctgcgtcgggacctgccagacccccctcccgggtcctgagcccgaactcccagagctcacccgcgggtgaccgggggccagcccaggagggcgggtggtttgtgcgagttcccttgccacgcggggccccggccccatcaagtccctctggggacgtccccgtcggaaaccggaaaaagcagttccagttaattgtgtgaagtgtgtctgtctccagcccttcgggcctcccacgagcccctccagcctctccaagtcgctgtgaattgaccccttctttcctttctctgttgtaaatacccctcacggaggaaatagttttgctaagaaataaaagtgactatttt

SEQ ID NO: 58855 - DNA, 3088 bp, Homo sapiens
tttcgcaccatgactagcctctacggttccatccaccccgcggactcggtgtacctcagcacccgcacccacggcgccgtcttcaacctcgagtactcgcccgacgggtcagtgctgacagttgcttgtgaacaaactgaagttctgctttttgaccctatatcttcaaagcacataaaaacactttctgaagctcatgaagactgtgtaaataatatcagatttcttgataaccggctgtttgctacctgctctgatgacactacaatagcactatgggatctgagaaaattgaacaccaaagtatgcactttacatggtcacactagctgggtgaagaacatcgaatatgatactaatacaagactcttagtaacatcaggatttgatggaaatgtcattatttgggacactaacaggtatacagaagatgggtgtccacataagaaattctttcacacacgttttctcatgcgaatgaggttaacaccagattgttccaaaatgttgatttcaacgtcctctggatatctcttaattttgcatgaccttgacttaactaagtctttagaagtaggcagctatcccattttaagagcaagaagaactacttcaagttcagatttgaccacttcatcaagttcatctggtcctagagtttctggctcaccttgtcatcatagtgattctaattcttctgagaaacacatgtcacgagcctctcaaagagaaggagtttcaccacgaaatagtcttgaagtcgtaacccctgaagttcttggtgagagtgaccacggaaactgcatcacgtccttacagctgcacccaaaaggctgggccactcttcttcggtgctcaagcaacagtgatgatgaggagtgtacttgtgtctatgaattccaagaaggagctccagtgcgacctgtctcacctcgctgttctctacgactgactcattacattgaagaagccaatgtaggcaggggttacatcaaagaactttgcttcagccccgatggacgaatgatttcttccccacatggctatgggattcgcttgttgggatttgacaaacagtgcagtgaacttgttgactgcttgcccaaagaagccagtcccctgcgggtgatccgttctctgtactctcataatgatgtggtactgacaacaaagttctctccaacacattgtcagattgcctcagggtgccttagtggacgggtttctttgtatcagccaaagttttaggcacaacttacatcaaataaggaactcttctggtgtttgacttaggaattgcttcaatttagatgaagtattttctttttagaagatcttataagtttgggtcaagatcctggttcttatgggtccatgaacacacttgtgaccttagtacttggtcatccagcatcatacaggcatctccaagttagactctatgcagcatcatcttttgcagcattcctctgctcctgctgatctgtgccactgaactccagttcttctggtcattttgcatggtagctcttgtcacgttccttccttcctcactctctatttctctttccctctccctgtccctctctttctttgtgtttgttgattttggtgtcaattttgtggacatttggcaggagttttgactggggtaggagaaacccatgacattagaattgaataaaacctagaagttggatattggcatattggttgttgaaaaataaatttcatcctcacttatgagtatacttggccttttaaagttactgttatgtttatctatattgagcacagataatggcattattcttataattgttaagatagtcttgcaacaaaatgtcttttaagtttcctgttaaaattataaaaagattttcatggtgagagggattttattgtgaaattctagaaaaaaatattaccacctctctttgtaatttactttacttgtatgaatttaacatctctagcatgtatccttacttgatattttgttcctatcaacagcattagaaaggaaaggagacagaatgagctttggttatttctattgcacagaaaaggatttttaaaattagattagtataatatctggccatagagtgataagaacaatatgacttagattttctgtatttcatctgccagattatttgaatcacacaggatgatgtgttaacagtattagggtggaagaggaatcaagagtaaagaggtaggggtttactcatttttcttccctgagccaggtgtgacaagccaactctgtcaccattcgtgaggggagagttgcagtcctcttcaagctgttatcataagtacagtagtcagctacttggatatcaagactaagtgctgatatgaagacttgcctttgtgttttgttatgaaacacgcaagcataaagcaggactcaagcacaaggctgactgttctactttgaataacagcttccttgcagtctcctccacatgggtggtactgtgtttagaagggattaccaaaggctggagcgatttaagctatgcactagccttgccctcttaggttgcattctctttaggccactggttctcaaacattagggtgcactgtaaccattacagagcttgtgaaaagtgcagaaacctgagcctcaccttatgagattctgattcagccagggggaggacaggaatctgtatttttcatagcaacctcaagtaatctttattctgagggtctcgggattgcaggttgaaaaacacaaccttaatcagcagtaaattcttctctactcggccaggcgcagtggctcatgcctgtaatcccagcactttgggaggccgaggtgggtggatcacaaggtcaggagttcgagaccagcctgaccaacatggtgaaacgccatctctactaaaaatacaaaaattagccgggcgtggtggtgctcacctgtaatcccagctacccaggaggctgaggcaagagaatcacttgaacccgggaggcagagggtgcagtaagccgagattgcaccactgcactccagcctaggcgacagagcgagactctgtctcaaaaaaaaaaaaaaaaaaaaaaa

SEQ ID NO: 58856 - DNA, 2129 bp, Homo sapiens
ccggggctgagctgcggcggcgcctgacaatgccccctcgcgccccggcctcggcgcccgctcccggctccagcgcgcctgcacgtacgtagccttcacgtgtgtgtggatacggagtgcatgtgtggagacagaggaatatgctccaacaaatttcggatagaggcgccgaagacaggacgtggggaagctaaagaagtaaacaggtcatggcacgtttaacaaaaagacgacaggcggatacaaaagctatccagcatctttgggcagccattgagattatacggaaccagaagcagattgccaacattgaccgtattacaaagtatatgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattgactgggaaacagaaaatcatgactggtattgttttgaatgccatttgcctggagaggtgttgatatgtgacctgtgttttcgtgtgtatcattccaagtgtttgtctgatgagttcaggcttagagacagcagtagtccctggcagtgcccagtttgcaggagcattaagaagaagaatacaaacaaacaggagatgggcacatacctcagattcattgtctcccgcatgaaggagagggctatagatcttaataaaaaggggaaggacaataaacacccgatgtacaggaggctggtgcactcagctgtggacgttcccaccattcaagagaaagtgaatgaagggaaataccgaagttatgaagagttcaaagctgatgcccaattgcttctccacaataccgtgattttctatggagcagacagtgagcaagctgacattgcgaggatgctatataaagacacatgtcatgagctggatgaactgcagctttgcaagaattgcttttacttgtcaaatgctcgtcctgacaactggttctgttatccttgtatacctaatcatgagctggtttgggctaaaatgaaaggttttgggttttggccagccaaagtcatgcagaaagaagacaatcaagtcgacgttcgcttctttggccaccaccaccagagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcagctaaaggtcactcaagaaccaagagcaaagaaaggacgacgtaatcaaagtgtggagcccaaaaaggaagaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaagctgcgttctgaaatggaagaagaaaagagacaagctgtaaataaagctgtagccaacatgcagggtgagatggacagaaaatgtaagcaagtaaaggaaaagtgtaaggaagaatttgtagaagaaatcaagaagctggcaacacagcacaagcaactgatttctcagaccaagaagaagcagtgggtaaataccagtcttttttagacccttatttctgaaaatgtaccacaggtatgatgcccgttaattcagaaggtagctgtggcacatgcagaagatgtttctgaaataagatcaaatgtgaaatggtcagctttagttttaaaaattttattaaaagtcctatgatctctcaaaaaaaaaaaaaaaaaaaaaaaaaaaaaaaaaaaaaaaaaaaaaaaaaaaaaaaaaaaaaaa

SEQ ID NO: 58857 - DNA, 2434 bp, Homo sapiens
gcaggcgcagtggtccccgcaggcttgcgcgcgcactcgctgcgggacaagcttctggaagctctttgcggtggcgttggtgctgtttgcggatgctgatgcagtttctgcaggactgtaaactggattcctggaacctttgatattcctggctgtgtatagtgcctgttggtggactgtactgatactcaactagagtgtgaagggactggattcctgcccctgagacacaatgcaagctgtagtgcccttgaacaagatgacagccatctcaccagaacctcaaactctggcctcgactgaacaaaatgaggtcccaagagtggttacttctggggaacaagaagctattttaagaggaaatgctgctgatgcagagtctttcagacagaggtttaggtggttttgttactcagaagtagctggacccaggaaagctctgagtcaactctgggagctctgcaatcagtggctgagaccagacattcacacgaaagaacagattttagagcttctggtgtttgagcagttcctgaccattttgcctggggagatcaggatttgggtaaagtcacaacatcctgagagtagtgaggaagtggtgaccctaatagaagatttgacccagatgcttgaagaaaaagatccagtctctcaagattctactgtttcccaagaggagaactcaaaagaggataaaatggtcactgtttgtcccaatactgagtcctgtgaatctataacattgaaggatgtagctgtgaacttttcaagaggagagtggaagaagctggagccttttcaaaaggagctatataaggaagtgctactggaaaacctcaggaacctagaatttctggactttccagtttcaaaattagagttgatttcccagctaaagtgggttgaattgccatggctgctggaagaagtctcaaaaagctcccgactagacatacatggagcagtaaaaaagatgcagatgttctctgaggctgaataagaccatgctctgccttcttgtttcaactgttacacagagatgaccagaggatggggccactgcagtgcagttcaagaggctctggttcggggaagagctggatggagtatgaatcccaactctgggggtattagctagtggagtggccataggcaagttacttaacacttctgaacctccttttgtctttcataaaataaaagctactaggatgagttgttttaaggatttcagattatagtctatgtgagatatgtgcaaacatgtacatatttcccctagaagcaatggttttcagccttggtggtgaccttatagaacataaatattgtgaataatgaaaatccactgaatctaataagggacttgtatcggtaagatgtaaagaactcttggccaggtgtggtggctcatgcctataatcccagcactttgggaggccaaggcaggtggatcacctgaggtcaggagttcgagaccaacctggccaacatgacgaaactccgtctctatttaaaatacaaaaattagctgggcatggtggtgcatgcctgtaatcccagctactcgggaggctgaggcaggagaatcacttgaactcgggaggtggaggttgcagtgagccaagatcgcgccactgcactccagcctggatgacagagcaaaaaactgtctcaaaaaaaaaaaaaatcttacaacctcacaaataacctagttcaaaaatgggcaaagattttgaacagatatttctccaaagaagatatacaaatggcaaatacatacgttgaaagatccttaatattgttagccatagggaaatgcaagtcaaactcaaatcagaatgaaatatcacttcaaacctactaggatggttataataaaaaagacagacaatagcacgtgttggtgagtatgtagagaagttggaaccctcatacactgcttgtgggaatgtaaagtactgtagccactttgcaaaacagtttgacagctcctcaaaatgttaaacatgaaattatcatatgacccagcaattctactcataggtatatacttaaaagaaatgaaaaatccacacaaaaacctctgcatgaatgttcatagtaacattatacttcatagccagaaagtataagctaatacccatcaggctgggtgtggtggctcacgcctgtaatcctagcactttgggaggccgagttgggaggtttgcttgagcccaggagttccagaccagcctgggcaacatggcgaaaccccatctctactaaaaatataaaaattagttgcgtgtggtggcacatccctatagtcccagctacttgggaggctgaggtggaaggactgcttgagcgagggaggtcgaggctgcagtgagccacgatcacaccactgcactccagcctaggtgacagagtgagatcctgtctc

SEQ ID NO: 58858 - DNA, 3655 bp, Homo sapiens
cgttggtgctgtttgcggatgctgatgcagtttctgcaggactgtaaactggattcctggaacctttgatattcctggctgtgtatagtgcctgttggtggactgtactgatactcaactagagtgtgaagggactggattcctgcccctgagacacaatgcaagctgtagtgcccttgaacaagatgacagccatctcaccagaacctcaaactctggcctcgactgaacaaaatgaggtcccaagagtggttacttctggggaacaagaagctattttaagaggaaatgctgctgatgcagagtctttcagacagaggtttaggtggttttgttactcagaagtagctggacccaggaaagctctgagtcaactctgggagctctgcaatcagtggctgagaccagacattcacacgaaagaacagattttagagcttctggtgtttgagcagttcctgaccattttgcctggggagatcaggatttgggtaaagtcacaacatcctgagagtagtgaggaagtggtgaccctaatagaagatttgacccagatgcttgaagaaaaagatccagtctctcaagattctactgtttcccaagaggagaactcaaaagaggataaaatggtcactgtttgtcccaatactgagtcctgtgaatctataacattgaaggatgtagctgtgaacttttcaagaggagagtggaagaagctggagccttttcaaaaggagctatataaggaagtgctactggaaaacctcaggaacctagaatttctggactttccagtttcaaaattagagttgatttcccagctaaagtgggttgaattgccatggctgctggaagaagtctcaaaaagctcccgactagatgaatcagctttagataaaataatagaaaggtgcctcagggatgatgatcatggcttgatggaagaatcccagcaatattgtggcagctcagaggaggatcacggtaatcagggaaattcaaaaggaagagtcgcacaaaacaaaactcttgggagtggcagtaggggtaagaaatttgacccagataaaagcccctttggacataatttcaaagaaacttcagacttaattaaacatctgagagtctacttgaggaagaaatctcggaggtataatgaaagcaagaaacccttcagttttcattcagaccttgttctgaaccgcaaggagaaaaccgccggagaaaagtcacggaaatctaatgatggtgggaaagtcctgagtcactcttcagctcttactgaacatcagaaacgtcagaagattcatttgggggataggtcccaaaaatgcagtaagtgtgggataatctttattagaagatcaactctttctaggagaaaaacccctatgtgtgagaaatgtcggaaagattcatgtcaagaagcagccttaaataaagatgagggaaatgagagtggaaaaaaaactcataaatgtagtaagtgtggaaaagcctttggctatagcgcctcactcaccaaacatcggagaattcacactggagaaaaaccctatatgtgtaatgaatgtggaaaagcttttagtgatagttcatcgctcacaccacatcatagaactcatagtggagagaaacccttcaaatgtgatgactgtgggaaaggtttcaccctaagtgctcacctcattaaacatcagagaattcatactggagaaaaaccttataaatgtaaagactgtgggagaccctttagtgacagttcatctcttattcaacatcagcgaattcatactggagaaaaaccctatacatgtagcaattgtggaaaatccttcagtcatagctcatccctttccaaacatcagagaattcatactggagagaaaccctataaatgtggcgaatgtggaaaagcctttaggcagaattcatgccttacccggcatcagagaattcacactggagaaaaaccatatttgtgtaatgattgcggaatgacttttagccattttacgtctgtgatttatcatcaaagacttcattcaggagaaaaaccctacaaatgtaaccagtgtgagaaagccttcccaacccattcactgctaagtcgtcatcagagaattcatactggtgtaaaaccttataaatgtaaagaatgtgggaagtccttcagtcagagttcatctcttaatgagcaccaccgaattcatacaggagagaaaccctatgagtgtaactattgtggtgcaacctttagtcgaagctcaatccttgtagaacacctaaaaattcataccggaaggagagaatatgaatgtaacgaatgtgagaagacatttaaaagtaattcaggcctcattagacatcggggatttcactctgcagagtaatcctggaactacattaaagtggggggaatttaattcaaattgtcagttactgaaaccctgggatgtaaacttacagtattgatcagtagctgcagctttcgtaaattggcagttaggaaaaatatccttttgcccattcatccctcttcttttcaaggatggcaacgactggtaaacagtaattagttggtaaagtcactggaaagggaagaatgcaaaatgattctgaggccagacgaattggaaaagctcttttcttcaggggatttctctctgatttcttctactaccatgtagtgtgatggagagaacttgactgcagtcacataacttggattctgtcccagtttgccaaccaacttgctgtatacaccttggacaagtcatttgacctttcagaattttattttcgtcaccagcagaatgaagggatgggattaatgatttttgccttttttggttttttagttttttattggtatcctgataatctctgaagctgtggacataagttatttttttttatttgtcattactttcaagtttctctagtaaaaaatacaataccactattcaggatgctggacttcttttcttttttttttcttttttttttttcaatttttcttttttgggatggagtctcactatgttgcccagactggtcttgaactcctgggctcaagtgatccttccatctcactttcctgagtagctgacattacgggtacactccatcaagcctggttcctaggatgctggacttctagcttagtgagaatgcagtatactttttgaaaacttcgtgcaggaatccctcaaatgctgtaactaggaatgggtcagtgaagttcaaacgacttttccttgagggagtattttaatcggacaagggaactctttttcttttgggcattggccaacaggactgagaagccagagagcttgcacctgagccatctcagccgtgagagtaacagtcctaggaaaatagatgggggctgggggtaaggaaatgtgctgaagacagagctattctggatggattttggtttgcaaaaattctactttaaaacaattttgcctgtagcaagtacatttttttgcaattggagtgtaaacattctgtgtggcaacagttaaaagctgttataacaatttgcttgggtgtgtgtgcatgtgtgtgtgtgtgtgtgtgtgtgtatacattgttgccactatctaaaattagggcatttcatactaaaaacaaagcttgtctt

SEQ ID NO: 58859 - protein, 176 aa, Homo sapiens
MTMCSGARLALLVYGIIMHSSVYSSPAAAGLRFPGIRPEEEAYGEDGNPLPDFGGSEPPGAGSPASAPRAAAAWYRPAGRRDVAHGILNEAYRKVLDQLSAGKHLQSLVARGVGGSLGGGAGDDAEPLSKRHSDGIFTDSYSRYRKQMAVKKYLAAVLGKRYKQRVKNKGRRIAYL

SEQ ID NO: 58860 - protein, 560 aa, Homo sapiens
MLWTPAPPDLTLGEGEEARTWDFLTAVGGSQAEAQACLTEALQLQARGALYTAHAQAWAQLWVECGLDVVGPLQLRQALRGSLYYLLSALPQPKAPGYICHGLSPGGLSNGSREECYWGHVFWDQDLWMFPSILMFHPEAARAILEYRIRTLDGALENAQNLGYQGAKFAWESADSGLEVCPEDIYGVQEVHVNGAVVLAFELYYHTTQDLQLFREAGGWDVVRAVAEFWCSRVEWSPREEKYHLRGVMSPDEYHSGVNNSVYTNVLVQNSLRFAAALAQDLGLPIPSQWLAVADKIKVPFDVEQNFHPEFDGYEPGEVVKQADVVLLGYPVPFSLSPDVRRKNLEIYEAVTSPQGPAMTWSMFAVGWMELKDAVRARGLLDRSFANMAEPFKVWTENADGSGAVNFLTGMGGFLQAVVFGCTGFRVTRAGVTFDPVCLSGISRVSVSGIFYQGNKLNFSFSEDSVTVEVTARAGPWAPHLEAELWPSQSRLSLLPGHKVSFPRSAGRIQMSPPKLPGSSSSEFPGRTFSDVRDPLQSPLWVTLGSSSPTESLTVDPASE

SEQ ID NO: 58861 - protein, 116 aa, Homo sapiens
MKGLRSLAATTLALFLVFVFLGNSSCAPQRLLERRNWTPQAMLYLKGAQGRRFISDQSRRKDLSDRPLPERRSPNPQLLTIPEAATILLASLQKSPEDEEKNFDQTRFLEDSLLNW

SEQ ID NO: 58862 - protein, 258 aa, Homo sapiens
MLLVLVVLIPVLVSSGGPEGHYEMLGTCRMVCDPYPARGPGAGARTDGGDALSEQSGAPPPSTLVQGPQGKPGRTGKPGPPGPPGDPGPPGPVGPPGEKGEPGKPGPPGLPGAGGSGAISTATYTTVPRVAFYAGLKNPHEGYEVLKFDDVVTNLGNNYDAASGKFTCNIPGTYFFTYHVLMRGGDGTSMWADLCKNGQVRASAIAQDADQNYDYASNSVILHLDAGDEVFIKLDGGKAHGGNSNKYSTFSGFIIYSD

SEQ ID NO: 58863 - protein, 656 aa, Homo sapiens
MKCPMLRSRLGQESVHCGPMFIQVSRPLPLWRDNRQTPWLLSLRGELVASLEDASLMGLYVDMNATTVTVQSPRQGLLQRWEVSGGQQALPGVSFQPESEVLVHIPKQRLGLVKRGSYIEETLSLRLLRVHQSNIFMVTENKDFVVVSIPAAGVLQVQRCQEVGGTPGTQAFYRVDLSLEFAEMAAPVLWTVESFFQCVGSGTEPPASTAALRTTPSPPSPGPETPPAGVPPAASSQVWAAGPAAQEWLSRDLLHRPSDALAKKGLGPFLQTAKPARRGQTSASILPRVVQAQRGPQPPPGEAGIPGHPTPPATLPSEPVEGVQASPWRPRPVLPTHPALTLPVSSDASSPSPPAPRPERPESLLVSGPSVTLTEGLGTVRPEQDPAKSPGSPLLLRGLSSGDVAAPEPIMGEPGQASEEFQPLARPWRATLAAEELVSHRSPGEPQETCSGTEVERPRQTGPGLPREGARGHMDLSSSEPSQDIEGPGLSILPARDATFSTPSVRQPDPSAWLSSGPELTGMPRVRLAAPLAVLPMEPLPPEPVRPAALLTPEASSVGGPDQARYLESAPGWPVGQEEWGVAHTSSPPSTQTLSLWAPTGVLLPSLVELEYPFQAGRGASLQQELTEPTLALSAESHRPPELQDSVEGLSERPSR

SEQ ID NO: 58864 - protein, 127 aa, Homo sapiens
MGFRKFSPFLALSILVLYQAGSLQAAPFRSALESSPDPATLSKEDARLLLAALVQDYVQMKASELKQEQETQGSSSAAQKRACNTATCVTHRLAGLLSRSGGMVKSNFVPTNVGSKAFGRRRRDLQA

SEQ ID NO: 58865 - protein, 1078 aa, Homo sapiens
MAFYSCCWVLLALTWHTSAYGPDQRAQKKGDIILGGLFPIHFGVAAKDQDLKSRPESVECIRYNFRGFRWLQAMIFAIEEINSSPALLPNLTLGYRIFDTCNTVSKALEATLSFVAQNKIDSLNLDEFCNCSEHIPSTIAVVGATGSGVSTAVANLLGLFYIPQVSYASSSRLLSNKNQFKSFLRTIPNDEHQATAMADIIEYFRWNWVGTIAADDDYGRPGIEKFREEAEERDICIDFSELISQYSDEEEIQHVVEVIQNSTAKVIVVFSSGPDLEPLIKEIVRRNITGKIWLASEAWASSSLIAMPQYFHVVGGTIGFALKAGQIPGFREFLKKVHPRKSVHNGFAKEFWEETFNCHLQEGAKGPLPVDTFLRGHEESGDRFSNSSTAFRPLCTGDENISSVETPYIDYTHLRISYNVYLAVYSIAHALQDIYTCLPGRGLFTNGSCADIKKVEAWQVLKHLRHLNFTNNMGEQVTFDECGDLVGNYSIINWHLSPEDGSIVFKEVGYYNVYAKKGERLFINEEKILWSGFSREVPFSNCSRDCLAGTRKGIIEGEPTCCFECVECPDGEYSDETDASACNKCPDDFWSNENHTSCIAKEIEFLSWTEPFGIALTLFAVLGIFLTAFVLGVFIKFRNTPIVKATNRELSYLLLFSLLCCFSSSLFFIGEPQDWTCRLRQPAFGISFVLCISCILVKTNRVLLVFEAKIPTSFHRKWWGLNLQFLLVFLCTFMQIVICVIWLYTAPPSSYRNQELEDEIIFITCHEGSLMALGFLIGYTCLLAAICFFFAFKSRKLPENFNEAKFITFSMLIFFIVWISFIPAYASTYGKFVSAVEVIAILAASFGLLACIFFNKIYIILFKPSRNTIEEVRCSTAAHAFKVAARATLRRSNVSRKRSSSLGGSTGSTPSSSISSKSNSEDPFPQPERQKQQQPLALTQQEQQQQPLTLPQQQRSQQQPRCKQKVIFGSGTVTFSLSFDEPQKNAMAHRNSTHQNSLEAQKSSDTLTRHQPLLPLQCGETDLDLTVQETGLQGPVGGDQRPEVEDPEELSPALVVSSSQSFVISGGGSTVTENVVNS

SEQ ID NO: 58866 - protein, 745 aa, Homo sapiens
MLTMGRLQLVVLGLTCCWAVASAAKLGAVYTEGGFVEGVNKKLGLLGDSVDIFKGIPFAAPTKALENPQPHPGWQGTLKAKNFKKRCLQATITQDSTYGDEDCLYLNIWVPQGRKQVSRDLPVMIWIYGGAFLMGSGHGANFLNNYLYDGEEIATRGNVIVVTFNYRVGPLGFLSTGDANLPGNYGLRDQHMAIAWVKRNIAAFGGDPNNITLFGESAGGASVSLQTLSPYNKGLIRRAISQSGVALSPWVIQKNPLFWAKKVAEKVGCPVGDAARMAQCLKVTDPRALTLAYKVPLAGLEYPMLHYVGFVPVIDGDFIPADPINLYANAADIDYIAGTNNMDGHIFASIDMPAINKGNKKVTEEDFYKLVSEFTITKGLRGAKTTFDVYTESWAQDPSQENKKKTVVDFETDVLFLVPTEIALAQHRANAKSAKTYAYLFSHPSRMPVYPKWVGADHADDIQYVFGKPFATPTGYRPQDRTVSKAMIAYWTNFAKTGDPNMGDSAVPTHWEPYTTENSGYLEITKKMGSSSMKRSLRTNFLRYWTLTYLALPTVTDQEATPVPPTGDSEATPVPPTGDSETAPVPPTGDSGAPPVPPTGDSGAPPVPPTGDSGAPPVPPTGDSGAPPVPPTGDSGAPPVPPTGDSGAPPVPPTGDSGAPPVPPTGDAGPPPVPPTGDSGAPPVPPTGDSGAPPVTPTGDSETAPVPPTGDSGAPPVPPTGDSEAAPVPPTDDSKEAQMPAVIRF

SEQ ID NO: 58867 - protein, 223 aa, Homo sapiens
MTWRHHVRLLFTVSLALQIINLGNSYQREKHNGGREEVTKVATQKHRQSPLNWTSSHFGEVTGSAEGWGPEEPLPYSRAFGEGASARPRCCRNGGTCVLGSFCVCPAHFTGRYCEHDQRRSECGALEHGAWTLRACHLCRCIFGALHCLPLQTPDRCDPKDFLASHAHGPSAGGAPSLLLLLPCALLHRLLRPDAPAHPRSLVPSVLQRERRPCGRPGLGHRL

SEQ ID NO: 58868 - protein, 1480 aa, Homo sapiens
MQRSPLEKASVVSKLFFSWTRPILRKGYRQRLELSDIYQIPSVDSADNLSEKLEREWDRELASKKNPKLINALRRCFFWRFMFYGIFLYLGEVTKAVQPLLLGRIIASYDPDNKEERSIAIYLGIGLCLLFIVRTLLLHPAIFGLHHIGMQMRIAMFSLIYKKTLKLSSRVLDKISIGQLVSLLSNNLNKFDEGLALAHFVWIAPLQVALLMGLIWELLQASAFCGLGFLIVLALFQAGLGRMMMKYRDQRAGKISERLVITSEMIENIQSVKAYCWEEAMEKMIENLRQTELKLTRKAAYVRYFNSSAFFFSGFFVVFLSVLPYALIKGIILRKIFTTISFCIVLRMAVTRQFPWAVQTWYDSLGAINKIQDFLQKQEYKTLEYNLTTTEVVMENVTAFWEEGFGELFEKAKQNNNNRKTSNGDDSLFFSNFSLLGTPVLKDINFKIERGQLLAVAGSTGAGKTSLLMMIMGELEPSEGKIKHSGRISFCSQFSWIMPGTIKENIIFGVSYDEYRYRSVIKACQLEEDISKFAEKDNIVLGEGGITLSGGQRARISLARAVYKDADLYLLDSPFGYLDVLTEKEIFESCVCKLMANKTRILVTSKMEHLKKADKILILNEGSSYFYGTFSELQNLQPDFSSKLMGCDSFDQFSAERRNSILTETLHRFSLEGDAPVSWTETKKQSFKQTGEFGEKRKNSILNPINSIRKFSIVQKTPLQMNGIEEDSDEPLERRLSLVPDSEQGEAILPRISVISTGPTLQARRRQSVLNLMTHSVNQGQNIHRKTTASTRKVSLAPQANLTELDIYSRRLSQETGLEISEEINEEDLKECLFDDMESIPAVTTWNTYLRYITVHKSLIFVLIWCLVIFLAEVAASLVVLWLLGNTPLQDKGNSTHSRNNSYAVIITSTSSYYVFYIYVGVADTLLAMGFFRGLPLVHTLITVSKILHHKMLHSVLQAPMSTLNTLKAGGILNRFSKDIAILDDLLPLTIFDFIQLLLIVIGAIAVVAVLQPYIFVATVPVIVAFIMLRAYFLQTSQQLKQLESEGRSPIFTHLVTSLKGLWTLRAFGRQPYFETLFHKALNLHTANWFLYLSTLRWFQMRIEMIFVIFFIAVTFISILTTGEGEGRVGIILTLAMNIMSTLQWAVNSSIDVDSLMRSVSRVFKFIDMPTEGKPTKSTKPYKNGQLSKVMIIENSHVKKDDIWPSGGQMTVKDLTAKYTEGGNAILENISFSISPGQRVGLLGRTGSGKSTLLSAFLRLLNTEGEIQIDGVSWDSITLQQWRKAFGVIPQKVFIFSGTFRKNLDPYEQWSDQEIWKVADEVGLRSVIEQFPGKLDFVLVDGGCVLSHGHKQLMCLARSVLSKAKILLLDEPSAHLDPVTYQIIRRTLKQAFADCTVILCEHRIEAMLECQQFLVIEENKVRQYDSIQKLLNERSLFRQAISPSDRVKLFPHRNSSKCKSKPQIAALKEETEEEVQDTRL

SEQ ID NO: 58869 - protein, 457 aa, Homo sapiens
MRSAAVLALLLCAGQVTALPVNSPMNKGDTEVMKCIVEVISDTLSKPSPMPVSQECFETLRGDERILSILRHQNLLKELQDLALQGAKERAHQQKKHSGFEDELSEVLENQSSQAELKEAVEEPSSKDVMEKREDSKEAEKSGEATDGARPQALPEPMQESKAEGNNQAPGEEEEEEEEATNTHPPASLPSQKYPGPQAEGDSEGLSQGLVDREKGLSAEPGWQAKREEEEEEEEEAEAGEEAVPEEEGPTVVLNPHPSLGYKEIRKGESRSEALAVDGAGKPGAEEAQDPEGKGEQEHSQQKEEEEEMAVVPQGLFRGGKSGELEQEEERLSKEWEDSKRWSKMDQLAKELTAEKRLEGQEEEEDNRDSSMKLSFRARAYGFRGPGPQLRRGWRPSSREDSLEAGLPLQVRGYPEEKKEEEGSANRRPEDQELESLSAIEAELEKVAHQLQALRRG

SEQ ID NO: 58870 - protein, 112 aa, Homo sapiens
MEKILILLLVALSVAYAAPGPRGIIINLENGELCMNSAQCKSNCCQHSSALGLARCTSMASENSECSVKTLYGIYYKCPCERGLTCEGDKTIVGSITNTNFGICHDAGRSKQ

SEQ ID NO: 58871 - protein, 694 aa, Homo sapiens
MAKINTQYSHPSRTHLKVKTSDRDLNRAENGLSRAHSSSEETSSVLQPGIAMETRGLADSGQGSFTGQGIARLSRLIFLLRRWAARHVHHQDQGPDSFPDRFRGAELKEVSSQESNAQANVGSQEPADRGRSAWPLAKCNTNTSNNTEEEKKTKKKDAIVVDPSSNLYYRWLTAIALPVFYNWYLLICRACFDELQSEYLMLWLVLDYSADVLYVLDVLVRARTGFLEQGLMVSDTNRLWQHYKTTTQFKLDVLSLVPTDLAYLKVGTNYPEVRFNRLLKFSRLFEFFDRTETRTNYPNMFRIGNLVLYILIIIHWNACIYFAISKFIGFGTDSWVYPNISIPEHGRLSRKYIYSLYWSTLTLTTIGETPPPVKDEEYLFVVVDFLVGVLIFATIVGNVGSMISNMNASRAEFQAKIDSIKQYMQFRKVTKDLETRVIRWFDYLWANKKTVDEKEVLKSLPDKLKAEIAINVHLDTLKKVRIFQDCEAGLLVELVLKLRPTVFSPGDYICKKGDIGKEMYIINEGKLAVVADDGVTQFVVLSDGSYFGEISILNIKGSKSGNRRTANIRSIGYSDLFCLSKDDLMEALTEYPEAKKALEEKGRQILMKDNLIDEELARAGADPKDLEEKVEQLGSSLDTLQTRFARLLAEYNATQMKMKQRLSQLESQVKGGGDKPLADGEVPGDATKTEDKQQ

SEQ ID NO: 58872 - protein, 607 aa, Homo sapiens
MELVRRLMPLTLLILSCLAELTMAEAEGNASCTVSLGGANMAETHKAMILQLNPSENCTWTIERPENKSIRIIFSYVQLDPDGSCESENIKVFDGTSSNGPLLGQVCSKNDYVPVFESSSSTLTFQIVTDSARIQRTVFVFYYFFSPNISIPNCGGYLDTLEGSFTSPNYPKPHPELAYCVWHIQVEKDYKIKLNFKEIFLEIDKQCKFDFLAIYDGPSTNSGLIGQVCGRVTPTFESSSNSLTVVLSTDYANSYRGFSASYTSIYAENINTTSLTCSSDRMRVIISKSYLEAFNSNGNNLQLKDPTCRPKLSNVVEFSVPLNGCGTIRKVEDQSITYTNIITFSASSTSEVITRQKQLQIIVKCEMGHNSTVEIIYITEDDVIQSQNALGKYNTSMALFESNSFEKTILESPYYVDLNQTLFVQVSLHTSDPNLVVFLDTCRASPTSDFASPTYDLIKSGCSRDETCKVYPLFGHYGRFQFNAFKFLRSMSSVYLQCKVLICDSSDHQSRCNQGCVSRSKRDISSYKWKTDSIIGPIRLKRDRSASGNSGFQHETHAEETPNQPFNSVHLFSFMVLALNVVTVATITVRHFVNQRADYKYQKLQNY

SEQ ID NO: 58873 - protein, 868 aa, Homo sapiens
MGWQPMGENWGCLEEMLNEDQSREPPGHLGSRRSGKDGRLDIYGERRDATRSSTSRYKPGTGSFSKDAQGPMGHFSQGLADMEVQPGEAATLSCTLTSDLGPGTWFKDGVKLTTQDGVIFKQDGLVHSLFITHVQGTQAGRYTFVAGDQQSEATLTVQDSPTIAPDVTEKLREPLVVKAGKPVIVKIPFQSHLPIQAAWRKDGAEVVGSSDREAQVDLGDGYTRLCLPSAGRKDCGQYSVTLRSEGGSVQAELTLQVIDKPDPPQGPMEVQDCHRAGVCLRWRPPRDNGGRTVECYVVERRQAGRSTWLKVGEAPADSTTFTDAHVEPGRKYTFRVRAVTSEGAGEALESEEILVAPEALPKAPSAPAILSASSQGITLTWTAPRGPGSAHILGYLIERRKKGSNTWTAVNDQPVPERRWTVADVRQGCQYEFRVTAVAPSGPGEPGPPSDAVFARDPMRPPGLVRNLQVTDRSNTSITLSWAGPDTQEGDEAQGYVVELCSSDSLQWLPCHVGTVPVTTYTAKGLRPGEGYFVRVTAVNEGGQSQPSALDTLVQAMPVTVCPKFLVDSSTKDLLTVKVGDTVRVPVSFEAMPMPEVTWLKDGLPLPKRSVTVTKDGLTQLLIPVAGLSDSGLYTVVLRTLQGKEVAHSFRIRVAACPQAPGPIHLQENVPGTVTAEWEPSPDEAQDVPLHYAVFTRSSAHGPWHEAADRIYTNRFTLLGILPGHEYHFRVVAKNELGASKPSDTSQPWCIPRQRDRFTVKAPCYREPDLSQKPRFLVGLRSHLLPQGCECCMSCAVQGSPRPHVTWFKNDRSLEGNPAVYSTDLLGVCSLTIPSVSPKDSGEYKAVAENTLGQAVSTATLIVIEPST

SEQ ID NO: 58874 - protein, 269 aa, Homo sapiens
MIRTLLLSTLVAGALSCGVSTYAPDMSRMLGGEEARPNSWPWQVSLQYSSNGQWYHTCGGSLIANSWVLTAAHCISSSGIYRVMLGQHNLYVAESGSLAVSVSKIVVHKDWNSDQVSKGNDIALLKLANPVSLTDKIQLACLPPAGTILPNNYPCYVTGWGRLQTNGALPDDLKQGRLLVVDYATCSSSGWWGSTVKTNMICAGGDGVICTCNGDSGGPLNCQASDGRWEVHGIGSLTSVLGCNYYYKPSIFTRVSNYNDWINSVIANN

SEQ ID NO: 58875 - protein, 270 aa, Homo sapiens
MMLRLLSSLLLVAVASGYGPPSSRPSSRVVNGEDAVPYSWPWQVSLQYEKSGSFYHTCGGSLIAPDWVVTAGHCISSSRTYQVVLGEYDRAVKEGPEQVIPINSGDLFVHPLWNRSCVACGNDIALIKLSRSAQLGDAVQLASLPPAGDILPNETPCYITGWGRLYTNGPLPDKLQEALLPVVDYEHCSRWNWWGSSVKKTMVCAGGDIRSGCNGDSGGPLNCPTEDGGWQVHGVTSFVSAFGCNTRRKPTVFTRVSAFIDWIEETIASH

SEQ ID NO: 58876 - protein, 913 aa, Homo sapiens
MQRYAGRGGARGRRAGGRARWGPRGGPAAAASSSALPAAPGGSVFPAGGGPLLTGGAAVHISAAGAAKATLYCRVFLLDGTEVSVDLPKHAKGQDLFDQIVYHLDLVETDYFGLQFLDSAQVAHWLDHAKPIKKQMKIGPAYALHFRVKYYSSEPNNLREEFTRYLFVLQLRHDILSGKLKCPYETAVELAALCLQAELGECELPEHTPELVSEFRFIPNQTEAMEFDIFQRWKECRGKSPAQAELSYLNKAKWLEMYGVDMHVVRGRDGCEYSLGLTPTGILIFEGANKIGLFFWPKITKMDFKKSKLTLVVVEDDDQGREQEHTFVFRLDSARTCKHLWKCAVEHHAFFRLRTPGNSKSNRSDFIRLGSRFRFSGRTEYQATHGSRLRRTSTFERKPSKRYPSRRHSTFKASNPVIAAQLCSKTNPEVHNYQPQYHPNIHPSQPRWHPHSPNVSYPLPSPVLSSSDRLPFGIEENGGTPFLTAASGRHHHQHQHQHQHQHHSNYSLSLTLENKEGPLRSPNSSSKSLTKLSPGTPALFSEAAAHLKKLELETVKAAGPWPPLHININKAEEKKVSEKTLQTPLLPSPVADHVKCNILKAQLENASRVNIQGGKEESPFVNINKKSSLQDASVRSPIPIRVETAQPAVEKPEIKPPRVRKLTRQYSFDEDDLPPDLAEAVGVTTSTTTNTTTAATQVSVPLPSPKVQNVSSPHKSEGKGLLSPGAKSPSDRGGAFTLEPGDLLMDFTEATPLAEPASNPHCAHSRCSPPLSLPMKEETTGVCMYPPIKTRLIKTFPVDTMTPFPDTFTTGPQFTADFRDSKLQCCPGPTSPLIPAATLRPLTETVSTVQTIYTTPETCFSGSQCRDTPAGTGEREDDEKTVDDQTVKFSPCHLEDGMVPSVHLLSSGFVCSL

SEQ ID NO: 58877 - protein, 502 aa, Homo sapiens
MAQRCVCVLALVAMLLLVFPTVSRSMGPRSGEHQRASRIPSQFSKEERVAMKEALKGAIQIPTVTFSSEKSNTTALAEFGKYIHKVFPTVVSTSFIQHEVVEEYSHLFTIQGSDPSLQPYLLMAHFDVVPAPEEGWEVPPFSGLERDGVIYGRGTLDDKNSVMALLQALELLLIRKYIPRRSFFISLGHDEESSGTGAQRISALLQSRGVQLAFIVDEGGFILDDFIPNFKKPIALIAVSEKGSMNLMLQVNMTSGHSSAPPKETSIGILAAAVSRLEQTPMPIIFGSGTVVTVLQQLANEFPFPVNIILSNPWLFEPLISRFMERNPLTNAIIRTTTALTIFKAGVKFNVIPPVAQATVNFRIHPGQTVQEVLELTKNIVADNRVQFHVLSAFDPLPVSPSDDKALGYQLLRQTVQSVFPEVNITAPVTSIGNTDSRFFTNLTTGIYRFYPIYIQPEDFKRIHGVNEKISVQAYETQVKFIFELIQNADTDQEPVSHLHKL

SEQ ID NO: 58878 - protein, 222 aa, Homo sapiens
MSALVFFPPSSPLPIAFFPPSSPLPIAFFPPSSPLPIVFFPSLFSIFLPPPYPHLLLAAASSCRAFLSPHHLLFLFPTVLSPRPLLLSLSSPRAFPTTVLSPVFFPSHRFLPMSSHRLAAASVSRNLLPTFFSPPPIVFFPQPLILRHLLPLPTFSQQRLPAAFFSPRTLFSPLPLPTVFAPDRRLAHPLLALSNCLSPRSAPRVRPAVSLRLVCLCAQAAP

SEQ ID NO: 58879 - protein, 355 aa, Homo sapiens
MDFLHRNGVLIIQHLQKDYRAYYTFLNFMSNVGDPRNIFFIYFPLCFQFNQTVGTKMIWVAVIGDWLNLIFKWILFGHRPYWWVQETQIYPNHSSPCLEQFPTTCETGPGSPSGHAMGASCVWYVMVTAALSHTVCGMDKFSITLHRLTWSFLWSVFWLIQISVCISRVFIATHFPHQVILGVIGGMLVAEAFEHTPGIQTASLGTYLKTNLFLFLFAVGFYLLLRVLNIDLLWSVPIAKKWCANPDWIHIDTTPFAGLVRNLGVLFGLGFAINSEMFLLSCRGGNNYTLSFRLLCALTSLTILQLYHFLQIPTHEEHLFYVLSFCKSASIPLTVVAFIPYSVHMLMKQSGKKSQ

SEQ ID NO: 58880 - protein, 533 aa, Homo sapiens
MERMVGSGLLWLALVSCILTQASAVQRGYGNPIEASSYGLDLDCGAPGTPEAHVCFDPCQNYTLLDEPFRSTENSAGSQGCDKNMSGWYRFVGEGGVRMSETCVQVHRCQTDAPMWLNGTHPALGDGITNHTACAHWSGNCCFWKTEVLVKACPGGYHVYRLEGTPWCNLRYCTVPRDPSTVEDKCEKACRPEEECLALNSTWGCFCRQDLNSSDVHSLQPQLDCGPREIKVKVDKCLLGGLGLGEEVIAYLRDPNCSSILQTEERNWVSVTSPVQASACRNILERNQTHAIYKNTLSLVNDFIIRDTILNINFQCAYPLDMKVSLQAALQPIVSSLNVSVDGNGEFIVRMALFQDQNYTNPYEGDAVELSVESVLYVGAILEQGDTSRFNLVLRNCYATPTEDKADLVKYFIIRNSCSNQRDSTIHVEENGQSSESRFSVQMFMFAGHYDLVFLHCEIHLCDSLNEQCQPSCSRSQVRSEVPAIDLARVLDLGPITRRGAQSPGVMNGTPSTAGFLVAWPMVLLTVLLAWLF

SEQ ID NO: 58881 - protein, 386 aa, Homo sapiens
MERMVGSGLLWLALVSCILTQASAVQRVPRDPSTVEDKCEKACRPEEECLALNSTWGCFCRQDLNSSDVHSLQPQLDCGPREIKVKVDKCLLGGLGLGEEVIAYLRDPNCSSILQTEERNWVSVTSPVQASACRNILERNQTHAIYKNTLSLVNDFIIRDTILNINFQCAYPLDMKVSLQAALQPIVSSLNVSVDGNGEFIVRMALFQDQNYTNPYEGDAVELSVESVLYVGAILEQGDTSRFNLVLRNCYATPTEDKADLVKYFIIRNSCSNQRDSTIHVEENGQSSESRFSVQMFMFAGHYDLVFLHCEIHLCDSLNEQCQPSCSRSQVRSEVPAIDLARVLDLGPITRRGAQSPGVMNGTPSTAGFLVAWPMVLLTVLLAWLF

SEQ ID NO: 58882 - protein, 383 aa, Homo sapiens
MERMVGSGLLWLALVSCILTQASAVQRDPSTVEDKCEKACRPEEECLALNSTWGCFCRQDLNSSDVHSLQPQLDCGPREIKVKVDKCLLGGLGLGEEVIAYLRDPNCSSILQTEERNWVSVTSPVQASACRNILERNQTHAIYKNTLSLVNDFIIRDTILNINFQCAYPLDMKVSLQAALQPIVSSLNVSVDGNGEFIVRMALFQDQNYTNPYEGDAVELSVESVLYVGAILEQGDTSRFNLVLRNCYATPTEDKADLVKYFIIRNSCSNQRDSTIHVEENGQSSESRFSVQMFMFAGHYDLVFLHCEIHLCDSLNEQCQPSCSRSQVRSEVPAIDLARVLDLGPITRRGAQSPGVMNGTPSTAGFLVAWPMVLLTVLLAWLF

SEQ ID NO: 58883 - protein, 530 aa, Homo sapiens
MERMVGSGLLWLALVSCILTQASAVQRGYGNPIEASSYGLDLDCGAPGTPEAHVCFDPCQNYTLLDEPFRSTENSAGSQGCDKNMSGWYRFVGEGGVRMSETCVQVHRCQTDAPMWLNGTHPALGDGITNHTACAHWSGNCCFWKTEVLVKACPGGYHVYRLEGTPWCNLRYCTDPSTVEDKCEKACRPEEECLALNSTWGCFCRQDLNSSDVHSLQPQLDCGPREIKVKVDKCLLGGLGLGEEVIAYLRDPNCSSILQTEERNWVSVTSPVQASACRNILERNQTHAIYKNTLSLVNDFIIRDTILNINFQCAYPLDMKVSLQAALQPIVSSLNVSVDGNGEFIVRMALFQDQNYTNPYEGDAVELSVESVLYVGAILEQGDTSRFNLVLRNCYATPTEDKADLVKYFIIRNSCSNQRDSTIHVEENGQSSESRFSVQMFMFAGHYDLVFLHCEIHLCDSLNEQCQPSCSRSQVRSEVPAIDLARVLDLGPITRRGAQSPGVMNGTPSTAGFLVAWPMVLLTVLLAWLF

SEQ ID NO: 58884 - protein, 129 aa, Homo sapiens
MPMASPQTLVLYLLVLAVTEAWGQEAVIPGCHLHPFNVTVRSDRQGTCQGSHVAQACVGHCESSAFPSRYSVLVASGYRHNITSVSQCCTISGLKKVKVQLQCVGSRREELEIFTARACQCDMCRLSRY

SEQ ID NO: 58885 - protein, 89 aa, Homo sapiens
MGILKLQVFLIVLSVALNHLKATPIESHQVEKRKCNTATCATQRLANFLVHSSNNFGAILSSTNVGSNTYGKRNAVEVLKREPLNYLPL

SEQ ID NO: 58886 - protein, 574 aa, Homo sapiens
MRTLLTILTVGSLAAHAPEDPSDLLQHVKFQSSNFENILTWDSGPEGTPDTVYSIEYKTYGERDWVAKKGCQRITRKSCNLTVETGNLTELYYARVTAVSAGGRSATKMTDRFSSLQHTTLKPPDVTCISKVRSIQMIVHPTPTPIRAGDGHRLTLEDIFHDLFYHLELQVNRTYQMHLGGKQREYEFFGLTPDTEFLGTIMICVPTWAKESAPYMCRVKTLPDRTWTYSFSGAFLFSMGFLVAVLCYLSYRYVTKPPAPPNSLNVQRVLTFQPLRFIQEHVLIPVFDLSGPSSLAQPVQYSQIRVSGPREPAGAPQRHSLSEITYLGQPDISILQPSNVPPPQILSPLSYAPNAAPEVGPPSYAPQVTPEAQFPFYAPQAISKVQPSSYAPQATPDSWPPSYGVCMEGSGKDSPTGTLSSPKHLRPKGQLQKEPPAGSCMLGGLSLQEVTSLAMEESQEAKSLHQPLGICTDRTSDPNVLHSGEEGTPQYLKGQLPLLSSVQIEGHPMSLPLQPPSRPCSPSDQGPSPWGLLESLVCPKDEAKSPAPETSDLEQPTELDSLFRGLALTVQWES

SEQ ID NO: 58887 - protein, 510 aa, Homo sapiens
MPRGFLVKRSKKSTPVSYRVRGGEDGDRALLLSPSCGGARAEPPAPSPVPGPLPPPPPAERAHAALAAALACAPGPQPPPQGPRAAHFGNPEAAHPAPLYSPTRPVSREHEKHKYFERSFNLGSPVSAESFPTPAALLGGGGGGGASGAGGGGTCGGDPLLFAPAELKMGTAFSAGAEAARGPGPGPPLPPAAALRPPGKRPPPPTAAEPPAKAVKAPGAKKPKAIRKLHFEDEVTTSPVLGLKIKEGPVEAPRGRAGGAARPLGEFICQLCKEEYADPFALAQHKCSRIVRVEYRCPECAKVFSCPANLASHRRWHKPRPAPAAARAPEPEAAARAEAREAPGGGSDRDTPSPGGVSESGSEDGLYECHHCAKKFRRQAYLRKHLLAHHQALQAKGAPLAPPAEDLLALYPGPDEKAPQEAAGDGEGAGVLGLSASAECHLCPVCGESFASKGAQERHLRLLHAAQVFPCKYCPATFYSSPGLTRHINKCHPSENRQVILLQVPVRPAC

SEQ ID NO: 58888 - protein, 346 aa, Homo sapiens
MGDPPKKKRLISLCVGCGNQIHDQYILRVSPDLEWHAACLKCAECNQYLDESCTCFVRDGKTYCKRDYIRLYGIKCAKCSIGFSKNDFVMRARSKVYHIECFRCVACSRQLIPGDEFALREDGLFCRADHDVVERASLGAGDPLSPLHPARPLQMAAEPISARQPALRPHVHKQPEKTTRVRTVLNEKQLHTLRTCYAANPRPDALMKEQLVEMTGLSPRVIRVWFQNKRCKDKKRSIMMKQLQQQQPNDKTNIQGMTGTPMVAASPERHDGGLQANPVEVQSYQPPWKVLSDFALQSDIDQPAFQQLVNFSEGGPGSNSTGSEVASMSSQLPDTPNSMVASPIEA

SEQ ID NO: 58889 - protein, 309 aa, Homo sapiens
MPSAGLCSCWGGRVLPLLLAYVCYLLLGATIFQLLERQAEAQSRDQFQLEKLRFLENYTCLDQWAMEQFVQVIMEAWVKGVNPKGNSTNPSNWDFGSSFFFAGTVVTTIGYGNLAPSTEAGQVFCVFYALLGIPLNVIFLNHLGTGLRAHLAAIERWEDRPRRSQVLQVLGLALFLTLGTLVILIFPPMVFSHVEGWSFSEGFYFAFITLSTIGFGDYVVGTDPSKHYISVYRSLAAIWILLGLAWLALILPLGPLLLHRCCQLWLLSLRQGCGAKAAPGRRPRRGSTAARGVQVTPQDFPISKKGLGS

SEQ ID NO: 58890 - protein, 235 aa, Homo sapiens
MFIWTSGRTSSSYRHDEKRNIYQKIRDHDLLDKRKTVTALKAGEDRAILLGLAMMVCSIMMYFLLGITLLRSYMQSVWTEESQCTLLNASITETFNCSFSCGPDCWKLSQYPCLQVYVNLTSSGEKLLLYHTEETIKINQKCSYIPKCGKNFEESMSLVNVVMENFRKYQHFSCYSDPEGNQKSVILTKLYSSNVLFHSLFWPTCMMAGGVAIVAMVKLTQYLSLLCERIQRINR

SEQ ID NO: 58891 - protein, 235 aa, Homo sapiens; identical to SEQ ID NO: 58890

SEQ ID NO: 58892 - protein, 708 aa, Homo sapiens
MLRMRVPALLVLLFCFRGRAGPSPHFLQQPEDLVVLLGEEARLPCALGAYWGLVQWTKSGLALGGQRDLPGWSRYWISGNAANGQHDLHIRPVELEDEASYECQATQAGLRSRPAQLHVLVPPEAPQVLGGPSVSLVAGVPANLTCRSRGDARPTPELLWFRDGVLLDGATFHQTLLKEGTPGSVESTLTLTPFSHDDGATFVCRARSQALPTGRDTAITLSLQYPPEVTLSASPHTVQEGEKVIFLCQATAQPPVTGYRWAKGGSPVLGARGPRLEVVADASFLTEPVSCEVSNAVGSANRSTALDVLFGPILQAKPEPVSVDVGEDASFSCAWRGNPLPRVTWTRRGGAQVLGSGATLRLPSVGPEDAGDYVCRAEAGLSGLRGGAAEARLTVNAPPVVTALHSAPAFLRGPARLQCLVFASPAPDAVVWSWDEGFLEAGSQGRFLVETFPAPESRGGLGPGLISVLHISGTQESDFSRSFNCSARNRLGEGGAQASLGRRDLLPTVRIVAGVAAATTTLLMVITGVALCCWRHSKASASFSEQKNLMRIPGSSDGSSSRGPEEEETGSREDRGPIVHTDHSDLVLEEEGTLETKDPTNGYYKVRGVSVSLSLGEAPGGGLFLPPPSPLGPPGTPTFYDFNPHLGMVPPCRLYRARAGYLTTPHPRAFTSYIKPTSFGPPDLAPGTPPFPYAAFPTPSHPRLQTHV

SEQ ID NO: 58893 - protein, 262 aa, Homo sapiens
MWFLVLCLALSLGGTGAAPPIQSRIVGGWECEQHSQPWQAALYHFSTFQCGGILVHRQWVLTAAHCISDNYQLWLGRHNLFDDENTAQFVHVSESFPHPGFNMSLLENHTRQADEDYSHDLMLLRLTEPADTITDAVKVVELPTEEPEVGSTCLASGWGSIEPENFSFPDDLQCVDLKILPNDECKKAHVQKVTDFMLCVGHLEGGKDTCVGDSGGPLMCDGVLQGVTSWGYVPCGTPNKPSVAVRVLSYVKWIEDTIAENS

SEQ ID NO: 58894 - protein, 98 aa, Homo sapiens
MTIGALIGLGIAALVLLAFVISVCVLCYLFLYTKPQRLDTGLKLQHLEASSTQEGKSNGKTKALNSNAASNATNETYYEADDIIQEKTMDATQIHIAY

SEQ ID NO: 58895 - protein, 160 aa, Homo sapiens
MSEASRLCSGYYSLNQSFVEPFQCPRRGEGAALQYCCGFADLKYCCSEPGSYFPYKHSYMWSLSIGALIGLGIAALVLLAFVISVCVLCYLFLYTKPQRLDTGLKLQHLEASSTQEGKSNGKTKALNSNAASNATNETYYEADDIIQEKTMDATQIHIAY

SEQ ID NO: 58896 - protein, 61 aa, Homo sapiens
MEKKDAELLEPYNERNSIMISTDKFSARKMLLWYLLRSFEIMVERPELWALLEIGYHQTRH

SEQ ID NO: 58897 - protein, 160 aa, Homo sapiens [sequence omitted]

SEQ ID NO: 58898 - protein, 98 aa, Homo sapiens
MTIGALIGLGIAALVLLAFVISVCVLCYLFLYTKPQRLDTGLKLQHLEPSSTQEGKSNGKTKALNSNAASNATNETYYEADDIIQEKTMDATQIHIAY

SEQ ID NO: 58899 - protein, 187 aa, Homo sapiens; identical to SEQ ID NO: 22142

SEQ ID NO: 58900 - protein, 187 aa, Homo sapiens; identical to SEQ ID NO: 22142

SEQ ID NO: 58901 - protein, 58 aa, Homo sapiens
MDYLDRDPNEQGSAGVRKLTEGRTRRLPKYNCVPLKEITTRIRSALEARSAAGETKPQ

SEQ ID NO: 58902 - protein, 61 aa, Homo sapiens; identical to SEQ ID NO: 58896

SEQ ID NO: 58903 - protein, 183 aa, Homo sapiens
MAFLWLLSCWALLGTTFGCGVPAIHPVLSGLSRIVNGEDAVPGSWPWQVSLQDKTGFHFCGGSLISEDWVVTAAHCGVRTSDVVVANKTPDKLQQAALPLLSNAECKKSWGRRITDVMICAGASGVSSCMGDSGGPLVCQKDGAWTLVGIVSWGSDTCSTSSPGVYARVTKLIPWVQKILAAN

SEQ ID NO: 58904 - protein, 265 aa, Homo sapiens
MKFFLLLFTIGFCWAQYSPNTQQGRTSIVHLFEWRWVDIALECERYLAPKGFGGVQVSPPNENVAIYNPFRPWWERYQPVSYKLCTRSGNEDEFRNMVTRCNNVGVRIYVDAVINHMCGNAVSAGTSSTCGSYFNPGSRDFPAVPYSGWDFNDGKCKTGSGDIENYNDATQVRDCRLTGLLDLALEKDYVRSKIAEYMNHLIDIGVAGFRLDASKHMWPGDIKAILDKLHNLNSNWFPAGSKPFIYQEVHQYLYAYKISSYSLEN

SEQ ID NO: 58905 - protein, 58 aa, Homo sapiens; identical to SEQ ID NO: 58901

SEQ ID NO: 58906 - protein, 61 aa, Homo sapiens; identical to SEQ ID NO: 58896

SEQ ID NO: 58907 - protein, 366 aa, Homo sapiens
MIHSINCRIHCACSKHYSDLLREAWATFYFTEIAAYTKIQESFVSPPNENVAIHNPFRPWWERYQPVSYKLCTRSGNEDEFRNMVTRCNNVGVRIYVDAVINHMCGNAVSAGTSSTCGSYFNPGSRDFPAVPYSGWDFNDGKCKTGSGDIENYNDATQVRDCRLSGLLDLALGKDYVRSKIAEYMNHLIDIGVAGFRIDASKHMWPGDIKAILDKLHNLNSNWFPEGSKPFIYQEVIDLGGEPIKSSDYFGNGRVTEFKYGAKLGTVIRKWNGEKMSYLKNWGEGWGFMPSDRALVFVDNHDNQRGHGAGGASILTFWDARLYKMAVGFMLAHPYGFTRVMSSYRWPRYFENGKGCDLVMQVILKE

SEQ ID NO: 58908 - protein, 223 aa, Homo sapiens
MTWRHHVRLLFTVSLALQIINLGNSYQREKHNGGREEVTKVATQKHRQSPLNWTSSHFGEVTGSAEGWGPEEPLPYSWAFGEGASARPRCCRNGGTCVLGSFCVCPAHFTGRYCEHDQRRSECGALEHGAWTLRACHLCRCIFGALHCLPLQTPDRCDPKDFLASHAHGPSAGGAPSLLLLLPCALLHRLLRPDAPAHPRSLVPSVLQRERRPCGRPGLGHRL

SEQ ID NO: 58909 - protein, 194 aa, Homo sapiens
MTWRHHVRLLFTVSLALQIINLGNSYQREKHNGGREEVTKVATQKHRQSPLNWTSSHFGEVTGSAEGWGPEEPLPYSWAFGEGASARPRCCRNGGTCVLGSFCVCPAHFTGRYCEHDQRRSECGALEHGAWTLRACHLCRCIFGALHCLPLQTPDRCGKRPCDSVPSSPPHAVAPSLRLTLHTDPQCIFQCQAT

SEQ ID NO: 58910 - protein, 148 aa, Homo sapiens
MTWRHHVRLLFTVSLALQIINLGNSYQREKHNGGREEVTKVATQKHRQSPLNWTSSHFGEVTGSAEGWGPEEPLPYSWAFGEDPKDFLASHAHGPSAGGAPSLLLLLPCALLHRLLRPDAPAHPRSLVPSVLQRERRPCGRPGLGHRL

SEQ ID NO: 58911 - protein, 191 aa, Homo sapiens
MTWRHHVRLLFTVSLALQIINLGNSYQREKHNGGREEVTKVATQKHRQSPLNWTSSHFGEVTGSAEGWGPEEPLPYSWAFGEVNAAPWSTEPGPSAPATSAGASSGPCTASPSRRLTAVTRKTSWPPTLTGRAPGARPACYSCCPAHSCTASCARMRPRTLGPWSLPSSSGSGAPAEGRDLGIAFNFLCCK

SEQ ID NO: 58912 - protein, 353 aa, Homo sapiens
MAAELAMGAELPSSPLAIEYVNDFDLMKFEVKKEPPEAERFCHRLPPGSLSSTPLSTPCSSVPSSPSFCAPSPGTGGGGGAGGGGGSSQAGGAPGPPSGGPGAVGGTSGKPALEDLYWMSGYQHHLNPEALNLTPEDAVEALIGSGHHGAHHGAHHPAAAAAYEAFRGPGFAGGGGADDMGAGHHHGAHHAAHHHHAAHHHHHHHHHHGGAGHGGGAGHHVRLEERFSDDQLVSMSVRELNRQLRGFSKEEVIRLKQKRRTLKNRGYAQSCRFKRVQQRHILESEKCQLQSQVEQLKLEVGRLAKERDLYKEKYEKLAGRGGPGSAGGAGFPREPSPPQAGPGGAKGTADFFL

SEQ ID NO: 58913 - protein, 148 aa, Homo sapiens
MDKNVISVKIMEEKRDESTGVIYRKRIAICQNVVPEILRKVSILKVPNIQLEEESWLNPRERNMAIRSHCLTWTQYASMKEESVFRESMENPNWTEFIQRGRISITGVGFLNCVLETFASTFLRQGAQKGIRIMEMLLKEQCGAPLAE

SEQ ID NO: 58914 - protein, 189 aa, Homo sapiens
MGVSVDVHQVYKYPFEQVVASFLRKYPNPMDKNVISVKIMEEKRDESTGVIYRKRIAICQNVVPEILRKSLSTLVILCWKKVSILKVPNIQLEEESWLNPRERNMAIRSHCLTWTQYASMKEESVFRESMENPNWTEFIQRGRISITGVGFLNCVLETFASTFLRQGAQKGIRIMEMLLKEQCGAPLAE

SEQ ID NO: 58915 - protein, 177 aa, Homo sapiens
MGVSVDVHQVYKYPFEQVVASFLRKYPNPMDKNVISVKIMEEKRDESTGVIYRKRIAICQNVVPEILRKVSILKVPNIQLEEESWLNPRERNMAIRSHCLTWTQYASMKEESVFRESMENPNWTEFIQRGRISITGVGFLNCVLETFASTFLRQGAQKGIRIMEMLLKEQCGAPLAE

SEQ ID NO: 58916 - protein, 367 aa, Homo sapiens
MLAVGAMEGTRQSAFLLSSPPLAALHSMAEMKTPLYPAAYPPLPAGPPSSSSSSSSSSSPSPPLGTHNPGGLKPPATGGLSSLGSPPQQLSAATPHGINNILSRPSMPVASGAALPSASPSGSSSSSSSSASASSASAAAAAAAAAAAAASSPAGLLAGLPRFSSLSPPPPPPGLYFSPSAAAVAAVGRYPKPLAELPGRTPIFWPGVMQSPPWRDARLACTPHQGSILLDKDGKRKHTRPTFSGQQIFALEKTFEQTKYLAGPERARLAYSLGMTESQVKVWFQNRRTKWRKKHAAEMATAKKKQDSETERLKGASENEEEDDDYNKPLDPNSDDEKITQLLKKHKSSSGGGGGLLLHASEPESSS

SEQ ID NO: 58917 - protein, 753 aa, Homo sapiens
MERRAWSLQCTAFVLFCAWCALNSAKAKRQFVNEWAAEIPGGPEAASAIAEELGYDLLGQIGSLENHYLFKHKNHPRRSRRSAFHITKRLSDDDRVIWAEQQYEKERSKRSALRDSALNLFNDPMWNQQWYLQDTRMTAALPKLDLHVIPVWQKGITGKGVVITVLDDGLEWNHTDIYANYDPEASYDFNDNDHDPFPRYDPTNENKHGTRCAGEIAMQANNHKCGVGVAYNSKVGGIRMLDGIVTDAIEASSIGFNPGHVDIYSASWGPNDDGKTVEGPGRLAQKAFEYGVKQGRQGKGSIFVWASGNGGRQGDNCDCDGYTDSIYTISISSASQQGLSPWYAEKCSSTLATSYSSGDYTDQRITSADLHNDCTETHTGTSASAPLAAGIFALALEANPNLTWRDMQHLVVWTSEYDPLANNPGWKKNGAGLMVNSRFGFGLLNAKALVDLADPRTWRSVPEKKECVVKDNDFEPRALKANGEVIIEIPTRACEGQENAIKSLEHVQFEATIEYSRRGDLHVTLTSAAGTSTVLLAERERDTSPNGFKNWDFMSVHTWGENPIGTWTLRITDMSGRIQNEGRIVNWKLILHGTSSQPEHMKQPRVYTSYNTVQNDRRGVEKMVDPGEEQPTQENPKENTLVSKSPSSSSVGGRRDELEEGAPSQAMLRLLQSAFSKNSPPKQSPKKSPSAKLNIPYENFYEALEKLNKPSQLKDSEDSLYNDYVDVFYNTKPYKHRDDRLLQALVDILNEEN

SEQ ID NO: 58918 - protein, 511 aa, Homo sapiens
MASCPWGQEQGARSPSEEPPEEEIPKEDGILVLSRHTLGLALREHPALLVEFYAPWCGHCQALAPEYSKAAAVLAAESMVVTLAKVDGPAQRELAEEFGVTEYPTLKFFRNGNRTHPEEYTGPRDAEGIAEWLRRRVGPSAMRLEDEAAAQALIGGRDLVVIGFFQDLQDEDVATFLALAQDALDMTFGLTDRPRLFQQFGLTKDTVVLFKKFDEGRADFPVDEELGLDLGDLSRFLVTHSMRLVTEFNSQTSAKIFAARILNHLLLFVNQTLAAHRELLAGFGEAAPRFRGQVLFVVVDVAADNEHVLQYFGLKAEAAPTLRLVNLETTKKYAPVDGGPVTAASITAFCHAVLNGQVKPYLLSQEIPPDWDQRPVKTLVGKNFEQVAFDETKNVFVKFYAPWCTHCKEMAPAWEALAEKYQDHEDIIIAELDATANELDAFAVHGFPTLKYFPAGPGRKVIEYKSTRDLETFSKFLDNGGVLPTEESPEEPAAPFPEPPANSTMGSKEEL

SEQ ID NO: 58919 - protein, 1107 aa, Homo sapiens
MAFSYLFATCARGLLPRRPRSGASGPRWSEGPGEARAGRRAPGPAAGTTEPPYGRRQRLAAAPGPRRGKRRRGGGGGGGGGGGDGGSAMEPGEVKDRILENISLSVKKLQSYFAACEDEIPAIRNHDKVLQRLCEHLDHALLYGLQDLSSGYWVLVVHFTRREAIKQIEVLQHVATNLGRSRAWLYLALNENSLESYLRLFQENLGLLHKYYVKNALVCSHDHLTLFLTLVSGLEFIRFELDLDAPYLDLAPYMPDYYKPQYLLDFEDRLPSSVHGSDSLSLNSFNSVTSTNLEWDDSAIAPSSEDYDFGDVFPAVPSVPSTDWEDGDLTDTVSGPRSTASDLTSSKASTRSPTQRQNPFNEEPAETVSSSDTTPVHTTSQEKEEAQALDPPDACTELEVIRVTKKKKIGKKKKSRSDEEASPLHPACSQKKCAKQGDGDSRNGSPSLGRDSPDTMLASPQEEGEGPSSTTESSERSEPGLLIPEMKDTSMERLGQPLSKVIDQLNGQLDPSTWCSRAEPPDQSFRTGSPGDAPERPPLCDFSEGLSAPMDFYRFTVESPSTVTSGGGHHDPAGLGQPLHVPSSPEAAGQEEEGGGGEGQTPRPLEDTTREAQELEAQLSLVREGPVSEPEPGTQEVLCQLKRDQPSPCLSSAEDSGVDEGQGSPSEMVHSSEFRVDNNHLLLLMIHVFRENEEQLFKMIRMSTGHMEGNLQLLYVLLTDCYVYLLRKGATEKPYLVEEAVSYNELDYVSVGLDQQTVKLVCTNRRKQFLLDTADVALAEFFLASLKSAMIKGCREPPYPSILTDATMEKLALAKFVAQESKCEASAVTVRFYGLVHWEDPTDESLGPTPCHCSPPEGTITKEGMLHYKAGTSYLGKEHWKTCFVVLSNGILYQYPDRTDVIPLLSVNMGGEQCGGCRRANTTDRPHAFQVILSDRPCLELSAESEAEMAEWMQHLCQAVSKGVIPQGVAPSPCIPCCLVLTDDRLFTCHEDCQTSFFRSLGTAKLGDISAVSTEPGKEYCVLEFSQDSQQLLPPWVIYLSCTSELDRLLSALNSGWKTIYQVDLPHTAIQEASNKKKFEDALSLIHSAWQRSDSLCRGRASRDPWC

SEQ ID NO: 58920 - protein, 1107 aa, Homo sapiens; identical to SEQ ID NO: 58919

SEQ ID NO: 58921 - protein, 95 aa, Homo sapiens
MAAARLCLSLLLLSTCVALLLQPLLGAQGAPLEPVYPGDNATPEQMAQYAADLRRYINMLTRPRYGKRHKEDTLAFSEWGSPHAAVPRELSPLDL

SEQ ID NO: 58922 - protein, 247 aa, Homo sapiens
MNPFLILAFVGAAVAVPFDDDDKIVGGYTCEENSLPYQVSLNSGSHFCGGSLISEQWVVSAAHCYKTRIQVRLGEHNIKVLEGNEQFINAAKIIRHPKYNRDTLDNDIMLIKLSSPAVINARVSTISLPTAPPAAGTECLISGWGNTLSFGADYPDELKCLDAPVLTQAECKASYPGKITNSMFCVGFLEGGKDSCQRDSGGPVVCNGQLQGVVSWGHGCAWKNRPGVYTKVYNYVDWIKDTIAANS

SEQ ID NO: 58923 - protein, 979 aa, Homo sapiens
MRRPRRPGGLGGSGGLRLLLCLLLLSSRPGGCSAVSAHGCLFDRRLCSHLEVCIQDGLFGQCQVGVGQARPLLQVTSPVLQRLQGVLRQLMSQGLSWHDDLTQYVISQEMERIPRLRPPEPRPRDRSGLAPKRPGPAGELLLQDIPTGSAPAAQHRLPQPPVGKGGAGASSSLSPLQAELLPPLLEHLLLPPQPPHPSLSYEPALLQPYLFHQFGSRDGSRVSEGSPGMVSVGPLPKAEAPALFSRTASKGIFGDHPGHSYGDLPGPSPAQLFQDSGLLYLAQELPAPSRARVPRLPEQGSSSRAEDSPEGYEKEGLGDRGEKPASPAVQPDAALQRLAAVLAGYGVELRQLTPEQLSTLLTLLQLLPKGAGRNPGGVVNVGADIKKTMEGPVEGRDTAELPARTSPMPGHPTASPTSSEVQQVPSPVSSEPPKAARPPVTPVLLEKKSPLGQSQPTVAGQPSARPAAEEYGYIVTDQKPLSLAAGVKLLEILAEHVHMSSGSFINISVVGPALTFRIRHNEQNLSLADVTQQAGLVKSELEAQTGLQILQTGVGQREEAAAVLPQTAHSTSPMRSVLLTLVALAGVAGLLVALAVALCVRQHARQQDKERLAALGPEGAHGDTTFEYQDLCRQHMATKSLFNRAEGPPEPSRVSSVSSQFSDAAQASPSSHSSTPSWCEEPAQANMDISTGHMILAYMEDHLRNRDRLAKEWQALCAYQAEPNTCATAQGEGNIKKNRHPDFLPYDHARIKLKVESSPSRSDYINASPIIEHDPRMPAYIATQGPLSHTIADFWQMVWESGCTVIVMLTPLVEDGVKQCDRYWPDEGASLYHVYEVNLVSEHIWCEDFLVRSFYLKNVQTQETRTLTQFHFLSWPAEGTPASTRPLLDFRRKVNKCYRGRSCPIIVHCSDGAGRTGTYILIDMVLNRMAKGVKEIDIAATLEHVRDQRPGLVRSKDQFEFALTAVAEEVNAILKALPQ

SEQ ID NO: 58924 - protein, 928 aa, Homo sapiens
MAKVPKLEDTFLQAQPAPQLSPGIQEDCCVQLLGKGLLVYPEETVYLAAEGQPGGEQGGGEKGEDPELPGAVKSEMHLNNGNFSSEEEDADNHDSKTKAADQYLSQKKTITQIVKDKKKQTQLTLQWLEENYIVCEGVCLPRCILYAHYLDFCRKEKLEPACAATFGKTIRQKFPLLTTRRLGTRGHSKYHYYGIGIKESSAYYHSVYSGKGLTRFSGSKLKNEGGFTRKYSLSSKTGTLLPEFPSAQHLVYQGCISKDKVDTLIMMYKTHCQCILDNAINGNFEEIQHFLLHFWQGMPDHLLPLLENPVIIDIFCVCDSILYKVLTDVLIPATMQEMPESLLADIRNFAKNWEQWVVSSLENLPEALTDKKIPIVRRFVSSLKRQTSFLHLAQIARPALFDQHVVNSMVSDIERVDLNSIGSQALLTISGSTDTESGIYTEHDSITVFQELKDLLKKNATVEAFIEWLDTVVEQRVIKTSKQNGRSLKKRAQDFLLKWSFFGARVMHNLTLNNASSFGSFHLIRMLLDEYILLAMETQFNNDKEQELQNLLDKYMKNSDASKAAFTASPSSCFLANRNKGSMVSSDAVKNESHVETTYLPLPSSQPGGLGPALHQFPAGNTDNMPLTGQMELSQIAGHLMTPPISPAMASRGSVINQGPMAGRPPSVGPVLSAPSHCSTYPEPIYPALPQANHDFYSTSSNYQTVFRAQPHSTSGLYPHHTEHGRCMAWTEQQLSRDFFSGSCAGSPYNSRPPSSYGPSLQAQDSHNMQFLNTGSFNFLSNTGAASCQGATLPPNSPNGYYGSNINYPESHRLGSMVNQHVSVISSIRSLPPYSDIHDPLNILDDSGRKQTSSFYTDTSSPVACRTPVLASSLQTPIPSSSSQCMYGTSNQYPAQETLDSHGTSSREMVSSLPPINTVFMGTAAGGT

SEQ ID NO: 58925 - protein, 468 aa, Homo sapiens
MGFLGTGTWILVLVLPIQAFPKPGGSQDKSLHNRELSAERPLNEQIAEAEEDKIKKTYPPENKPGQSNYSFVDNLNLLKAITEKEKIEKERQSIRSSPLDNKLNVEDVDSTKNRKLIDDYDSTKSGLDHKFQDDPDGLHQLDGTPLTAEDIVHKIAARIYEENDRAVFDKIVSKLLNLGLITESQAHTLEDEVAEVLQKLISKEANNYEEDPNKPTSWTENQAGKIPEKVTPMAAIQDGLAKGENDETVSNTLTLTNGLERRTKTYSEDNFEELQYFPNFYALLKSIDSEKEAKEKETLITIMKTLIDFVKMMVKYGTISPEEGVSYLENLDEMIALQTKNKLEKNATDNISKLFPAPSEKSHEETDSTKEEAAKMEKEYGSLKDSTKDDNSNPGGKTDEPKGKTEAYLEAIRKNIEWLKKHDKKGNKEDYDLSKMRDFINKQADAYVEKGILDKEEAEAIKRIYSSL

SEQ ID NO: 58926 - protein, 276 aa, Homo sapiens
MDSSREPTLGRLDAAGFWQVWQRFDADEKGYIEEKELDAFFLHMLMKLGTDDTVMKANLHKVKQQFMTTQDASKDGRIRMKELAGMFLSEDENFLLLFRRENPLDSSVEFMQIWRKYDADSSGFISAAELRNFLRDLFLHHKKAISEAKLEEYTGTMMKIFDRNKDGRLDLNDLARILALQENFLLQFKMDACSTEERKRDFEKIFAYYDVSKTGALEGPEVDGFVKDMMELVQPSISGVDLDKFREILLRHCDVNKDGKIQKSELALCLGLKINP

SEQ ID NO: 58927 - protein, 440 aa, Homo sapiens
MRPHLSPPLQQLLLPVLLACAAHSTGALPRLCDVLQVLWEEQDQCLQELSREQTGDLGTEQPVPGCEGMWDNISCWPSSVPGRMVEVECPRFLRMLTSRNGSLFRNCTQDGWSETFPRPNLACGVNVNDSSNEKRHSYLLKLKVMYTVGYSSSLVMLLVALGILCAFRRLHCTRNYIHMHLFVSFILRALSNFIKDAVLFSSDDVTYCDPHRAGCKLVMVLFQYCIMANYSWLLVEGLYLHTLLAISFFSERKYLQGFVAFGWGSPAIFVALWAIARHFLEDVGCWDINANASIWWIIRGPVILSILINFILFINILRILMRKLRTQETRGNEVSHYKRLARSTLLLIPLFGIHYIVFAFSPEDAMEIQLFFELALGSFQGLVVAVLYCFLNGEVQLEVQKKWQQWHLREFPLHPVASFSNSTKASHLEQSQGTCRTSII

SEQ ID NO: 58928 - protein, 211 aa, Homo sapiens
MVSRMVSTMLSGLLFWLASGWTPAFAYSPRTPDRVSEADIQRLLHGVMEQLGIARPRVEYPAHQAMNLVGPQSIEGGAHEGLQHLGPFGNIPNIVAELTGDNIPKDFSEDQGYPDPPNPCPVGKTDDGCLENTPDTAEFSREFQLHQHLFDPEHDYPGLGKWNKKLLYEKMKGGERRKRRSVNPYLQGQRLDNVVAKKSVPHFSDEDKDPE

SEQ ID NO: 58929 - protein, 372 aa, Homo sapiens
MEAKEKQHLLDARPAIRSYTGSLWQEGAGWIPLPRPGLDLQAIELAAQSNHHCHAQKGPDSHCDPKKGKAQRQLYVASAICLLFMIGEVVGGYLAHSLAVMTDAAHLLTDFASMLISLFSLWMSSRPATKTMNFGWQRAEILGALVSVLSIWVVTGVLVYLAVERLISGDYEIDGGTMLITSGCAVAVNIIMGLTLHQSGHGHSHGTTNQQEENPSVRAAFIHVIGDFMQSMGVLVAAYILYFKPEYKYVDPICTFVFSILVLGTTLTILRDVILVLMEGTPKGVDFTAVRDLLLSVEGVEALHSLHIWALTVAQPVLSVHIAIAQNTDAQAVLKTASSRLQGKFHFHTVTIQIEDYSEDMKDCQACQGPSD

SEQ ID NO: 58930 - protein, 323 aa, Homo sapiens
MEAKEKQHLLDARPAIRSYTGSLWQEGAGWIPLPRPGLDLQAIELAAQSNHHCHAQKGPDSHCDPKKGKAQRQLYVASAICLLFMIGEVVEILGALVSVLSIWVVTGVLVYLAVERLISGDYEIDGGTMLITSGCAVAVNIIMGLTLHQSGHGHSHGTTNQQEENPSVRAAFIHVIGDFMQSMGVLVAAYILYFKPEYKYVDPICTFVFSILVLGTTLTILRDVILVLMEGTPKGVDFTAVRDLLLSVEGVEALHSLHIWALTVAQPVLSVHIAIAQNTDAQAVLKTASSRLQGKFHFHTVTIQIEDYSEDMKDCQACQGPSD

SEQ ID NO: 58931 - protein, 369 aa, Homo sapiens
MEFLERTYLVNDKAAKMYAFTLESVELQQKPVNKDQCPRERPEELESGGMYHCHSGSKPTEKGANEYAYAKWKLCSASAICFIFMIAEVVGGHIAGSLAVVTDAAHLLIDLTSFLLSLFSLWLSSKPPSKRLTFGWHRAEILGALLSILCIWVVTGVLVYLACERLLYPDYQIQATVMIIVSSCAVAANIVLTVVLHQRCLGHNHKEVQANASVRAAFVHALGDLFQSISVLISALIIYFKPEYKIADPICTFIFSILVLASTITILKDFSILLMEGVPKSLNYSGVKELILAVDGVLSVHSLHIWSLTMNQVILSAHVATAASRDSQVVRREIAKALSKSFTMHSLTIQMESPVDQDPDCLFCEDPCD

SEQ ID NO: 58932 - protein, 116 aa, Homo sapiens
MLSCRLQCALAALSIVLALGCVTGAPSDPRLRQFLQKSLAAAAGKQELAKYFLAELLSEPNQTENDALEPEDLSQAAEQDEMRLELQRSANSNPAMAPRERKAGCKNFFWKTFTSC

SEQ ID NO: 58933 - protein, 1047 aa, Homo sapiens
MDAEAEDKTLRTRSKGTEVPMDSLIQELSVAYDCSMAKKRTAEDQALGVPVNKRKSLLMKPRHYSPKADCQEDRSDRTEDDGPLETHGHSTAEEIMIKPMDESLLSTAQENSSRKEDRYSCYQELMVKSLMHLGKFEKNVSVQTVSENLNDSGIQSLKAESDEADECFLIHSDDGRDKIDDSQPPFCSSDDNESNSESAENGWDSGSNFSEETKPPRVPKYVLTDHKKDLLEVPEIKTEGDKFIPCENRCDSETERKDPQNALAEPLDGNAQPSFPDVEEEDSESLAVMTEEGSDLEKAKGNLSLLEQAIALQAERGCVFHNTYKELDRFLLEHLAGERRQTKVIDMGGRQIFNNKHSPRPEKRETKCPIPGCDGTGHVTGLYPHHRSLSGCPHKVRVPLEILAMHENVLKCPTPGCTGRGHVNSNRNTHRSLSGCPIAAAEKLAMSQDKNQLDSPQTGQCPDQAHRTSLVKQIEFNFPSQAITSPRATVSKEQEKFGKVPFDYASFDAQVFGKRPLIQTVQGRKTPPFPESKHFPNPVKFPNRLPSAGAHTQSPGRASSYSYGQCSEDTHIAAAAAILNLSTRCREATDILSNKPQSLHAKGAEIEVDENGTLDLSMKKNRILDKSAPLTSSNTSIPTPSSSPFKTSSILVNAAFYQALCDQEGWDTPINYSKTHGKTEEEKEKDPVSSLENLEEKKFPGEASIPSPKPKLHARDLKKELITCPTPGCDGSGHVTGNYASHRSVSGCPLADKTLKSLMAANSQELKCPTPGCDGSGHVTGNYASHRSLSGCPRARKGGVKMTPTKEEKEDPELKCPVIGCDGQGHISGKYTSHRTASGCPLAAKRQKENPLNGASLSWKLNKQELPHCPLPGCNGLGHVNNVFVTHRSLSGCPLNAQVIKKGKVSEELMTIKLKATGGIESDEEIRHLDEEIKELNESNLKIEADMMKLQTQITSMESNLKTIEEENKLIEQNNESLLKELAGLSQALISSLADIQLPQMGPISEQNFEAYVNTLTDMYSNLERDYSPECKALLESIKQAVKGIHV

SEQ ID NO: 58934 - protein, 161 aa, Homo sapiens
MLMPVHFLLLLLLLLGGPRTGLPHKFYKAKPIFSCLNTALSEAEKGQWEDASLLSKRSFHYLRSRDASSGEEEEGKEKKTFPISGARGGARGTRYRYVSQAQPRGKPRQDTAKSPHRTKFTLSLDVPTNIMNLLFNIAKAKNLRAQAAANAHLMAQIGRKK

SEQ ID NO: 58935 - protein, 615 aa, Homo sapiens
MKALRLSASALFCLLLINGLGAAPPGRPEAQPPPLSSEHKEPVAGDAVPGPKDGSAPEVRGARNSEPQDEGELFQGVDPRALAAVLLQALDRPASPPAPSGSQQGPEEEAAEALLTETVRSQTHSLPAPESPEPAAPPRPQTPENGPEASDPSEELEALASLLQELRDFSPSSAKRQQETAAAETETRTHTLTRVNLESPGPERVWRASWGEFQARVPERAPLPPPAPSQFQARMPDSGPLPETHKFGEGVSSPKTHLGEALAPLSKAYQGVAAPFPKARRPESALLGGSEAGERLLQQGLAQVEAGRRQAEATRQAAAQEERLADLASDLLLQYLLQGGARQRGLGGRGLQEAAEERESAREEEEAEQERRGGEERVGEEDEEAAEAEAEAEEAERARQNALLFAEEEDGEAGAEDKRSQEETPGHRRKEAEGTEEGGEEEDDEEMDPQTIDSLIELSTKLHLPADDVVSIIEEVEEKRKRKKNAPPEPVPPPRAAPAPTHVRSPQPPPPAPAPARDELPDWNEVLPPWDREEDEVYPPGPYHPFPNYIRPRTLQPPSALRRRHYHHALPPSRHYPGREAQARRAQEEAEAEERRLQEQEELENYIEHVLLRRP

SEQ ID NO: 58936 - protein, 412 aa, Homo sapiens
MTSLYGSIHPADSVYLSTRTHGAVFNLEYSPDGSVLTVACEQTEVLLFDPISSKHIKTLSEAHEDCVNNIRFLDNRLFATCSDDTTIALWDLRKLNTKVCTLHGHTSWVKNIEYDTNTRLLVTSGFDGNVIIWDTNRYTEDGCPHKKFFHTRFLMRMRLTPDCSKMLISTSSGYLLILHDLDLTKSLEVGSYPILRARRTTSSSDLTTSSSSSGPRVSGSPCHHSDSNSSEKHMSRASQREGVSPRNSLEVVTPEVLGESDHGNCITSLQLHPKGWATLLRCSSNSDDEECTCVYEFQEGAPVRPVSPRCSLRLTHYIEEANVGRGYIKELCFSPDGRMISSPHGYGIRLLGFDKQCSELVDCLPKEASPLRVIRSLYSHNDVVLTTKFSPTHCQIASGCLSGRVSLYQPKF

SEQ ID NO: 58937 - protein, 528 aa, Homo sapiens
MSRVHGMHPKETTRQLSLAVKDGLIVETLTVGCKGSKAGIEQEGYWLPGDEIDWETENHDWYCFECHLPGEVLICDLCFRVYHSKCLSDEFRLRDSSSPWQCPVCRSIKKKNTNKQEMGTYLRFIVSRMKERAIDLNKKGKDNKHPMYRRLVHSAVDVPTIQEKVNEGKYRSYEEFKADAQLLLHNTVIFYGADSEQADIARMLYKDTCHELDELQLCKNCFYLSNARPDNWFCYPCIPNHELVWAKMKGFGFWPAKVMQKEDNQVDVRFFGHHHQRAWIPSENIQDITVNIHRLHVKRSMGWKKACDELELHQRFLREGRFWKSKNEDRGEEEAESSISSTSNEQLKVTQEPRAKKGRRNQSVEPKKEEPEPETEAVSSSQEIPTMPQPIEKVSVSTQTKKLSASSPRMLHRSTQTTNDGVCQSMCHDKYTKIFNDFKDRMKSDHKRETERVVREALEKLRSEMEEEKRQAVNKAVANMQGEMDRKCKQVKEKCKEEFVEEIKKLATQHKQLISQTKKKQWVNTSLF

SEQ ID NO: 58938 - protein, 256 aa, Homo sapiens
MQAVVPLNKMTAISPEPQTLASTEQNEVPRVVTSGEQEAILRGNAADAESFRQRFRWFCYSEVAGPRKALSQLWELCNQWLRPDIHTKEQILELLVFEQFLTILPGEIRIWVKSQHPESSEEVVTLIEDLTQMLEEKDPVSQDSTVSQEENSKEDKMVTVCPNTESCESITLKDVAVNFSRGEWKKLEPFQKELYKEVLLENLRNLEFLDFPVSKLELISQLKWVELPWLLEEVSKSSRLDIHGAVKKMQMFSEAE

SEQ ID NO: 58939 - protein, 744 aa, Homo sapiens
MQAVVPLNKMTAISPEPQTLASTEQNEVPRVVTSGEQEAILRGNAADAESFRQRFRWFCYSEVAGPRKALSQLWELCNQWLRPDIHTKEQILELLVFEQFLTILPGEIRIWVKSQHPESSEEVVTLIEDLTQMLEEKDPVSQDSTVSQEENSKEDKMVTVCPNTESCESITLKDVAVNFSRGEWKKLEPFQKELYKEVLLENLRNLEFLDFPVSKLELISQLKWVELPWLLEEVSKSSRLDESALDKIIERCLRDDDHGLMEESQQYCGSSEEDHGNQGNSKGRVAQNKTLGSGSRGKKFDPDKSPFGHNFKETSDLIKHLRVYLRKKSRRYNESKKPFSFHSDLVLNRKEKTAGEKSRKSNDGGKVLSHSSALTEHQKRQKIHLGDRSQKCSKCGIIFIRRSTLSRRKTPMCEKCRKDSCQEAALNKDEGNESGKKTHKCSKCGKAFGYSASLTKHRRIHTGEKPYMCNECGKAFSDSSSLTPHHRTHSGEKPFKCDDCGKGFTLSAHLIKHQRIHTGEKPYKCKDCGRPFSDSSSLIQHQRIHTGEKPYTCSNCGKSFSHSSSLSKHQRIHTGEKPYKCGECGKAFRQNSCLTRHQRIHTGEKPYLCNDCGMTFSHFTSVIYHQRLHSGEKPYKCNQCEKAFPTHSLLSRHQRIHTGVKPYKCKECGKSFSQSSSLNEHHRIHTGEKPYECNYCGATFSRSSILVEHLKIHTGRREYECNECEKTFKSNSGLIRHRGFHSAE

SEQ ID NO: 58940 - DNA, 20 bp, Homo sapiens
gatcgtcctgaagcggggtg

SEQ ID NO: 58941 - DNA, 20 bp, Homo sapiens
gatcctctcctttgaaacct

SEQ ID NO: 58942 - DNA, 20 bp, Homo sapiens
gatcttcacggacagctaca

SEQ ID NO: 58943 - DNA, 20 bp, Homo sapiens
gatcaattacctcctggtaa

SEQ ID NO: 58944 - DNA, 20 bp, Homo sapiens
gatccatttattgcaattca

SEQ ID NO: 58945 - DNA, 20 bp, Homo sapiens
gatctggaaatgaagatgaa

SEQ ID NO: 58946 - DNA, 20 bp, Homo sapiens
gatcttcagcagagttacta

SEQ ID NO: 58947 - DNA, 20 bp, Homo sapiens
gatcttgtgcataatttata

SEQ ID NO: 58948 - DNA, 20 bp, Homo sapiens
gatcaagaagaccagtcaga

SEQ ID NO: 58949 - DNA, 20 bp, Homo sapiens
gatctactggctgggcccac

SEQ ID NO: 58950 - DNA, 20 bp, Homo sapiens
gatccccgacagacacacag

SEQ ID NO: 58951 - DNA, 20 bp, Homo sapiens
gatcaaagtttttttcttca

SEQ ID NO: 58952 - DNA, 20 bp, Homo sapiens
gatcctgcacctggacgccg

SEQ ID NO: 58953 - DNA, 20 bp, Homo sapiens
gatccctggacaccccacac

SEQ ID NO: 58954 - DNA, 20 bp, Homo sapiens
gatcatgcagctccaccaaa

SEQ ID NO: 58955 - DNA, 20 bp, Homo sapiens
gatccaccctcaaatgtcag

SEQ ID NO: 58956 - DNA, 20 bp, Homo sapiens
gatctgaccgtccaggaaac

SEQ ID NO: 58957 - DNA, 20 bp, Homo sapiens
gatcaacctgtacgccaacg

SEQ ID NO: 58958 - DNA, 20 bp, Homo sapiens
gatcaccaagaagatgggca

SEQ ID NO: 58959 - DNA, 20 bp, Homo sapiens
gatcagcacatggccattgc

SEQ ID NO: 58960 - DNA, 20 bp, Homo sapiens
gatcagtaaccttcagacac

SEQ ID NO: 58961 - DNA, 20 bp, Homo sapiens
gatcataacgggcaggtccc

SEQ ID NO: 58962 - DNA, 20 bp, Homo sapiens
gatcatggccttagagactg

SEQ ID NO: 58963 - DNA, 20 bp, Homo sapiens
gatccccgagccctgacgct

SEQ ID NO: 58964 - DNA, 20 bp, Homo sapiens
gatcccgaaggccatagtta

SEQ ID NO: 58965 - DNA, 20 bp, Homo sapiens
gatcgccacacgcggaaacg

SEQ ID NO: 58966 - DNA, 20 bp, Homo sapiens
gatcgcctactggaccaact

SEQ ID NO: 58967 - DNA, 20 bp, Homo sapiens
gatcgggtcagcggggatga

SEQ ID NO: 58968 - DNA, 20 bp, Homo sapiens
gatctatggaggcgccttcc

SEQ ID NO: 58969 - DNA, 20 bp, Homo sapiens
gatctccaggtagccgctgt

SEQ ID NO: 58970 - DNA, 20 bp, Homo sapiens
gatctcctcgccgtcataca

SEQ ID NO: 58971 - DNA, 20 bp, Homo sapiens
gatcatcaatttgggaaaca

SEQ ID NO: 58972 - DNA, 20 bp, Homo sapiens
gatctgtaatgccaaactga

SEQ ID NO: 58973 - DNA, 20 bp, Homo sapiens
gatcaactaggctgattgac

SEQ ID NO: 58974 - DNA, 20 bp, Homo sapiens
gatcctggaaatcagggtta

SEQ ID NO: 58975 - DNA, 20 bp, Homo sapiens
gatccggaaaggcgagagtc

SEQ ID NO: 58976 - DNA, 20 bp, Homo sapiens
gatcctttccattctgagac

SEQ ID NO: 58977 - DNA, 20 bp, Homo sapiens
gatcgaccgacagacggacg

SEQ ID NO: 58978 - DNA, 20 bp, Homo sapiens
gatctccttgtagccaaggc

SEQ ID NO: 58979 - DNA, 20 bp, Homo sapiens
gatcatgtgatggctgcttc

SEQ ID NO: 58980 - DNA, 20 bp, Homo sapiens
gatcggaaacacatgctgcc

SEQ ID NO: 58981 - DNA, 20 bp, Homo sapiens
gatctgtttttcaccacttc

SEQ ID NO: 58982 - DNA, 20 bp, Homo sapiens
gatcaggatcttctccatgg

SEQ ID NO: 58983 - DNA, 20 bp, Homo sapiens
gatcattatcaacctggaga

SEQ ID NO: 58984 - DNA, 20 bp, Homo sapiens
gatcccccgggggccaggag

SEQ ID NO: 58985 - DNA, 20 bp, Homo sapiens
gatcctcctgcttgtcgccc

SEQ ID NO: 58986 - DNA, 20 bp, Homo sapiens
gatcttctccatggtgagtg

SEQ ID NO: 58987 - DNA, 20 bp, Homo sapiens
gatcccttggaattgcatcc

SEQ ID NO: 58988 - DNA, 20 bp, Homo sapiens
gatcagctttccaaggctgc

SEQ ID NO: 58989 - DNA, 20 bp, Homo sapiens
gatcatccccacagccaagg

SEQ ID NO: 58990 - DNA, 20 bp, Homo sapiens
gatcatggtctcatagctga

SEQ ID NO: 58991 - DNA, 20 bp, Homo sapiens
gatccagatggctggacgct

SEQ ID NO: 58992 - DNA, 20 bp, Homo sapiens
gatccagattggcaacacct

SEQ ID NO: 58993 - DNA, 20 bp, Homo sapiens
gatccagctcatcctggtca

SEQ ID NO: 58994 - DNA, 20 bp, Homo sapiens
gatcgacacgggcatccatt

SEQ ID NO: 58995 - DNA, 20 bp, Homo sapiens
gatcgaggacgtgcagtcgc

SEQ ID NO: 58996 - DNA, 20 bp, Homo sapiens
gatcgtcaccaaccctgatg

SEQ ID NO: 58997 - DNA, 20 bp, Homo sapiens
gatctatgacttcctggacc

SEQ ID NO: 58998 - DNA, 20 bp, Homo sapiens
gatctccaggaagatgtcca

SEQ ID NO: 58999 - DNA, 20 bp, Homo sapiens
gatctcctccagggtgtggt

SEQ ID NO: 59000 - DNA, 20 bp, Homo sapiens
gatctgggaggctggcagca

SEQ ID NO: 59001 - DNA, 20 bp, Homo sapiens
gatcttctttgcaaaccaga

SEQ ID NO: 59002 - DNA, 20 bp, Homo sapiens
gatcttgaccgcctggatgc

SEQ ID NO: 59003 - DNA, 20 bp, Homo sapiens
gatcttgctgacaaggtgcg

SEQ ID NO: 59004 - DNA, 20 bp, Homo sapiens
gatctttctggagtcccacg

SEQ ID NO: 59005 - DNA, 20 bp, Homo sapiens
gatccacaccaacacagagg

SEQ ID NO: 59006 - DNA, 20 bp, Homo sapiens
gatccatgctcgagagtggg

SEQ ID NO: 59007 - DNA, 20 bp, Homo sapiens
gatcccagcatccagccaga

SEQ ID NO: 59008 - DNA, 20 bp, Homo sapiens
gatcctaaccggaactggga

SEQ ID NO: 59009 - DNA, 20 bp, Homo sapiens
gatcctgcccacagccgagg

SEQ ID NO: 59010 - DNA, 20 bp, Homo sapiens
gatcctgttttttggtgccc

SEQ ID NO: 59011 - DNA, 20 bp, Homo sapiens
gatctgacgggctggcaaga

SEQ ID NO: 59012 - DNA, 20 bp, Homo sapiens
gatcaatacgaaaagatcta

SEQ ID NO: 59013 - DNA, 20 bp, Homo sapiens
gatcataataaaagtgaatc

SEQ ID NO: 59014 - DNA, 20 bp, Homo sapiens
gatcatcatttgggagtacg

SEQ ID NO: 59015 - DNA, 20 bp, Homo sapiens
gatccaagtgacagagcttc

SEQ ID NO: 59016 - DNA, 20 bp, Homo sapiens
gatccagtatgggtggagcg

SEQ ID NO: 59017 - DNA, 20 bp, Homo sapiens
gatcccaatctttcttttaa

SEQ ID NO: 59018 - DNA, 20 bp, Homo sapiens
gatccgggctacctgcgagg

SEQ ID NO: 59019 - DNA, 20 bp, Homo sapiens
gatctacccttactcatatg

SEQ ID NO: 59020 - DNA, 20 bp, Homo sapiens
gatctacctagtttaataga

SEQ ID NO: 59021 - DNA, 20 bp, Homo sapiens
gatctagctgcattggcaca

SEQ ID NO: 59022 - DNA, 20 bp, Homo sapiens
gatctcacgtccataggtac

SEQ ID NO: 59023 - DNA, 20 bp, Homo sapiens
gatctgcaaaacatccaggc

SEQ ID NO: 59024 - DNA, 20 bp, Homo sapiens
gatctgggattctggaagga

SEQ ID NO: 59025 - DNA, 20 bp, Homo sapiens
gatcttttcgtattgatcat

SEQ ID NO: 59026 - DNA, 20 bp, Homo sapiens
gatcctcctgccccaggact

SEQ ID NO: 59027 - DNA, 20 bp, Homo sapiens
gatcctggacaggccgctga

SEQ ID NO: 59028 - DNA, 20 bp, Homo sapiens
gatcctggctgccaactgag

SEQ ID NO: 59029 - DNA, 20 bp, Homo sapiens
gatcgccaaggtcttcaaga

SEQ ID NO: 59030 - DNA, 20 bp, Homo sapiens
gatcgtgaatggggaggacg

SEQ ID NO: 59031 - DNA, 20 bp, Homo sapiens
gatctgtgccggggccagtg

SEQ ID NO: 59032 - DNA, 20 bp, Homo sapiens
gatcttcaggacctggatgt

SEQ ID NO: 59033 - DNA, 20 bp, Homo sapiens
gatcttctgcacccaaggta

SEQ ID NO: 59034 - DNA, 20 bp, Homo sapiens
gatcctggccgccaactgag

SEQ ID NO: 59035 - DNA, 20 bp, Homo sapiens
gatcttctgcacccagggta

SEQ ID NO: 59036 - DNA, 20 bp, Homo sapiens
gatcaacgagaaaatgcagc

SEQ ID NO: 59037 - DNA, 20 bp, Homo sapiens
gatcacgccacgtgctccag

SEQ ID NO: 59038 - DNA, 20 bp, Homo sapiens
gatccaccacgggctgcagg

SEQ ID NO: 59039 - DNA, 20 bp, Homo sapiens
gatccagtcgatgtaggcgg

SEQ ID NO: 59040 - DNA, 20 bp, Homo sapiens
gatccctgtttgtgggtgtg

SEQ ID NO: 59041 - DNA, 20 bp, Homo sapiens
gatccttcttcgtcttccac

SEQ ID NO: 59042 - DNA, 20 bp, Homo sapiens
gatctccctccagtacctca

SEQ ID NO: 59043 - DNA, 20 bp, Homo sapiens
gatctgccagggccagctgt

SEQ ID NO: 59044 - DNA, 20 bp, Homo sapiens
gatcaaccaggtcatagcct

SEQ ID NO: 59045 - DNA, 20 bp, Homo sapiens
gatcatcaaacgcagagccc

SEQ ID NO: 59046 - DNA, 20 bp, Homo sapiens
gatcatggagtcagtgatac

SEQ ID NO: 59047 - DNA, 20 bp, Homo sapiens
gatccaggtgctgaacttgc

SEQ ID NO: 59048 - DNA, 20 bp, Homo sapiens
gatcggtcatactcgcccag

SEQ ID NO: 59049 - DNA, 20 bp, Homo sapiens
gatctgtgcaggtggcgcag

SEQ ID NO: 59050 - DNA, 20 bp, Homo sapiens
gatcacccgtcagaaacaac

SEQ ID NO: 59051 - DNA, 20 bp, Homo sapiens
gatcacttcagaagttgagg

SEQ ID NO: 59052 - DNA, 20 bp, Homo sapiens
gatcagtcaattacttacac

SEQ ID NO: 59053 - DNA, 20 bp, Homo sapiens
gatccaaatttggtggtgtt

SEQ ID NO: 59054 - DNA, 20 bp, Homo sapiens
gatcccttttcagacgaatg

SEQ ID NO: 59055 - DNA, 20 bp, Homo sapiens
gatccttccaaggtatccag

SEQ ID NO: 59056 - DNA, 20 bp, Homo sapiens
gatcgaagtgcaagtggcaa

SEQ ID NO: 59057 - DNA, 20 bp, Homo sapiens
gatctgaggtgtgcagacta

SEQ ID NO: 59058 - DNA, 20 bp, Homo sapiens
gatcttctacctttctgatt

SEQ ID NO: 59059 - DNA, 20 bp, Homo sapiens
gatctgcctgccttagcctc

SEQ ID NO: 59060 - DNA, 20 bp, Homo sapiens
gatccagagggcacctgcct

SEQ ID NO: 59061 - DNA, 20 bp, Homo sapiens
gatcaattcggtgattgcaa

SEQ ID NO: 59062 - DNA, 20 bp, Homo sapiens
gatcatactggttttcacgc

SEQ ID NO: 59063 - DNA, 20 bp, Homo sapiens
gatccagctggcctgcctcc

SEQ ID NO: 59064 - DNA, 20 bp, Homo sapiens
gatccagtcgatgtaattgg

SEQ ID NO: 59065 - DNA, 20 bp, Homo sapiens
gatctccagctgcaacggag

SEQ ID NO: 59066 - DNA, 20 bp, Homo sapiens
gatctgtgctgggggtgatg

SEQ ID NO: 59067 - DNA, 20 bp, Homo sapiens
gatcttgtcggtgagggaga

SEQ ID NO: 59068 - DNA, 20 bp, Homo sapiens
gatcatattcgtcttcacgg

SEQ ID NO: 59069 - DNA, 20 bp, Homo sapiens
gatccagtcgttgtagttgg

SEQ ID NO: 59070 - DNA, 20 bp, Homo sapiens
gatcacctgctcggggccct

SEQ ID NO: 59071 - DNA, 20 bp, Homo sapiens
gatcagcactgccagctggg

SEQ ID NO: 59072 - DNA, 20 bp, Homo sapiens
gatcccacatcctgaataaa

SEQ ID NO: 59073 - DNA, 20 bp, Homo sapiens
gatccccatcaactctgagg

SEQ ID NO: 59074 - DNA, 20 bp, Homo sapiens
gatccctcgagatgcagtgg

SEQ ID NO: 59075 - DNA, 20 bp, Homo sapiens
gatcgatcagcactgccagc

SEQ ID NO: 59076 - DNA, 20 bp, Homo sapiens
gatcgatcccacatcctgaa

SEQ ID NO: 59077 - DNA, 20 bp, Homo sapiens
gatctctcagaaaattccaa

SEQ ID NO: 59078 - DNA, 20 bp, Homo sapiens
gatctgacctaccaggtggt

SEQ ID NO: 59079 - DNA, 20 bp, Homo sapiens
gatctttattctttattcag

SEQ ID NO: 59080 - DNA, 20 bp, Homo sapiens
gatccccatcaactctgggg

SEQ ID NO: 59081 - DNA, 20 bp, Homo sapiens
gatccgactttatcaggctg

SEQ ID NO: 59082 - DNA, 20 bp, Homo sapiens
gatcacaaggtcaggagttc

SEQ ID NO: 59083 - DNA, 20 bp, Homo sapiens
gatctgtgcatcaaaaaaaa

SEQ ID NO: 59084 - DNA, 20 bp, Homo sapiens
gatccgagatgtgggcagag

SEQ ID NO: 59085 - DNA, 20 bp, Homo sapiens
gatccacattgacaccacgc

SEQ ID NO: 59086 - DNA, 20 bp, Homo sapiens
gatcccgactcacgaagagc

SEQ ID NO: 59087 - DNA, 20 bp, Homo sapiens
gatcaaccaaagtgattgat

SEQ ID NO: 59088 - DNA, 20 bp, Homo sapiens
gatctatcgaaacttttcac

SEQ ID NO: 59089 - DNA, 20 bp, Homo sapiens
gatcagatgaacgaggacaa

SEQ ID NO: 59090 - DNA, 20 bp, Homo sapiens
gatcatcttcacaacatcac

SEQ ID NO: 59091 - DNA, 20 bp, Homo sapiens
gatcggaataatttacattt

SEQ ID NO: 59092 - DNA, 20 bp, Homo sapiens
gatctgacatatctgcatta

SEQ ID NO: 59093 - DNA, 20 bp, Homo sapiens
gatctggatttctcctctgt

SEQ ID NO: 59094 - DNA, 20 bp, Homo sapiens
gatcttgaatagtgatatag

SEQ ID NO: 59095 - DNA, 20 bp, Homo sapiens
gatcaaggtgaaggtggaca

SEQ ID NO: 59096 - DNA, 20 bp, Homo sapiens
gatcacctgaggtcagcagt

SEQ ID NO: 59097 - DNA, 20 bp, Homo sapiens
gatctccctgggcccacagt

SEQ ID NO: 59098 - DNA, 20 bp, Homo sapiens
gatcctttgtaagattttgt

SEQ ID NO: 59099 - DNA, 20 bp, Homo sapiens
gatcctaaacagatgcattg

SEQ ID NO: 59100 - DNA, 20 bp, Homo sapiens
gatccaatacatatggcaag

SEQ ID NO: 59101 - DNA, 20 bp, Homo sapiens
gatcccacgttggtagatga

SEQ ID NO: 59102 - DNA, 20 bp, Homo sapiens
gatcataacacctacctcat

SEQ ID NO: 59103 - DNA, 20 bp, Homo sapiens
gatccccacattacagatga

SEQ ID NO: 59104 - DNA, 20 bp, Homo sapiens
gatcaaaccaaaaagtctta

SEQ ID NO: 59105 - DNA, 20 bp, Homo sapiens
gatcatctttgttgaggtag

SEQ ID NO: 59106 - DNA, 20 bp, Homo sapiens
gatccctttagaaaaaggct

SEQ ID NO: 59107 - DNA, 20 bp, Homo sapiens
gatctgcttaaagttttaac

SEQ ID NO: 59108 - DNA, 20 bp, Homo sapiens
gatccatcctttatcaagaa

SEQ ID NO: 59109 - DNA, 20 bp, Homo sapiens
gatctcaaaaaaagtgggga

SEQ ID NO: 59110 - DNA, 20 bp, Homo sapiens
gatcttcctcaaccacctgg

SEQ ID NO: 59111 - DNA, 20 bp, Homo sapiens
gatcaatagataaatgcaaa

SEQ ID NO: 59112 - DNA, 20 bp, Homo sapiens
gatcattacatttgtcagga

SEQ ID NO: 59113 - DNA, 20 bp, Homo sapiens
gatcatctggaaatgagaaa

SEQ ID NO: 59114 - DNA, 20 bp, Homo sapiens
gatccacttcacataagaca

SEQ ID NO: 59115 - DNA, 20 bp, Homo sapiens
gatcgaggacaccatagcgg

SEQ ID NO: 59116 - DNA, 20 bp, Homo sapiens
gatctccagtgtgtggacct

SEQ ID NO: 59117 - DNA, 20 bp, Homo sapiens
gatctgggctaaagtcctcc

SEQ ID NO: 59118 - DNA, 20 bp, Homo sapiens
gatcattacttttcaatgac

SEQ ID NO: 59119 - DNA, 20 bp, Homo sapiens
gatccgagagcagaccgggg

SEQ ID NO: 59120 - DNA, 20 bp, Homo sapiens
gatcatttgaaatcatggta

SEQ ID NO: 59121 - DNA, 20 bp, Homo sapiens
gatcctagtttctgtctcta

SEQ ID NO: 59122 - DNA, 20 bp, Homo sapiens
gatcagaatagccacatttg

SEQ ID NO: 59123 - DNA, 20 bp, Homo sapiens
gatctggctggtggggaccg

SEQ ID NO: 59124 - DNA, 20 bp, Homo sapiens
gatcttgcactggagaagga

SEQ ID NO: 59125 - DNA, 20 bp, Homo sapiens
gatctgggtggtgagccaat

SEQ ID NO: 59126 - DNA, 20 bp, Homo sapiens
gatccttgggagagggacac

SEQ ID NO: 59127 - DNA, 20 bp, Homo sapiens
gatcgattcatcattgaaga

SEQ ID NO: 59128 - DNA, 20 bp, Homo sapiens
gatctgtactggatgagcgg

SEQ ID NO: 59129 - DNA, 20 bp, Homo sapiens
gatcaaagttcctgttcacc

SEQ ID NO: 59130 - DNA, 20 bp, Homo sapiens
gatcgattccagtggtacca

SEQ ID NO: 59131 - DNA, 20 bp, Homo sapiens
gatctatgcaatttttaaac

SEQ ID NO: 59132 - DNA, 20 bp, Homo sapiens
gatctgtactgtaattttgt

SEQ ID NO: 59133 - DNA, 20 bp, Homo sapiens
gatcccaactcggacgacga

SEQ ID NO: 59134 - DNA, 20 bp, Homo sapiens
gatcacctatggccaaggta

SEQ ID NO: 59135 - DNA, 20 bp, Homo sapiens
gatcaaacatccatccagtc

SEQ ID NO: 59136 - DNA, 20 bp, Homo sapiens
gatcaacaagctttgccacg

SEQ ID NO: 59137 - DNA, 20 bp, Homo sapiens
gatcatggttttctttttaa

SEQ ID NO: 59138 - DNA, 20 bp, Homo sapiens
gatctacctgaagcaagaat

SEQ ID NO: 59139 - DNA, 20 bp, Homo sapiens
gatctattttggctgctagt

SEQ ID NO: 59140 - DNA, 20 bp, Homo sapiens
gatcactaatactaattcat

SEQ ID NO: 59141 - DNA, 20 bp, Homo sapiens
gatcataggtatttcaaaac

SEQ ID NO: 59142 - DNA, 20 bp, Homo sapiens
gatccaggggaggagcagcc

SEQ ID NO: 59143 - DNA, 20 bp, Homo sapiens
gatcccacaaacgagaacaa

SEQ ID NO: 59144 - DNA, 20 bp, Homo sapiens
gatcctgcctaacagaagat

SEQ ID NO: 59145 - DNA, 20 bp, Homo sapiens
gatcatgtttattgtggggc

SEQ ID NO: 59146 - DNA, 20 bp, Homo sapiens
gatcctcgggtgagagggct

SEQ ID NO: 59147 - DNA, 20 bp, Homo sapiens
gatcagcggccagttaagac

SEQ ID NO: 59148 - DNA, 20 bp, Homo sapiens
gatcccaatcagggggtatc

SEQ ID NO: 59149 - DNA, 20 bp, Homo sapiens
gatcattttgcggaactgcc

SEQ ID NO: 59150 - DNA, 20 bp, Homo sapiens
gatcccggggagtgacccct

SEQ ID NO: 59151 - DNA, 20 bp, Homo sapiens
gatctgcttgatggcctctc

SEQ ID NO: 59152 - DNA, 20 bp, Homo sapiens
gatcaacccaactttaccta

SEQ ID NO: 59153 - DNA, 20 bp, Homo sapiens
gatcacattgttataccaaa

SEQ ID NO: 59154 - DNA, 20 bp, Homo sapiens
gatcctgatgttctgcgagg

SEQ ID NO: 59155 - DNA, 20 bp, Homo sapiens
gatcgtgggagcagaagtgg

SEQ ID NO: 59156 - DNA, 20 bp, Homo sapiens
gatcaaagttgctttgtttg

SEQ ID NO: 59157 - DNA, 20 bp, Homo sapiens
gatcaaggatgcccacagat

SEQ ID NO: 59158 - DNA, 20 bp, Homo sapiens
gatcactgtgcaaaagggag

SEQ ID NO: 59159 - DNA, 20 bp, Homo sapiens
gatccaaccctgtaatcctg

SEQ ID NO: 59160 - DNA, 20 bp, Homo sapiens
gatccatcaacaattgaggc

SEQ ID NO: 59161 - DNA, 20 bp, Homo sapiens
gatcggcacccgcttcctgc

SEQ ID NO: 59162 - DNA, 20 bp, Homo sapiens
gatctagatggcatctgggc

SEQ ID NO: 59163 - DNA, 20 bp, Homo sapiens
gatctggacacgggaagcac

SEQ ID NO: 59164 - DNA, 20 bp, Homo sapiens
gatcttggtggcacccactt

SEQ ID NO: 59165 - DNA, 20 bp, Homo sapiens
gatccatctgacgccgtgtt

SEQ ID NO: 59166 - DNA, 20 bp, Homo sapiens
gatccctcaaaccagatgca

SEQ ID NO: 59167 - DNA, 20 bp, Homo sapiens
gatcctgcccacgcggcccc

SEQ ID NO: 59168 - DNA, 20 bp, Homo sapiens
gatcctttgaaaatctcata

SEQ ID NO: 59169 - DNA, 20 bp, Homo sapiens
gatcagctgcatactgggcc

SEQ ID NO: 59170 - DNA, 20 bp, Homo sapiens
gatctccgtagatacatcaa

SEQ ID NO: 59171 - DNA, 20 bp, Homo sapiens
gatcaggagtggattcatgg

SEQ ID NO: 59172 - DNA, 20 bp, Homo sapiens
gatcatccgccacccccaat

SEQ ID NO: 59173 - DNA, 20 bp, Homo sapiens
gatccttacctttgtggcag

SEQ ID NO: 59174 - DNA, 20 bp, Homo sapiens
gatcgttgggggctacaact

SEQ ID NO: 59175 - DNA, 20 bp, Homo sapiens
gatcttggctgcattgatga

SEQ ID NO: 59176 - DNA, 20 bp, Homo sapiens
gatcttgtcatcatcatcaa

SEQ ID NO: 59177 - DNA, 20 bp, Homo sapiens
gatcaagctctcctcacctg

SEQ ID NO: 59178 - DNA, 20 bp, Homo sapiens
gatcagaagtagattcatgg

SEQ ID NO: 59179 - DNA, 20 bp, Homo sapiens
gatcagcaggatgtcattgt

SEQ ID NO: 59180 - DNA, 20 bp, Homo sapiens
gatcatccgccaccccaaat

SEQ ID NO: 59181 - DNA, 20 bp, Homo sapiens
gatccttacctttgttgcag

SEQ ID NO: 59182 - DNA, 20 bp, Homo sapiens
gatcgttgggggctacatct

SEQ ID NO: 59183 - DNA, 20 bp, Homo sapiens
gatcaaactctcctcacctg

SEQ ID NO: 59184 - DNA, 20 bp, Homo sapiens
gatcagcatgatgtcattgt

SEQ ID NO: 59185 - DNA, 20 bp, Homo sapiens
gatcaggaatggattcatgg

SEQ ID NO: 59186 - DNA, 20 bp, Homo sapiens
gatccttgcctttgtgggag

SEQ ID NO: 59187 - DNA, 20 bp, Homo sapiens
gatcttggccgcattgatga

SEQ ID NO: 59188 - DNA, 20 bp, Homo sapiens
gatcctggctgagcatgtgc

SEQ ID NO: 59189 - DNA, 20 bp, Homo sapiens
gatcgtggagagaagcctgc

SEQ ID NO: 59190 - DNA, 20 bp, Homo sapiens
gatctctcaggagatggagc

SEQ ID NO: 59191 - DNA, 20 bp, Homo sapiens
gatcagggattctacagctg

SEQ ID NO: 59192 - DNA, 20 bp, Homo sapiens
gatcatccgtaaagtagcaa

SEQ ID NO: 59193 - DNA, 20 bp, Homo sapiens
gatcatgggaggtagtgtga

SEQ ID NO: 59194 - DNA, 20 bp, Homo sapiens
gatctaatattccaggaagg

SEQ ID NO: 59195 - DNA, 20 bp, Homo sapiens
gatcagcatgaagtatgagc

SEQ ID NO: 59196 - DNA, 20 bp, Homo sapiens
gatcagctgcccagaaggca

SEQ ID NO: 59197 - DNA, 20 bp, Homo sapiens
gatcagttctagacatgtat

SEQ ID NO: 59198 - DNA, 20 bp, Homo sapiens
gatccagcaattacaacgga

SEQ ID NO: 59199 - DNA, 20 bp, Homo sapiens
gatccgggcctggggcaact

SEQ ID NO: 59200 - DNA, 20 bp, Homo sapiens
gatctcctgcctgatgtttc

SEQ ID NO: 59201 - DNA, 20 bp, Homo sapiens
gatctctattgccagaacat

SEQ ID NO: 59202 - DNA, 20 bp, Homo sapiens
gatctgcatcaacccaggtc

SEQ ID NO: 59203 - DNA, 20 bp, Homo sapiens
gatcagcatgaagaacgagt

SEQ ID NO: 59204 - DNA, 20 bp, Homo sapiens
gatcagcgatgcaaactcat

SEQ ID NO: 59205 - DNA, 20 bp, Homo sapiens
gatccagtgtcccaggactt

SEQ ID NO: 59206 - DNA, 20 bp, Homo sapiens
gatccccgagcagtgctaat

SEQ ID NO: 59207 - DNA, 20 bp, Homo sapiens
gatctcctccctgatgttcc

SEQ ID NO: 59208 - DNA, 20 bp, Homo sapiens
gatcttcagtaccttcacct

SEQ ID NO: 59209 - DNA, 20 bp, Homo sapiens
gatccctcagccccactgag

SEQ ID NO: 59210 - DNA, 20 bp, Homo sapiens
gatccgctgtcccaaaggct

SEQ ID NO: 59211 - DNA, 20 bp, Homo sapiens
gatccgtgcagagggcagtt

SEQ ID NO: 59212 - DNA, 20 bp, Homo sapiens
gatccttcgtgtcctccctg

SEQ ID NO: 59213 - DNA, 20 bp, Homo sapiens
gatctgcatctgtccaggat

SEQ ID NO: 59214 - DNA, 20 bp, Homo sapiens
gatctggcctgccagaagcg

SEQ ID NO: 59215 - DNA, 20 bp, Homo sapiens
gatcatgacaaggtagtcag

SEQ ID NO: 59216 - DNA, 20 bp, Homo sapiens
gatccgtggagagggcagtt

SEQ ID NO: 59217 - DNA, 20 bp, Homo sapiens
gatcctccttctttttcctt

SEQ ID NO: 59218 - DNA, 20 bp, Homo sapiens
gatctcaagacatggaagac

SEQ ID NO: 59219 - DNA, 20 bp, Homo sapiens
gatctcagagaataataata

SEQ ID NO: 59220 - DNA, 20 bp, Homo sapiens
gatctggtatgctttgtctg

SEQ ID NO: 59221 - DNA, 20 bp, Homo sapiens
gatctcagaatcattgttta

SEQ ID NO: 59222 - DNA, 20 bp, Homo sapiens
gatcattaattcaaaccaag

SEQ ID NO: 59223 - DNA, 20 bp, Homo sapiens
gatctgttaatgaaagtgct

SEQ ID NO: 59224 - DNA, 20 bp, Homo sapiens
gatcttcatcccagtactgc

SEQ ID NO: 59225 - DNA, 20 bp, Homo sapiens
gatcacaaggaaggaatgat

SEQ ID NO: 59226 - DNA, 20 bp, Homo sapiens
gatccaggagtctttcaact

SEQ ID NO: 59227 - DNA, 20 bp, Homo sapiens
gatcttttgccatttttaca

SEQ ID NO: 59228 - DNA, 20 bp, Homo sapiens
gatcacagaaacatagtaag

SEQ ID NO: 59229 - DNA, 20 bp, Homo sapiens
gatctatccctgtctcactg

SEQ ID NO: 59230 - DNA, 20 bp, Homo sapiens
gatcttgctggtagaattgt

SEQ ID NO: 59231 - DNA, 20 bp, Homo sapiens
gatccagctgttttttgaac

SEQ ID NO: 59232 - DNA, 20 bp, Homo sapiens
gatcacagggatgtgtatgc

SEQ ID NO: 59233 - DNA, 20 bp, Homo sapiens
gatcatgagtctggctcaaa

SEQ ID NO: 59234 - DNA, 20 bp, Homo sapiens
gatctttatcaagaggtttc

SEQ ID NO: 59235 - DNA, 20 bp, Homo sapiens
gatcataaaaattaaaatgt

SEQ ID NO: 59236 - DNA, 20 bp, Homo sapiens
gatcattgcagattcacatt

SEQ ID NO: 59237 - DNA, 20 bp, Homo sapiens
gatccagagtaaagagaaga

SEQ ID NO: 59238 - DNA, 20 bp, Homo sapiens
gatccttatcctcatctgaa

SEQ ID NO: 59239 - DNA, 20 bp, Homo sapiens
gatcgaggactactcggagg

SEQ ID NO: 59240 - DNA, 20 bp, Homo sapiens
gatcacagggcaatctgttt

SEQ ID NO: 59241 - DNA, 20 bp, Homo sapiens
gatcagagcatttaagtaac

SEQ ID NO: 59242 - DNA, 20 bp, Homo sapiens
gatcagtagctgtgttcaat

SEQ ID NO: 59243 - DNA, 20 bp, Homo sapiens
gatcatatttcattgggtgg

SEQ ID NO: 59244 - DNA, 20 bp, Homo sapiens
gatcattaatgttttgatag

SEQ ID NO: 59245 - DNA, 20 bp, Homo sapiens
gatccaaatttgccactggc

SEQ ID NO: 59246 - DNA, 20 bp, Homo sapiens
gatctatttcagagtatcag

SEQ ID NO: 59247 - DNA, 20 bp, Homo sapiens
gatctcagtgcctcttcctt

SEQ ID NO: 59248 - DNA, 20 bp, Homo sapiens
gatcatggctgccaactgag

SEQ ID NO: 59249 - DNA, 20 bp, Homo sapiens
gatccatattgatatttatg

SEQ ID NO: 59250 - DNA, 20 bp, Homo sapiens
gatcagaggtctgatatgga

SEQ ID NO: 59251 - DNA, 20 bp, Homo sapiens
gatcagcaggcagcagcgat

SEQ ID NO: 59252 - DNA, 20 bp, Homo sapiens
gatccctcgcccccacaccc

SEQ ID NO: 59253 - DNA, 20 bp, Homo sapiens
gatccgcgcctagagtttga

SEQ ID NO: 59254 - DNA, 20 bp, Homo sapiens
gatctctgcagctcaagcct

SEQ ID NO: 59255 - DNA, 20 bp, Homo sapiens
gatctgctaactcaaacccg

SEQ ID NO: 59256 - DNA, 20 bp, Homo sapiens
gatctgtcccaggctgctga

SEQ ID NO: 59257 - DNA, 20 bp, Homo sapiens
gatcttcaggttccagggca

SEQ ID NO: 59258 - DNA, 20 bp, Homo sapiens
gatcaatactgtaaattggg

SEQ ID NO: 59259 - DNA, 20 bp, Homo sapiens
gatctgtcacttttatatac

SEQ ID NO: 59260 - DNA, 20 bp, Homo sapiens
gatccatctcctcgtcgtcc

SEQ ID NO: 59261 - DNA, 20 bp, Homo sapiens
gatcccagggcgggagcacc

SEQ ID NO: 59262 - DNA, 20 bp, Homo sapiens
gatccctccgaggagctcga

SEQ ID NO: 59263 - DNA, 20 bp, Homo sapiens
gatcgacagcctcattgagc

SEQ ID NO: 59264 - DNA, 20 bp, Homo sapiens
gatcgggaggaggacgaggt

SEQ ID NO: 59265 - DNA, 20 bp, Homo sapiens
gatctctcaaaaaaaaaaaa

SEQ ID NO: 59266 - DNA, 20 bp, Homo sapiens
gatcaggatttgggtaaagt

SEQ ID NO: 59267 - DNA, 4649 bp, Homo sapiens
cggacgcgtgggcggacgcgtgggcaaaagaactcggagtgccaaagctaaataagttagctgagaaaacgcacgcagtttgcagcgcctgcgccgggtgcgccaactacgcaaagaccaagcgggctccgcgcggaccggccgcggggctagggacccggctttggccttcaggctccctagcagcggggaaaaggaattgctgcccggagtttctgcggaggtggagggagatcaggaaacggcttcttcctcacttcgccgcctggtgagtgtcggggagattggcaaacgcctaggaaaggactggggaaaatagccctgggaaagtggagaaggtgatcaggaggccggtccactacggcagtttatctgtctgatcagagccagacgcgacgcgtccacttcgcagttctttccaggtgtggggaccgcaggacagacggccgatcccgccgccctccgtaccagcactcccaggagagtcagcctcgctccccaacgtcgagggcgctctggccacgaaaagttcctgtccactgtgattctcaattccttgcttggtttttttctccagagaacttttgggtggagatattaacttttttctttttttttttccttggtggaagctgctctagggaggggggaggaggaggagaaagtgaaatgtgctggagaagagcgagccctccttgttcttccggagtcccatccattaagccatcacttctggaagattaaagttgtcggacatggtgacagctgagaggagaggaggatttcttgccaggtggagagtcttcaccgtctgttgggtgcatgtgtgcgcccgcagcggcgcggggcgcgtggttctccgcgtggagtctcacctgggacctgagtgaatggctcccaggggctgtgcggggcatccgcctccgccttctccacaggcctgtgtctgtcctggaaagatgctagcaatgggggcgctggcaggattctggatcctctgcctcctcacttatggttacctgtcctggggccaggccttagaagaggaggaagaaggggccttactagctcaagctggagagaaactagagcccagcacaacttccacctcccagccccatctcattttcatcctagcggatgatcagggatttagagatgtgggttaccacggatctgagattaaaacacctactcttgacaagctcgctgccgaaggagttaaactggagaactactatgtccagcctatttgcacaccatccaggagtcagtttattactggaaagtatcagatacacaccggacttcaacattctatcataagacctacccaacccaactgtttacctctggacaatgccaccctacctcagaaactgaaggaggttggatattcaacgcatatggtcggaaaatggcacttgggttttaacagaaaagaatgcatgcccaccagaagaggatttgataccttttttggttcccttttgggaagtggggattactatacacactacaaatgtgacagtcctgggatgtgtggctatgacttgtatgaaaacgacaatgctgcctgggactatgacaatggcatatactccacacagatgtacactcagagagtacagcaaatcttagcttcccataaccccacaaagcctatatttttatatactgcctatcaagctgttcattcaccactgcaagctcctggcaggtatttcgaacactaccgatccattatcaacataaacaggagaagatatgctgccatgctttcctgcttagatgaagcaatcaacaacgtgacattggctctaaagacttatggtttctataacaacagcattatcatttactcttcagataatggtggccagcctacggcaggagggagtaactggcctctcagaggtagcaaaggaacatattgggaaggagggatccgggctgtaggctttgtgcatagcccacttctgaaaaacaagggaacagtgtgtaaggaacttgtgcacatcactgactggtaccccactctcatttcactggctgaaggacagattgatgaggacattcaactagatggctatgatatctgggagaccataagtgagggtcttcgctcaccccgagtagatattttgcataacattgacccctatacaccaaggcaaaaaatggctcctgggcagcaggctatgggatctggaacactgcaatccagtcagccatcagagtgcagcactggaaattgcttacaggaaatcctggctacagcgactgggtcccccctcagtctttcagcaacctgggaccgaaccggtggcacaatgaacggatcaccttgtcaactggcaaaagtgtatggcttttcaacatcacagccgacccatatgagagggtggacctatctaacaggtatccaggaatcgtgaagaagctcctacggaggctctcacagttcaacaaaactgcagtgccggtcaggtatccccccaaagaccccagaagtaaccctaggctcaatggaggggtctggggaccatggtataaagaggaaaccaagaaaaagaagccaagcaaaaatcaggctgagaaaaagcaaaagaaaagcaaaaaaaagaagaagaaacagcagaaagcagtctcaggtaaaccagcaaatttggctcgataatatcgctggcctaagcgtcaggcttgttttcatgctgtgccactccagagacttctgccacctggccgccacactgaaaactgtcctgctcagtgccaaggtgctactcttgcaagccacacttagagagagtggagatgtttatttctctcgctcctttagaaaacgtggtgagtcctgagttccactgctgtgcttcagtcaactgaccaaacactgctttgaattataggaggagaacaataacctaccatccgcaagcatgctaatttgatggaagttacagggtagcatgattaaaactacctttgataaattacagtcaaagattgtgtcacctcaaaggccttgaagaatatattttcttggtgaatttttgtatgtctgtcatatgacacttgggttttttaattaattctattttatatatataaatatatgtttcttttcctgtgaaaagctgtttttctcacatgtgaacagcttgcacctcattttaccatgcgtgagggaatggcaaataagaatgtttgagcacactgcccacaatgaatgtaactattttctaaacactttactagaagaacatttcagtataaaaaacctaatttatttttacagaaaaatattttgttgtttttataaaaagttatgcaaatgacttttatttttatttcctgcataccattagaagaattttatttcatttcttcaaattatcaagcactgtaatactataaattaatgtaatactgtgtgaattcagactataaaaaacatcattcagaaaactttataatcgtcattgttcaatcaagattttgaatgtaataagatgaatatattccttacaaattacttggaaattcaatgtttgtgcagagttgagacaactttattgtttctatcataaactatttatgtatcttaattattaaaatgatttactttatggcactagaaaatttactgtggcttttctgatctaacttctagctaaaattgtatcattggtcctaaaaaataaaaatctttactaataggcaattgaaggaatggtttgctaacaaccacagtaatataatatgattttacagatagatgcttccccttggctatgacatggagaaagattttcccataataataactaatatttatattaggttggtgcaaaactagttgcggtttttcccattaaaagtaataaccttactcttatacaaagtggacactgtggggagatacagagaaatggaagatacggatcctgcctggagtaggtaaccttgcttggaaaccccacatgcaaacgtcatgaggagaattaaaggagtattatcagtaatgaagtttatcatgggtcatcaatgagcatagattggtgtggatcctgtagaccctggtgttttctttgaagtgccctctcctaatgcagaggccttgaagcttacagtatacacttgaaaagtcacagatagctagaattatgatctttgaagttataactgtgatctgaaaatgtgtgtggtggtatgacagcataccattaaatacatttacatcacagctcaaaggactgtgatataatccatttatatcacaactcaaaggactgtgatataatccatttatatcacagctcacagtttctgaaaatgtataaaagaatctataatctagtactgaaattactaaattgggtaagatgatttaaatgattttaattttaacattttatttctagaatatatggctccattttattttatagtgtaaagttgtatttcctaaagtttgtgttttgtcgacagtatcttttaaatgagtcttaaaaataaaggcatattgttcatgtttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 59268 - DNA, 4612 bp, Homo sapiens
gcggcgggggcggccatcgtgctgcgcagcctgggcgcttggggagccgcccacttcgccgggtcgcgccccgacggccggagcgtggatgcggcggcgcccgccgagccggggcggacgcggggcggcccgggcccgggagacgcgccggcagccccggcaccgcagcggtcgcaggatggccgaggctatcagctgtactctgaactgtagttgccaaagtttcaaacccgggaaaataaaccaccgtcagtgtgaccaatgcaagcatggatgggtggcccacgctctaagtaagctaaggatcccccccatgtatccaacaagccaggtggagattgtccagtccaatgtagtgtttgatattagcagcctcatgctctatgggacccaggccatccccgttcgcctaaaaatcctactggaccggctcttcagtgtgttgaagcaagatgaggttctccagatcctccatgccttggactggacacttcaggattatatccgtggatacgtactgcaggatgcatcaggaaaggtgttggatcactggtgcatcatgaccagtgaggaagaagtggccaccttgcagcagttccttcgttttggagagaccaaatctatagttgaactcatggcaattcaagagaaagaagagcaatccatcatcataccaccttccacagcaaatgtagatatcagggctttcatcgagagctgcagtcacaggagttctagcctccccactcctgtggacaaaggaaaccccagcagtatacacccctttgagaacctcataagcaacatgactttcatgctgcctttccagttcttcaaccctctgcctcctgcactgatagggtcattgcccgaacaatatatgttggagcagggtcatgaccaaagtcaggaccccaaacaggaagtccatgggcccaaccctgacagcagcttcttaacttccagttccacaccatttcaggttgaaaaagatcagtgtttaaactgtccggatgctattactaaaaaagaagacagcacccatttaagtgactccagctcatacaacattgtcactaagtttgaaaggacacagttatcccctgaggccaaagtgaagcctgagaggaatagccttggtacaaagaagggccgggtgttctgcactgcatgtgagaagaccttctatgacaaaggcaccctcaaaatccactacaatgccgtccacttgaagatcaagcataagtgcaccatcgaagggtgtaacatggtgttcagctccctaaggacgcggaatcgccatagcgccaaccccaaccctcggctgcacatgccaatgaacagaaataaccgggacaaagacctcaggaacagcctgaacctggccagctctgagaactacaagtgcccaggtttcacagtgacgtccccagactgtaggcctcctcccagctaccctggttcaggagaggattccaaaggccaaccagccttcccaaacattgggcaaaatggtgtgctttttcccaacctaaagacagtccagccagtccttcctttctaccgcagtccagccacgcctgccgaggtagcaaacacgcctgggatactcccttccctcccgctgttgtcctcttcaatcccagaacagctcatttcaaacgaaatgccatttgatgcccttcccaagaagaaatccaggaagtccagtatgcctatcaaaatagagaaagaagctgtggaaatagctaatgagaaaagacacaacctcagctcagatgaagacatgcccctacaggtggtcagtgaagatgagcaggaggcctgcagtcctcagtcacacagagtatctgaggagcagcatgtacagtcaggaggcttagggaagcctttccctgaaggggagaggccctgccatcgtgaatcagtaattgagtccagtggagccatcagccaaacccctgagcaggccacacacaattcagagagggagactgagcatacaccagcattgatcatggtgccaagggaggtcgaggatggtggccatgaacactacttcacacctgggatggaaccccaagttcctttttctgactacatggaactgcagcagcgcctgctggctgggggactcttcagtgctttgtccaacaggggaatggcttttccttgtcttgaagattctaaagaactggagcacgtgggtcagcatgcattagcaaggcagatagaagaaaatcgcttccagtgtgacatctgcaagaagacctttaaaaatgcttgtagtgtgaaaattcatcacaagaatatgcatgtcaaagaaatgcacacatgcacagtggagggctgtaatgctacctttccctcccgcaggagcagagacagacacagctcaaacctaaacctccaccaaaaagcattgagccaggaagcattggagagtagtgaagatcatttccgtgcagcttaccttctgaaagatgtggctaaggaagcctatcaggatgtggcttttacacagcaagcctcccagacatctgtcatcttcaaaggaacaagtcgaatgggcagtctggtttacccaataacgcaagtccacagtgccagcctggagagctacaactctggccccttgagcgagggcaccatcctggatttgagcactacctcgagcatgaagtcagagagtagcagccattcttcctgggactctgacggggtgagtgaggaaggcactgtgcttatggaggacagtgatgggaactgtgaagggtcgagccttgtccctggggaagatgagtaccccatctgtgtcctgatggagaaggctgaccagagccttgctagcctgccttctgggttgcccataacctgtcatctctgccaaaagacatacagtaacaaagggacctttagggcccactacaaaactgtgcacctccggcagctccacaaatgcaaagtaccaggctgcaacaccatgttttcgtctgttcgcagtcgaaacagacacagccagaatcccaacctgcacaaaagcctggcctcatctccaagtcacctccagtaacaagatggcaaaccaagtatgctcagataagcttttttcataattcaggaataaagtagtccatagaaatgtttctgtttcatatcatttggggcgagtcaggcaaaagtatttgatttgactttatagttttccacagcacaatgagcaaaagacaaacctcgtgggaagatgacactggggcagcccttcctattatttttcttagcccaagaggtctttcactgatacaaggaaaacttgcagaaatgtgatttttcccagatttgtttacatgttccctgggacagatccaggtctgcagatcgacaccagtgggcccaggacctgggggtggctttaaatgaggcttgcagtgttaaaggtcttggataagaagggtcctggggaagaagactctgtggacaagataccagtccccaaaacagcattttcagttccttcttcaattagtttgaaatccagacctgagtttggaagactgattttttgagaccatccctgtgtttggagtggataattgtccctcccctcagccctgcaccagaggtctcatatgttaccccagggagttctcagaggattgggttggcctctaacatgttccttgttaattcttgttctgtaacatgcattcaagaagctaggggaaaaatatctcatgcacttaaataatggtcttcaatttaatttaaaaatattttgacaatatttaatttgtgcttatgtggtgtttggtgtgagtgcagatattgcactgtgtcacctctggatctctgctcagaagcagaacaagtgatgacctaaatgtcaaaatcactgctcgttttcatttggtgaacttcaaactctgttctttttggtcacctgtggaatgaatgcaagcatgattttggcaggaacatttgtacatattctgccgtagataatgtggttctgatggttgttgtgtattttcagtatcactggatccctcagtcttcaccgttttataaacgtataagattaggatgaacttttgaatttacttggtaggaaaaaaagtaggacattattgccatattgtatgtcttaatatttaacttattcggaaatatattccacactgttacatacattttccatggtagaaaggaagttcagtcagtcctgtggaatgaaaccatctcctaaaattcagcatttgcagcattctaaaagcctgtgtaggtacaaggacattgattttgtattcagaattcaagttaactatcttttaaattcgtggttgatgtaagtaataaaaaacattcttaaagttgagggttataagagagattatttctgtggtctaaaggttaaaaagccaacaacctgttaccaattatttcagctttttttgttttaataagtgtgacaacttaaaacttgtttctatttaaagtgaaatgtatctttcaactgtttagttacccagctgtttaatattccagtcttcccaaagtgaaaagatttgtatacaaatgttttctatgatttaataaaaatatatggcacacc

SEQ ID NO: 59269 - DNA, 5168 bp, Homo sapiens
ctggagtctcccctggtcgggagcctcagccttctggagactgacaccaccctcttactcagagacgaatcgttttgtcgttgccttcacctccctgaccacaagtgctccggggctctttctaagggaggcagctgttctaggcgggaggctggagtctcctgggcctggacgcaccccggggtgtgagtgatgggtatgcctgaaaggaggggaagtggcgcggctttaatcatctgggctagtccccggcgggcctgggggaacagggaaactggaggcggccttaaagcgtcaggatgagacatcgcaagaggagctgcagatactgagcgtgcgccccgggttctcgccgccttctctccgccgagcagcccttcggccaccctttgcccttaaaaatctgcagactgcgcctcctctccgcgggagcgagacctagcaggcccggggctgggcgtgccctcgcctgccacgctgcgcgctgccctcagccgggccgctggggccgtgcagtgcaccgggcacgccgcgccaggctgggggcaggcaccgagcctccgtgggaggtcccgaggcagcttcgcctgctcgccctggctccagccctcacctgccgcagccttagctgagcagccgccgccactgggcgccccccgctccccacttcgccagcgcccgctcctcggctcggcccggggtagtttgtagggacgcagctctccacgtgcgcgactgcgaggctggacgctacgggctcctggaaaggagacaccagcatttgccacaatgctgtcatccactgactttacatttgcttcctgggagcttgtggtccgcgttgaccatcccaatgaagagcagcagaaagacgtcacactgagagtatctggagaccttcatgttggaggagtgatgctcaagttagtagaacagatcaatatatcccaagactggtcagactttgctctttggtgggaacagaagcattgctggcttctgaaaacccactggaccctggacaaatatggggtccaggcagatgcaaagcttctcttcacccctcagcataaaatgctgcgccttcgtctgccgaatttgaagatggtgaggttgcgagtcagcttctcagctgtggtttttaaagctgtcagtgatatctgcaaaatcctgaatattagaagatcagaagagctttccttgttaaagccgtctggtgactattttaagaagaagaagaaaaaagacaaaaataataaggaacccataattgaagatattctaaacctggagagttctccaacagcttcaggttcatcagtaagtcctggtttatacagtaaaaccatgacccctatatatgaccccatcaatggaacaccagcatcatccaccatgacttggttcagtgacagccctttgacggaacaaaactgcagcatcctcgcattcagccaacccccccagtccccagaagcacttgcggatatgtaccagcctcggtctctggttgataaagccaagctcaatgcaggttggctagactcctcacgctcccttatggaacaaggcatccaagaggatgagcagctgctcttacgatttaaatattattctttcttcgacttgaatcctaaatatgatgctgtccgaataaaccaactctatgagcaagccaggtgggccattctcttagaagaaattgattgcacagaggaagaaatgttgatctttgcagctctacagtaccacattagcaaactgtcgttgtctgctgaaacacaggattttgcaggcgagtccgaggttgatgaaatagaagcggcgctttctaatttggaagtaaccctagaaggtggaaaagcggacagccttttggaggacattactgatatccctaaacttgcagataatctcaaattatttaggcccaagaagttactaccaaaagctttcaaacaatattggtttatctttaaagacacatccatagcatactttaaaaataaggaacttgaacaaggagaaccactagaaaaactaaatcttagaggctgcgaagttgtgcccgatgtaaatgtagcaggaagaaaatttggaatcaagttactaatccctgttgccgatggtatgaatgaaatgtatttgagatgtgaccatgagaatcaatacgcccaatggatggctgcctgcatgttggcatcgaagggcaaaaccatggcagacagctcctaccagccagaggtcctcaacatcctttcatttctgaggatgaaaaacaggaactctgcatctcaggtggcttccagtctcgaaaacatggatatgaacccagaatgttttgtgtcaccacggtgtgcaaagaaacacaaatccaaacagctggccgcccggatcctggaggcgcaccagaacgtggcccagatgcccctggtcgaagccaagctgcggttcatccaggcgtggcagtcactgcctgagtttggcctcacctactaccttgtcagatttaaaggaagcaaaaaagatgacattctgggagtttcatataacaggttgattaaaattgatgcagccaccgggattccagtgacaacatggagattcacaaatatcaaacagtggaatgtaaactgggaaacccggcaggtggtcatcgagtttgaccaaaacgtctttactgctttcacctgcctgagtgcagattgcaagattgtgcacgagtacattggcggctacattttcttgtccacccgctccaaggaccagaatgaaacactcgatgaggacttgttccacaaattgaccggcggtcaggattgaaacaagcacgcgtgctcggctcacaccaacaaggcaagccaaaggcgcccctccccagagggatccctaacgtgcccagcatgtagattctggactaacagacaacatacattcaccgctggtcacccagatcctcattcaaacccactgctggcacatccctttccttactttgccctgtgctaccagccacggaaggagcctctcttgttttttctataaaatgggtaggcaggagaaaagcaggtgccctaagattgctctaaggcccagcatgtggttacagttctctgacttgcagaacctgccaggtgtatggctacaagttatcctcgtgctgatctgtctcattactaagtcaatggagaagacagaaaggtaaaaatcacgtgtagcaagaacaactcttatttcacaaactcaggtatgaaacgaaacgcctgtccttcatggaactgcttttagctcctgtcttttcaaaatggcagagggagttcctacacacactttttccctggaggccaaggtctaggggtagaaaggggaggggtggggctaccaggtagcagttgacaacccaaggtcagaggagtggccctcagtgtcatctgtccacagtgatacctgccaagatgaccactgacccacatctggtcttagtcattggtctcctcagatttctggggccacctgcaagccccattccattcctacagatctctcagccacctgtaagtcctttgtgaagatgtgggtgacacagggggacaggaaaacccatttctcaacccagatccatgtctccactgcttctactctgggttgggattcaggaagacaggcacagtcctctctgttcatagaaacacctgccagtgtcaaggattccagtcaggtgtctatcccaactggtcagggagagaagggcagacccattctcaaagaccaccatgtccaaggtctgacagctccccactggctgcccccacaggggctttaggctggtctgggtcatggggaagcgtccctcttatcgctggtctgtgttctcctggatttggtatctatgttggtacgactcctggccttttatctaaaggactttggcttttgtaaatcacaagccaataatagacttttttctccccctctgttttttgctgtgtcatctctgccttgagactgccttgagacagtgcttgccttgagagagtgagccaattaacagctgcctgaattgtcattttccattttggtttgttagaggtgggaggggtgggttttgagaaggtcaaaagcaataccagaagtaaagggaaatatcagacaatattttattattttttcatagatgttctgccacacaaagaacttggggtgtaaggataaggcaaaagctccaatcccatttttcagttctcctaggatgcacccctcagggagcctggccagagttccgaggctcgtgagcgtcagctgttgctttattttccatcaaagccctctgagaagtgagacctcagcaattccgggagccacatagagacagacttggcaagggaccccctggttctgagccagtagctgccatctggaaattcctcttttagcctctccttagaggtgaatgtgaatgaagcctcccaggcacccgctgaatttctgaggccttgcttaaagctcagaagtggtttaggcatttggaaaatctggttcacatcataaagaacttgatttgaaatgttttctatagaaacaagtgctaagtgtaccgtattatacttgatgttggtcatttctcagtcctatttctcagttctattattttagaacctagtcagttctttaagattataactggtcctacattaaaataatgcttctcgatgtcagattttacctgtttgctgctgagaacatctctgcctaatttaccaaagccagaccttcagttcaacatgcttccttagcttttcatagttgtctgacatttccatgaaaacaaaggaaccaactttgttttaaccaaactttgtttggttacagttttcaggggagcgtttcttccatgacacacagcaacatcccaaagaaataaacaagtgtgacaaaaaaaaaaaaaaacaaacctaaatgctactgttccaaagagcaacttgatggttttttttaatactgagtgcaaaaggtcacccaaattcctatgatgaaattttaaattaatgggcacctttcaacatcatttgcttccttatctacagttgattcagaaatctgcattttttattcttttatatgacttttaagtaaaagatttatatggatttgaaaaaaaaaaaaaaaaa

SEQ ID NO: 59270 - DNA, 1302 bp, Homo sapiens
gagacagcccgccggccgcccggatctccacctgccaccccagagctgggacagcagccgggctgcggcactgggagggagaccccacagtggcctcttctgccacccacgcccccacccctggcatggccgaccagctgactgaggagcaggtcacagaattcaaggaggccttctccctgtttgacaaggatggggacggctgcatcaccacccgcgagctgggcacggtcatgcggtccctgggccagaaccccacggaggccgagctgcgggacatgatgagtgagatcgaccgggacggcaacggcaccgtggacttccccgagttcctgggcatgatggccaggaagatgaaggacacggacaacgaggaggagatccgcgaggccttccgcgtgttcgacaaggacggcaacggcttcgtcagcgccgccgagctgcgacacgtcatgacccggctgggggagaagctgagtgacgaggaggtggacgagatgatccgggccgcggacacggacggagacggacaggtgaactacgaggagtttgtccgtgtgctggtgtccaagtgaggccggcgcccaccatgctcctgggcgcccacgcggcccacagggcaagaacccggggcctcccgcctcctcccccatccccctgcctcccctgggcactgtggcttcctcctgcgcctggttgattcagcccacctctctgcatcccgcttcccgcgtctcttctctgcactcctgccgaccttcccacctgctcatctgaatgacacggaacgctcccactgcaggcaaaccgtgacgccctccccactcgggagaagcagagctgaccttaggaccgagcaccagggcaggttgcgctgactctgcggccctccaggacggacaccgggtgaccccttagggcacccaggcaagatccctaagaggcacccaatgcccaggccaggggggctgcagccctcagcccccgccaggattcccgcaggctcctggactggaagctccctccgcggtcggattctggagggtgggaggcatcttggcctgcagtaagcggtgctgacggggactctggccacagaggtcaggcctcctgaaaacagcactgccttccgcgctgccccagcttgccccattccttgtccgccaacccaccgtgattcatcttctgaagctgggagtgaaactgggtcagctgtaacctgttcctattcatctggaaggagggaggcttggatgagcaggggatgagagctgcagggaaataaatgagatattcgtcctt

SEQ ID NO: 59271 - DNA, 2863 bp, Homo sapiens
tggggctcaaattgggtgccctggtgaaggaggggggcacactccagaacctagtccaaccccagacgctgcctgaggcttccctccagctcccctcccttccttttctccctttcctccctccctctctttccctttctccctccccgctaaggctggcgtgccagggggtgggacatgccaatcactggctgtgcctctcccgctgccagcacagggcgcagctccccctgggagccaggtgtttgggtccctggagacgccgcaggcccccagggaggcagtggggctgaggaccctacagacccctcttcagccccgtggtgatgactttcccctgaggaagccctgtagcgtgcctggaggaaggggctctccaaccccagccccacctagccaccatgaacacttcagccccacctgctgtcagccccaacatcaccgtcctggcaccaggaaagggtccctggcaagtggccttcattgggatcaccacgggcctcctgtcgctagccacagtgacaggcaacctgctggtactcatctctttcaaggtcaacacggagctcaagacagtcaataactacttcctgctgagcctggcctgtgctgacctcatcatcggtaccttctccatgaacctctataccacgtacctgctcatgggccactgggctctgggcacgctggcttgtgacctctggctggccctggactatgtggccagcaatgcctccgtcatgaatctgctgctcatcagctttgaccgctacttctccgtgactcggcccctgagctaccgtgccaagcgcacaccccgccgggcagctctgatgatcggcctggcctggctggtttcctttgtgctctgggccccagccatcctcttctggcagtacctggtaggggagcggacagtgctagctgggcagtgctacatccagttcctctcccagcccatcatcacctttggcacagccatggctgccttctacctccctgtcacagtcatgtgcacgctctactggcgcatctaccgggagacagagaaccgagcacgggagctggcagcccttcagggctccgagacgccaggcaaagggggtggcagcagcagcagctcagagaggtctcagccaggggctgagggctcaccagagactcctccaggccgctgctgtcgctgctgccgggcccccaggctgctgcaggcctacagctggaaggaagaagaggaagaggacgaaggctccatggagtccctcacatcctcagagggagaggagcctggctccgaagtggtgatcaagatgccaatggtggaccccgaggcacaggcccccaccaagcagcccccacggagctccccaaatacagtcaagaggccgactaagaaagggcgtgatcgagctggcaagggccagaagccccgtggaaaggagcagctggccaagcggaagaccttctcgctggtcaaggagaagaaggcggctcggaccctgagtgccatcctcctggccttcatcctcacctggacaccgtacaacatcatggtgctggtgtccaccttctgcaaggactgtgttcccgagaccctgtgggagctgggctactggctgtgctacgtcaacagcaccatcaaccccatgtgctacgcactctgcaacaaagccttccgggacacctttcgcctgctgctgctttgccgctgggacaagagacgctggcgcaagatccccaagcgccctggctccgtgcaccgcactccctcccgccaatgctgatagtcccctctcctgcatccctccaccccagtccccgggaaaggccggtgggaagagggcaggggctgcatcctcagccccagggccctgctcaggcctcacctggcttcccaggaccctgggtcaccttcctgggcagcccagagagaccctgccaactttccagacttcgctattcccaggcagggagggaaacccggggaactggtttttctgttccctgctgggtgggaatgcgctcttcaccaggaagaaggcccgggaggaggatccgggctttggactccttgtttgcctttaggcaggaagtcaggagccagcagggcgggccaggagaaagaaggcttaacattaagtattccttggcccagcagcggcccagattgcggtgtgagatggtgccccctggggggcacagccagaaactgaactggccgctgggagaaaagccagatgacagggagctggggaatcccctcgcttcataggcagagcccgcccacctgggccctaggcatactctccaggattgtccacaaatgtcctcagagggtccctaggtgggtcaactccaaggcaaatgtccaagcatcagcaagacaatgacactggaagggtccggcttggctagtcacatatcaagtcccgaggcagcaacaggaccaggagccaggtgtcctgactgtcctacaatatcattttcctgggagtgggagtcaagtgtgcctgctatccagccgcaaatccataccccctgccccagagaagcctcagtccctccctcctggctcacagccaccacctggatggatctgctccatgcagatctagccaggcctcccgcatgctgcctgcctccggccctgccccacacaggcctggcccagccagcaggttctctcctgtgagctccccaatccaacccatgcatggcctcccagccacccggatctccaggcccagcctggccccaaatgttctttcctttcatcctcagcaagtgctgagtctgtgaataaagccacataaccagcgggcaaaaaaaaaaaaaaaaaaaaaaaaaaaaaaaaaaaaaaaaa

SEQ ID NO: 59272 - DNA, 4007 bp, Homo sapiens
ctaaaaccttgcaagttcaggaagaaaccatctgcatccatattgaaaacctgacacaatgtatgcagcaggctcagtgtgagtgaactggaggcttctctacaacatgacccaaaggagcattgcaggtcctatttgcaacctgaagtttgtgactctcctggttgccttaagttcagaactcccattcctgggagctggagtacagcttcaagacaatgggtataatggattgctcattgcaattaatcctcaggtacctgagaatcagaacctcatctcaaacattaaggaaatgataactgaagcttcattttacctatttaatgctaccaagagaagagtatttttcagaaatataaagattttaatacctgccacatggaaagctaataataacagcaaaataaaacaagaatcatatgaaaaggcaaatgtcatagtgactgactggtatggggcacatggagatgatccatacaccctacaatacagagggtgtggaaaagagggaaaatacattcatttcacacctaatttcctactgaatgataacttaacagctggctacggatcacgaggccgagtgtttgtccatgaatgggcccacctccgttggggtgtgttcgatgagtataacaatgacaaacctttctacataaatgggcaaaatcaaattaaagtgacaaggtgttcatctgacatcacaggcatttttgtgtgtgaaaaaggtccttgcccccaagaaaactgtattattagtaagctttttaaagaaggatgcacctttatctacaatagcacccaaaatgcaactgcatcaataatgttcatgcaaagtttatcttctgtggttgaattttgtaatgcaagtacccacaaccaagaagcaccaaacctacagaaccagatgtgcagcctcagaagtgcatgggatgtaatcacagactctgctgactttcaccacagctttcccatgaatgggactgagcttccacctcctcccacattctcgcttgtacaggctggtgacaaagtggtctgtttagtgctggatgtgtccagcaagatggcagaggctgacagactccttcaactacaacaagccgcagaattttatttgatgcagattgttgaaattcataccttcgtgggcattgccagtttcgacagcaaaggagagatcagagcccagctacaccaaattaacagcaatgatgatcgaaagttgctggtttcatatctgcccaccactgtatcagctaaaacagacatcagcatttgttcagggcttaagaaaggatttgaggtggttgaaaaactgaatggaaaagcttatggctctgtgatgatattagtgaccagcggagatgataagcttcttggcaattgcttacccactgtgctcagcagtggttcaacaattcactccattgccctgggttcatctgcagccccaaatctggaggaattatcacgtcttacaggaggtttaaagttctttgttccagatatatcaaactccaatagcatgattgatgctttcagtagaatttcctctggaactggagacattttccagcaacatattcagcttgaaagtacaggtgaaaatgtcaaacctcaccatcaattgaaaaacacagtgactgtggataatactgtgggcaacgacactatgtttctagttacgtggcaggccagtggtcctcctgagattatattatttgatcctgatggacgaaaatactacacaaataattttatcaccaatctaacttttcggacagctagtctttggattccaggaacagctaagcctgggcactggacttacaccctgaacaatacccatcattctctgcaagccctgaaagtgacagtgacctctcgcgcctccaactcagctgtgcccccagccactgtggaagcctttgtggaaagagacagcctccattttcctcatcctgtgatgatttatgccaatgtgaaacagggattttatcccattcttaatgccactgtcactgccacagttgagccagagactggagatcctgttacgctgagactccttgatgatggagcaggtgctgatgttataaaaaatgatggaatttactcgaggtattttttctcctttgctgcaaatggtagatatagcttgaaagtgcatgtcaatcactctcccagcataagcaccccagcccactctattccagggagtcatgctatgtatgtaccaggttacacagcaaacggtaatattcagatgaatgctccaaggaaatcagtaggcagaaatgaggaggagcgaaagtggggctttagccgagtcagctcaggaggctccttttcagtgctgggagttccagctggcccccaccctgatgtgtttccaccatgcaaaattattgacctggaagctgtaaaagtagaagaggaattgaccctatcttggacagcacctggagaagactttgatcagggccaggctacaagctatgaaataagaatgagtaaaagtctacagaatatccaagatgactttaacaatgctattttagtaaatacatcaaagcgaaatcctcagcaagctggcatcagggagatatttacgttctcaccccaaatttccacgaatggacctgaacatcagccaaatggagaaacacatgaaagccacagaatttatgttgcaatacgagcaatggataggaactccttacagtctgctgtatctaacattgcccaggcgcctctgtttattccccccaattctgatcctgtacctgccagagattatcttatattgaaaggagttttaacagcaatgggtttgataggaatcatttgccttattatagttgtgacacatcatactttaagcaggaaaaagagagcagacaagaaagagaatggaacaaaattattataaataaatatccaaagtgtcttccttcttagatataagacccatggccttcgactacaaaaacatactaacaaagtcaaattaacatcaaaactgtattaaaatgcattgagtttttgtacaatacagataagatttttacatggtagatcaacaaattctttttgggggtagattagaaaacccttacactttggctatgaacaaataataaaaattattctttaaagtaatgtctttaaaggcaaagggaagggtaaagtcggaccagtgtcaaggaaagtttgttttattgaggtggaaaaatagccccaagcagagaaaaggagggtaggtctgcattataactgtctgtgtgaagcaatcatttagttactttgattaatttttcttttctccttatctgtgcagaacaggttgcttgtttacaactgaagatcatgctatattttatatatgaagcccctaatgcaaagctctttacctcttgctattttgttatatatattacagatgaaatctcactgctaatgctcagagatcttttttcactgtaagaggtaacctttaacaatatgggtattacctttgtctcttcataccggttttatgacaaaggtctattgaatttatttgtttgtaagtttctactcccatcaaagcagctttctaagttattgccttggttattatggatgatagttatagcccttataatgccttaactaaggaagaaaagatgttattctgagtttgttttaatacatatatgaacatatagttttattcaattaaaccaaagaagaggtcagcagggagatactaacctttggaaatgattagctggctctgttttttggttaaataagagtctttaatcctttctccatcaagagttacttaccaagggcaggggaagggggatatagaggtcacaaggaaataaaaatcatctttcatctttaattttactccttcctcttatttttttaaaagattatcgaacaataaaatcatttgcctttttaattaaaaaaaaaaaaaaaaaaaaaaaaaaaaaaaaaaaaaaaaa

SEQ ID NO: 59273 - DNA, 5610 bp, Homo sapiens
aacatttttgaaagatcactcagctttaacacaccttggctgggtctggataaaaaaaaagtgagcactgcaaatttctagaagaaaacatcaggagaagaaagagagagggggatttattcaaagttgtttccaattccttcaaaacctcaaaccaggtggctatggtatggatgtaaccaagaaaaacaaacgagatggaactgaagtcactgagagaattgtcactgaaacagtaaccacaagacttacatccttaccaccaaaaggcgggaccagcaatggctatgctaaaacagcctctcttggtggagggagccggctggagaaacaaagcctgactcatggcagcagcggctacataaactcaactggaagcacacgaggccatgcctccacctctagttacaggagggctcactcacctgcctccactctgcccaactccccaggctcaacctttgaaaggaaaactcacgttacccgccatgcgtatgaagggagctccagtggcaactcttctccggagtaccctcggaaggaatttgcatcttcttcaaccagaggacggagtcaaacacgagagagtgaaattcgagttcgactgcagagtgcgtccccatccacccgatggacagaattggatgatgttaagcgtttgctcaaggggagtcgatcggcaagtgtgagccccacccggaattcctccaacacactccccatccccaagaaaggcactgtggagaccaaaattgtgacagcgagctcccagtcggtgtcaggcacctacgatgcaacgatcctggatgccaaccttccctcccatgtgtggtcctccaccctgcccgcggggtcctccatggggacctatcacaacaacatgacaacccagagctcatccctcctcaacaccaatgcctactctgcgggatcagtcttcggagttccaaacaacatggcgtcctgctcacccactttgcaccctggactcagcacatcctcctcagtgtttggcatgcagaacaatctggcccccagcttgaccaccctgtcccatggcaccaccaccacttccacagcatatggggtgaagaaaaacatgccccagagtcctgcggctgtgaacactggcgtttccacctccgccgcctgcaccacaagtgtgcagagcgatgaccttttgcacaaggactgcaagttcctgatcctagagaaagacaacacacctgctaagaaggagatggagctgctcatcatgaccaaggacagcgggaaggtctttacagcctcccctgccagcatcgctgcaacttctttttcagaagacaccctaaaaaaagaaaagcaagctgcctacaatgctgactcaggcctaaaagccgaagctaatggagacctgaagactgtgtccacaaagggcaagaccaccactgcagatatccacagctacagcagcagtggtggtggtggcagtggaggaggtggcggtgttggtggcgctggcggcggcccttggggaccagcgccagcctggtgcccctgcggctcctgctgcagctggtggaagtggctgctgggcctgctgctcacctggctgctactcctggggctgctcttcggcctcattgctctggcggaggaggtgaggaagctgaaggcgcgtgtggatgagctggagaggatcaggaggagcatactgccctatggggacagcatggatagaatagaaaaggaccgcctccagggcatggcacccgcggcgggagcagacctggacaaaattgggctgcacagtgacagccaggaggagctctggatgttcgtgaggaagaagctaatgatggaacaggaaaatggaaatctccgaggaagccctggccctaaaggtgacatgggaagtccaggccctaaaggagatcgagggttccctgggactccaggtatccctgggcccttgggccacccaggtccacaaggaccaaagggtcaaaaaggcagcgtgggagatcctggcatggaaggccccatgggccagagagggcgagaaggccccatgggacctcgtggtgaggcagggcctcctggatctggagagaaaggggaaagaggggctgctggtgaaccaggtcctcatggcccacctggtgtcccaggttctgtgggtcccaaaggttccagcggctctcctggcccacagggccctccaggtcctgtaggtctccaagggctccgaggtgaagtaggacttcctggtgtcaaaggtgacaaaggaccaatgggaccaccaggacccaaaggtgaccagggtgagaaaggacctcgaggcctcacaggcgagcctggcatgagaggtttgcctggtgctgttggtgagcccggggctaaaggagcaatgggtcctgctggcccagacggacaccaaggcccaagaggtgaacaaggtcttactgggatgcctggaatccgtggcccaccaggaccttctggagacccaggaaagccaggtctcacaggaccccagggacctcagggacttcccggtacccctggccgaccaggaataaaaggtgaaccaggagctccaggcaagatcgtgacttcggaggggtcatcgatgctcactgtcccaggccccccaggacctcctggagccatgggacccccaggacctccaggtgccccaggccctgccggcccagctggtctcccaggacatcaagaagttcttaatttacaaggtcccccaggcccacccggcccacgtgggccaccagggccttccattccaggcccaccaggaccccgaggcccaccaggggagggtttgccaggcccaccaggcccaccaggatcgttcctgtccaactcagaaaccttcctcttcggccccccaggcccacctggccccccaggtcccaagggagaccaaggtcccccaggccccagaggacaccaaggcgagcaaggcctcccaggtttctcaacctcagggtccagttctttcggactcaaccttcagggaccaccaggcccacctggcccccagggaccaaaaggtgacaaaggtgatccgggtgttccaggggctcttggcattcctagtggtccttctgaagggggatcatcaagtaccatgtacgtgtcaggcccgccagggccccctgggccccctgggcctccgggctctatcagcagctctggccaggagattcagcagtacatctctgagtacatgcagagtgacagtattagatcttacctatccggagttcagggtcccccaggcccacctggtcccccaggacctgtcaccaccatcacaggcgagactttcgactactcagagctggcaagccacgttgtgagctacttacggacttcggggtacggtgtcagcttgttctcgtcctccatctcttctgaagacatcctggctgtgctgcagcgggatgacgtgcgtcagtacctacgtcagtacttgatgggccctcggggtccgccagggccaccaggagccagtggagatgggtccctcctgtctttggactatgcagagctgagtagtcgcattctcagctacatgtcgagttctgggatcagcattgggcttcctggtcccccggggccccctggcttgccgggaacctcctatgaggagctcctctccttgctgcgagggtctgaattcagaggcatcgttggacccccaggtcccccgggtccaccagggatcccaggcaatgtgtggtccagcatcagcgtggaggacctctcgtcttacttacatactgccggcttgtcattcatcccaggccctccaggacctcctggtcccccagggcctcgagggcccccgggtgtctcaggagccctggcaacctatgcagctgaaaacagcgacagcttccggagcgagctgatcagctacctcacaagtcctgatgtgcgcagcttcattgttggccccccaggccctcctgggccgcagggaccccctggggacagccgcctcctgtccacggatgcctcccacagtcggggtagcagctcctcctcacacagctcatctgtcaggcggggcagctcctacagctcttccatgagcacaggaggaggtggtgcaggctccctgggtgcaggcggtgcctttggtgaagctgcaggagacaggggtccctatggcactgacatcggcccaggcggaggctatggggcagcagcagaaggcggcatgtatgctggcaatggcggactattgggagctgactttgctggagatctggattacaatgagctggctgtgagggtgtcagagagcatgcagcgtcagggcctactgcaagggatggcctacactgtccagggcccaccaggccagcctgggccacaggggccacccggcatcagcaaggtcttctctgcctacagcaacgtgactgcggacctcatggacttcttccaaacttatggagccattcaaggaccccctgggcaaaaaggagagatgggcactccaggacccaaaggtgacaggggccctgctgggccaccaggtcatcctgggccacctggccctcgaggacacaagggagaaaaaggagacaaaggtgaccaagtctatgctgggcggagaaggagaagaagtattgctgtcaagccgtgagctagccatggcaggacagctcctggaccaggtctcataatgcatgtggcacttaggtccaaggtctccagagggtgaaagctggagtctgtcaatgtcctactgagacagcacagccaacctagctagcaacatttgttttagtctgaacaatatatacttatagaattcagtcaaagatacacaatctgaaacagcttcatggggtggactctaacagtagttgcaatgttttagaatgagacttacttctctgctatctagatctgaactccttggcttctttacttagttcaagccccagcctaggaaagccagttacataaaagttggctcaggagtcttagagctttacctaaatatgagcccagaaaacggaggatgggggtggggcgccttcctggaggtgacacttgatgggggtgtgttctggttactgttctaaggctgtgccatcagctccttcctcccctgttcattctgcattctctagtcagttggctaagaagtgactcttgcaactaaaaaaattaagaaattcacttcccctctaggaggtgatgatagggtttctaatggttatatgtatatcacattcccatttgcttagaaagtctgattgtagctatgattgtccgtaggcccatactagagttcatggatatgttatactgaaccaggccagagcaaacagaaaaagaaggttgagggcaatggacaaggaaggaataaagggagaagagggaaaacagaaaacctgatgctggggacacagcatcagctcaagacgtcaccctccattctgcactcagaaaatggcacttgggggactgggcgcagttggtctttaaccacttttcaatgtctaaaaacatttgtttgtggtctataagatgaaacatcatttcaatcgtaaaatttcccattaaagaagtttttttttctaa

SEQ ID NO: 59274 - DNA, 1847 bp, Homo sapiens
cagaaggatgtcgctgctgagcctgtcttggctgggcctcaggccggtggcagcatccccgtggctgctcctgctggtggtcggggcctcctggctcctggcccgcatcctggcctggacctatgccttctatcacaacggccgccgcctccggtgtttcccgcagccccggaaacagaactggttcttgggtcacctgggcctggtcactcccacagaggagggcttgagggtcctgacccagctggtggccacctacccccagggctttgtgaggtggttgggccccatcactcccatcatcaacttgtgccaccctgacatcgtccgatctgtcatcaatacctcagatgccattacagacaaggacatagtcttctacaagaccctgaagccctggctgggggatgggctcttgttaagtgttggtgacaagtggagacaccaccgtcgcttgctgacgcctgccttccatttcaacatcctgaagccctatataaagattttcagcaagagtgcaaacatcatgcatgccaagtggcaacgcctggccatggagggcagcacctgtctggatgtgtttgagcacatcagccttatgaccctggacagtctgcagaaatgcatcttcagctttgacagcaattgtcaggagaagcccagtgaatatattactgcgatcatggagctcagtgcccttgtagtgaaacggaataaccagttcttccggtacaaggacttcctgtacttcctcactccctgtggacggcgcttccacagggcctgcagactggtgcacgacttcacagatgccgtcatccaggagcggcgccgcaccctcactagccagggtgttgatgacttcctccaagccaaggccaagtccaagactttggactttattgatgtgctcctgctgagcgaggataaaaatggtaaagagttgtcagatgaggacataagagcagaagctgacactttcatgtttggaggccatgacaccacggccagtggcctctcctgggtcttgtacaacctcgcgaggcacccagaataccaagaacgctgccggcaggaggtgcaagagcttctgaaggaccgtgagcctaaagagattgaatgggacgacctggcccagttgcccttcctgaccatgtgcctgaaggagagcctgcggttgcatcccccaatccctacattcgcccgcggctgcacccaggacgtggtgctcccagacagccgagtcatccccaaagggaatgtctgtaacatcaacatcttcgcaatccatcacaacccctcagtctggccagaccctgaggtctatgaccccttccgcttcgaccccgaaaacgcccagaagaggtcacctatggcttttattcctttctcggcggggcccaggaactgcatcgggcagaagttcgcgatggcagagatgaaggtggtcctggcgctcacgctgctgcgcttccgcatcctgcccgaccacagggagccacgcaggacgccggagattgttttgcgtgcggaggacggactttggctgcgagtagaacccctgggctgaggcctgcagtgacccacccacctacctttgcatcacctacctttgcaccaactaccttttcagatttccggtaataaatctgtgttggcccctgtgcctcagtcccgcggatggccagtagggggcgctggaggactgcggggatctagggcctggctgggaagaggcggggagatgtctctgtgcccaagatactcactgcctctctgggtgagcacaggagccccgtgctgagggtgggatctcccagagtctaagtaaagactttttccccccc

SEQ ID NO: 59275 - DNA, 2393 bp, Homo sapiens
ggcaggaaaagcggaagagggagcgaaaaccaacgtgttcggtgacagaccccagcgccgactgagcctctaaagcgacttcagctctgccccaccaacaccaccgcgcgcccgggaacagccgctccgggaagaaacctgaggggactgcggggggcacgagggacagctgagggaagggaggacgcgagagaaacagcgcgagcacgctgagggccgggggttgccaggagaggggcccgcggacccgcagagcggaggaaggtccgggagaaaaggggcgggacggaggagaatccgggatcgcctggcagaaaaagagaagggagtttctgaatcctgggaagaggaggcgtgggtagggacgcttagcccgagatccgacagcagggaaccggagcgctccgggggaggggcttaatgctggggaagggatgtcttaaaagaggagaagctttaaattagacgatcggagaaggctgagggaattgctatgaaggggcgggagctgaagtgtagaggactcctttagacagcagaaagggaaagccgttgagaagttcccttcaaactccacctgcctcctctccaattcaaactccactcccttctccaaaagttaaaaggaaagccaagtttaccacgctcccctgttcctactcaataaatacttcttctactccgccaccgggaaaacagaaaaaaaaactaatttccttcccaatattaggacttagaaaagctctaggtcccgcaatttgaattttagcctaggggaatcaaaatagtaggagcattactcttgtttcctttttcaaaatcccacacctcatccttcctgcgacgccatgtccaccaacatttgtagtttcaaggacaggtgcgtgtccatcctgtgttgcaaattctgtaaacaagtgctcagctctaggggaatgaaggctgttttgctggctgatactgaaatagaccttttctctacagacatccctcctaccaacgcagtggacttcactggaagatgctatttcaccaaaatctgcaaatgtaaactgaaggacatcgcatgtttaaaatgtgggaacattgtaggttatcatgtgattgttccatgtagttcctgtcttctttcctgcaacaacagacacttctggatgtttcacagccaggcagtttatgatattaacagactagactccacaggtgtaaacgtcctacttcggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttctgtctctaattagttacctcagtttgattgaagccagtggagttgtgcttttcctctacttctacttcctctcccccacctttttctgcccagtgtaggtgtattcttaaattcagacgggaagattctttcacatatcactcagttacctcccaatctgggggagtttttcttacaacttgataccagataccattaattttacattcctgaataaaggcctagtacccacgcatatttcaaccatgcatatatcaagttcaaccgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagctaaacctaaataagttatcctgttccctaggaccttctctgtaaatagtgaattttagacgagtggtctgtcctaaatcttaaatagaaaaaaaaactaaagcgatttgcttaagccattgtacattataaagagctgttttgttttgctttgctttgctttgttttgtttttttaaagctgcattcagagctacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatgaccattcttcctttaattttttgttatgcccacatattgtatgtaaaaatataaataaatagtacttaaagtat

SEQ ID NO: 59276 - DNA, 2608 bp, Homo sapiens
tgatcccaggtagtggcgccggtggatccggatcgagggcaggaggctgagacccgcgggagctggccctaaagcaaggacctgagtgcaagtaatttttttgggaagtaataacagaaaataccagcaaggaagaagacagtgaacccaaaagaattgaaaacaggatgctgcccatcacagaccgcctgctgcacctcctggggctggagaagacggcgttccgcatatacgcggtgtccacccttctcctcttcctgctcttcttcctgttccgcctgctgctgcggttcctgaggctctgcaggagcttctacatcacctgccgccggctgcgctgcttcccccagcctccccggcgcaactggctgctgggccacctgggcatgtaccttccaaatgaggcgggccttcaagatgagaagaaggtactggacaacatgcaccatgtactcttggtatggatgggacctgtcctgccgctgttggttctggtgcaccctgattacatcaaaccccttttgggagcctcagctgccaccgcccccaaggatgacctcttctatggcttcctaaaaccttggctaggggatgggctgctgctcagcaaaggtgacaagtggagccggcaccgtcgcctgctgacacccgccttccactttgacatcctgaagccttacatgaagatcttcaaccagagcgctgacattatgcatgctaaatggcggcatctggcagagggctcagcggtctcccttgatatgtttgagcatatcagcctcatgaccctggacagtcttcagaaatgtgtcttcagctacaacagcaactgccaagagaagatgagtgattatatctccgctatcattgaactgagcgctctgtctgtccggcgccagtatcgcttgcaccactacctcgacttcatttactaccgctcggcggatgggcggaggttccggcaggcctgtgacatggtgcaccacttcaccactgaagtcatccaggaacggcggcgggcactgcgtcggcagggggccgaggcctggcttaaggccaagcaggggaagaccttggactttattgatgtgctgctcctggccagggatgaagatggaaaggaactgtcagacgaggatatccgagccgaagcagacaccttcatgtttgagggtcacgacacaacatccagtgggatctcttggatgctgttcaatttggcaaagtatccggaataccaggagaaatgccgagaagagattcaggaagtcatgaaaggccgggagctggaggagctggagtgggacgatctgactcagctgccctttacaactatgtgcattaaggagagcctgcgccagtacccacctgtcactcttgtctctcgccaatgcacggaggacatcaagctcccagatgggcgcatcatccccaaaggaatcatctgcttggtcagcatctatggaacccaccacaaccccacagtgtggcctgactccaaggtgtacaacccctaccgctttgacccggacaacccacagcagcgctctccactggcctatgtgcccttctctgcaggacccaggaattgcatcggacagagcttcgccatggccgagttgcgcgtggttgtggcactaacactgctacgtttccgcctgagcgtggaccgaacgcgcaaggtgcggcggaagccggagctcatactgcgcacggagaacgggctctggctcaaggtggagccgctgcctccgcgggcctgagcgtgggcgcgcccctgcggctcccgagggtccaggccccgcccccaaaggaccaggactcgccccaaagatcccgagggcataggccacccccctcgaagttcaggttcagctcctggatgaccaggcaccgctgttgagcagcctggtggtactggccacgcccctcaaggcaaggctccgccccttagggggcctgatcccgccccttgaggcttaggtcccgccccctgacttctcgcacctgtcctgtttgagggaacagggtcgaccctgcccccttgggctcaggccccgcccccaggatcctacggattgaggtcctcaggccacgcccctgcagatccaggtctccaggccttgcccactgagccttcagaggacctaagacccacctatgactcagggcccaccacaccccacccccccccaactggctgaacccctggaaggcttccaaactgaggaaagctggagcctgacgtcagagcttttaactcggacatcaccctcctgaggccctcagctcatacgggcagactgctcaggcgtgaggctggatcgtagggttcgaggctgcttgcttttgttgttgttttgtaaactcagacccttgtaagccccttccttcctcccttgcccaaagatcctttgctgagtgttctgtttttgcagaataaaagcaaaggatgcagacttaccccaccctccacccctagctcagccagatccttacacgtggagcccccagcatgggaatgaggggctctgcaactgagcgaagctgcgggctaggaggctgaaaagccatttatcctaggacataaactcagattttgggggtc

SEQ ID NO: 59277 - DNA, 3047 bp, Homo sapiens
ggaggaaagaaaacaagaggtgagtgaggcaactgaaaactgttcttggacctgcggtgctatagagcaggctcttctaggttggcagttgccatggaatctggacccaaaatgttggcccccgtttgccaggtggaaaataacaatgagcagctattggtgaaccagcaagctatacagattcttgaaaagatttctcagccagtggtggtggtggccattgtaggactgtaccgtacagggaaatcctacttgatgaaccatctggcaggacagaatcatggcttccctctgggctccacggtgcagtctgaaaccaagggcatctggatgtggtgcgtgccccacccatccaagccaaaccacaccctggtccttctggacaccgaaggtctgggcgatgtggaaaagggtgaccctaagaatgactcctggatctttgccctggctgtgctcctgtgcagcacctttgtctacaacagcatgagcaccatcaaccaccaggccctggagcagctgcattatgtgacggagctcacagaactaattaaggcaaagtcctccccaaggcctgatggagtagaagattccacagagtttgtgagtttcttcccagactttctttggacagtacgggatttcactctggagctgaagttgaacggtcaccctatcacagaggatgaatacctggagaatgccttgaagctgattcaaggcaataatcccagagttcaaacatccaattttcccagggagtgcatcaggcgtttctttccaaaacggaagtgtttcgtctttgaccggccaacaaatgacaaagaccttctagccaatattgagaaggtgtcagaaaagcaactggatcccaaattccaggaacaaacaaacattttctgttcttacatcttcactcatgcaagaaccaagaccctcagggagggaatcacagtcactgggaatcgtctgggaactctggcagtgacttatgtagaggccatcaacagtggagcagtgccttgtctggaggatgcagtgataactctggcccagcgtgagaactcagcggccgtgcagagggcatctgactactacagccagcagatggcccagcgagtgaagttccccacagacacgctccaggagctgctggacgtgcatgcggcctgtgagagggaagccattgcaatcttcatggagcactccttcaaggatgaaaatcaggaattccagaagaagttcatggaaaccacaatgaataagaagggggatttcttgctgcagaatgaagagtcatctgttcaatactgccaggctaaactcaatgagctctcaaagggactaatggaaagtatctcagcaggaagtttctctgttcctggagggcacaagctctacatggaaacaaaggaaaggattgagcaggactattggcaagttcccaggaaaggagtaaaggcaaaagaggtcttccagaggttcctggagtcacagatggtgatagaggaatccatcttgcagtcagataaagccctcactgatagagagaaggcagtagcagtggatcgggccaagaaggaggcagctgagaaggaacaggaacttttaaaacagaaattacaggagcagcagcaacagatggaggctcaagttaagagtcgcaaggaaaacatagcccaactgaaggagaagctgcagatggagagagaacacctactgagagagcagattatgatgttggagcacacgcagaaggtccaaaatgattggcttcatgaaggatttaagaagaagtatgaggagatgaatgcagagataagtcaatttaaacgtatgattgatactacaaaaaatgatgatactccctggattgcacgaaccttggacaaccttgccgatgagctaactgcaatattgtctgctcctgctaaattaattggtcatggtgtcaaaggtgtgagctcactctttaaaaagcataagctccccttttaaggatattatagattgtacatatatgctttggactatttttgatctgtatgtttttcattttcattcagcaagtttttttttttttttcagagtcttactctgttgcccaggctggagtacagtggtgcaatctcagctcactgcaacctctgcctcctgggttcaagagattcacctgcctcagccccctagtagctgggattataggtgtacaccaccacacccagctaatttttgtatttttagtagagatggggtttcactatgttggccaggctggtctcgaactcttgacctcaaatgatccacccgcctcggcctcccaaagtgctgggtttacaggcatgagccaccatgcccagccctcatttagcaaagttttaaacataaaaagtgcttattagaggatatcagtgcctggcccacatgagagaacagatccatacacactttgaaaaactttgttcacttttaggaaatataattttgaaaaatcatttacatacaagaggtccactgaggcattgcttttaatggcaaaatattgcaatgtacttgaatgtccttcacattagattggtaagataaattttagtatgtgcatgtactggaatattatatagccagtaaacaaattgacaatgaagctctatttgtaccagtaaagaatggtcttgaagagacattgtaaaatgaaaaaaaaaaaaccaagttgtaaagcaatgtagattatcttatcagcatggaaaaaatgcaattattatatggaagcatgcaaatatatctctggaaagattaatcaaaatctattattattggctccttctgggaagaaccaagtgaatgtaggggttgaaggaatacatactcttcactttatactcttgaattttgtaaagaaatcttattttaccgattcagaaataaataagaaaatgtaagagacaatgctaataatgataacaataaaaaaatagtgaaattggctatcaaaaaaaaaaaaaaaaaaaaaaaaaaaaaaaaaaaaaaaaaaaaaaaaaaaaaaaaaaaaa

SEQ ID NO: 59278 - DNA, 2263 bp, Homo sapiens
cggagcccctcggcggcgcccggcccaggacccgcctaggagcgcaggagccccagcgcagagaccccaacgccgagacccccgccccggccccgccgcgcttcctcccgacgcagagcaaaccgcccagagtagaagatggattggggcacgctgcagacgatcctggggggtgtgaacaaacactccaccagcattggaaagatctggctcaccgtcctcttcatttttcgcattatgatcctcgttgtggctgcaaaggaggtgtggggagatgagcaggccgactttgtctgcaacaccctgcagccaggctgcaagaacgtgtgctacgatcactacttccccatctcccacatccggctatgggccctgcagctgatcttcgtgtccacgccagcgctcctagtggccatgcacgtggcctaccggagacatgagaagaagaggaagttcatcaagggggagataaagagtgaatttaaggacatcgaggagatcaaaacccagaaggtccgcatcgaaggctccctgtggtggacctacacaagcagcatcttcttccgggtcatcttcgaagccgccttcatgtacgtcttctatgtcatgtacgacggcttctccatgcagcggctggtgaagtgcaacgcctggccttgtcccaacactgtggactgctttgtgtcccggcccacggagaagactgtcttcacagtgttcatgattgcagtgtctggaatttgcatcctgctgaatgtcactgaattgtgttatttgctaattagatattgttctgggaagtcaaaaaagccagtttaacgcattgcccagttgttagattaagaaatagacagcatgagagggatgaggcaacccgtgctcagctgtcaaggctcagtcgccagcatttcccaacacaaagattctgaccttaaatgcaaccatttgaaacccctgtaggcctcaggtgaaactccagatgccacaatggagctctgctcccctaaagcctcaaaacaaaggcctaattctatgcctgtcttaattttctttcacttaagttagttccactgagaccccaggctgttaggggttattggtgtaaggtactttcatattttaaacagaggatatcggcatttgtttctttctctgaggacaagagaaaaaagccaggttccacagaggacacagagaaggtttgggtgtcctcctggggttctttttgccaactttccccacgttaaaggtgaacattggttctttcatttgctttggaagttttaatctctaacagtggacaaagttaccagtgccttaaactctgttacactttttggaagtgaaaactttgtagtatgataggttattttgatgtaaagatgttctggataccattatatgttccccctgtttcagaggctcagattgtaatatgtaaatggtatgtcattcgctactatgatttaatttgaaatatggtcttttggttatgaatactttgcagcacagctgagaggctgtctgttgtattcattgtggtcatagcacctaacaacattgtagcctcaatcgagtgagacagactagaagttcctagtgatggcttatgatagcaaatggcctcatgtcaaatatttagatgtaattttgtgtaagaaatacagactggatgtaccaccaactactacctgtaatgacaggcctgtccaacacatctcccttttccatgactgtggtagccagcatcggaaagaacgctgatttaaagaggtcgcttgggaattttattgacacagtaccatttaatggggaggacaaaatggggcaggggagggagaagtttctgtcgttaaaaacagatttggaaagactggactctaaattctgttgattaaagatgagctttgtctacttcaaaagtttgtttgcttaccccttcagcctccaattttttaagtgaaaatataactaataacatgtgaaaagaatagaagctaaggtttagataaatattgagcagatctataggaagattgaacctgaatattgccattatgcttgacatggtttccaaaaaatggtactccacatacttcagtgagggtaagtattttcctgttgtcaagaatagcattgtaaaagcattttgtaataataaagaatagctttaatgatatgcttgtaactaaaataattttgtaatgtatcaaatacatttaaaacattaaaatataatctctataataaaaaaaaaaaaaaa

SEQ ID NO: 59279 - DNA, 1299 bp, Homo sapiens
atgaaattcaagctgcttgctgagtcctattgccggctgctgggagccaggagagccctgaggagtagtcactcagtagcagctgacgcgtgggtccaccatgaactggagtatctttgagggactcctgagtggggtcaacaagtactccacagcctttgggcgcatctggctgtctctggtcttcatcttccgcgtgctggtgtacctggtgacggccgagcgtgtgtggagtgatgaccacaaggacttcgactgcaatactcgccagcccggctgctccaacgtctgctttgatgagttcttccctgtgtcccatgtgcgcctctgggccctgcagcttatcctggtgacatgcccctcactgctcgtggtcatgcacgtggcctaccgggaggttcaggagaagaggcaccgagaagcccatggggagaacagtgggcgcctctacctgaaccccggcaagaagcggggtgggctctggtggacatatgtctgcagcctagtgttcaaggcgagcgtggacatcgcctttctctatgtgttccactcattctaccccaaatatatcctccctcctgtggtcaagtgccacgcagatccatgtcccaatatagtggactgcttcatctccaagccctcagagaagaacattttcaccctcttcatggtggccacagctgccatctgcatcctgctcaacctcgtggagctcatctacctggtgagcaagagatgccacgagtgcctggcagcaaggaaagctcaagccatgtgcacaggtcatcacccccacggtaccacctcttcctgcaaacaagacgacctcctttcgggtgacctcatctttctgggctcagacagtcatcctcctctcttaccagaccgcccccgagaccatgtgaagaaaaccatcttgtgaggggctgcctggactggtctggcaggttgggcctggatggggaggctctagcatctctcataggtgcaacctgagagtgggggagctaagccatgaggtaggggcaggcaagagagaggattcagacgctctgggagccagttcctagtcctcaactccagccacctgccccagctcgacggcactgggccagttccccctctgctctgcagctcggtttccttttctagaatggaaatagtgagggccaatgcccagggttggagggaggagggcgttcatagaagaacacacatgcgggcaccttcatcgtgtgtggcccactgtcagaacttaataaaagtcaactcatttgctggaaaaaaaaaaaaaaaaaa

SEQ ID NO: 59280 - DNA, 910 bp, Homo sapiens
aagaagaccccgttcttccgggaaaatggcgactcccgctcgtgccccggagtcaccgccgtccgcggatccggcgctagtagcggggcctgccgaggaagccgagtgcccgccgccgcgccagcctcagcccgcgcagaatgtgctcgctgccccgcggcttcgagccccaagctcccgaggacttggcgcagcggagtttggtggagctgcgggaaatgttgaagcgccaggagagacttttgcgcaacgagtaagctggggtcccgcggagtctccgccaggctccttcagctcgagctccctgggcgctcccctcccctcccgcactctgttcccttccctggaaggtgactttgactcagtcacattcgcttcagtcctacgggcgagtggacggagggcttgctgcggcagagccgtgcctcttcctggccagaaaattcatttgcaaattgcccgacaaaggtaaaaagatctttgactcttttgccaaactgaaagctgccattgcagaatgtgaagaagttagaagaaaaagtgaactgtttaaccctgttagtttagactgtaagctaaggcaaaaagcaattgcagaagttgatgtgggtacagataaggcccagaattctgacccgatacttgatacttcatcactagttcctggatgttcctctgtagataacatcaagtcatctcaaacctcacaaaaccagggacttggacgtcctactcttgaaggtgatgaagagacttcagaggttgagtacacagtgaataagggcccagcttccagcaatagagacagggtaccaccttcatctgaagctagtgagcatcacccgcggcatcgtgtttcaagtcaagcggaagatacttccagcagctttgacaacctgtttattgacag

SEQ ID NO: 59281 - DNA, 1539 bp, Homo sapiens
cttgaatcttggggcaggaactcagaaaacttccagcccgggcagcgcgcgcttggtgcaagactcaggagctagcagcccgtccccctccgactctccggtgccgccgctgcctgctcccgccaccctaggaggcgcggtgccacccactactctgtcctctgcctgtgctccgtgcccgaccctatcccggcggagtctccccatcctcctttgctttccgactgcccaaggcactttcaatctcaatctcttctctctctctctctctctctctctctctctctctctctctctctctctctctctcgcagggtggggggaagaggaggaggaattctttccccgcctaacatttcaagggacacaattcactccaagtctcttccctttccaagccgcttccgaagtgctcccggtgcccgcaactcctgatcccaacccgcgagaggagcctctgcgacctcaaagcctctcttccttctccctcgcttccctcctcctcttgctacctccacctccaccgccacctccacctccggcacccacccaccgccgccgccgccaccggcagcgcctcctcctctcctcctcctcctcccctcttctctttttggcagccgctggacgtccggtgttgatggtggcagcggcggcagcctaagcaacagcagccctcgcagcccgccagctcgcgctcgccccgccggcgtccccagccctatcacctcatctcccgaaaggtgctgggcagctccggggcggtcgaggcgaagcggctgcagcggcggtagcggcggcgggaggcaggatgagcgcacgcggtgagggcgcggggcagccgtccacttcagcccagggacaacctgccgccccagcgcctcagaagagaggacgcggccgccccaggaagcagcagcaagaaccaaccggtgagccctctcctaagagacccaggggaagacccaaaggcagcaaaaacaagagtccctctaaagcagctcaaaagaaagcagaagccactggagaaaaacggccaagaggcagacctaggaaatgggacaatctactaccaagaaccagctccaagaagaaaacatctctgggaaacagtaccaaaaggagtcactgaattgtcattggaggagtccaggatagctcttcatgttattttcaccttgaggaattgtccattacatctatgagccttatgtgtggctttctccgatatagaaacctatcaggtgtcttttagatcatttcaaaacactggcttattctttcttatgtttccaactgaagtctgcatcccaagatgtagtttcactgctaccccatatggcacccttgtacgaatttgaaaaaagtactcactctaggcacatgcagagccatgcctgcggggacagcttagagagtagagggtgggctgaactccagttactctcgtacagggatccacctttttgcagaaatcacagtgtggctatggtgtggtttgatttcataaaacagatgcttaaaaagtaaaaaaaaaaa

SEQ ID NO: 59282 - DNA, 1502 bp, Homo sapiens
cttagatattaaactgataggataagatataaaataatttaagattgctgatatatgttttaaaattaattatttgctcaagcatttgtgacaatttacagttctaattgaggttttaaatttagtagtttgtaggtattttaagttttgcccctgaattctttataggtgctgataagcctttggttaagttttactccatgaaagactattactgaaaaaaatgtaatctcaataaaagaactttaataagcttgactaaatatttagaaagcacattgtgttcagtgaaactttgtatataatgaatagaataataaaagattatgttggatgactagtctgtaattgcctcaaggaaagcatacaatgaataagttattttggtacttcctcaaaatagccaacacaatagggaaatggagaaaatgtactctgaacaccatgaaaagggaacctgaaaatctaatgtgtaaacttggagaaatgacattagaaaacgaaagcaacaaaagagaacactctccaaaataatctgagatgcatgaaaggcaaacattcactagagctggaatttccctaagtctatgcagggataagtagcatatttgaccttcaccatgattatcaagcacttctttggaactgtgttggtgctgctggcctctaccactatcttctctctagatttgaaactgattatcttccagcaaagacaagtgaatcaagaaagtttaaaactcttgaataagttgcaaaccttgtcaattcagcagtgtctaccacacaggaaaaactttctgcttcctcagaagtctttgagtcctcagcagtaccaaaaaggacacactctggccattctccatgagatgcttcagcagatcttcagcctcttcagggcaaatatttctctggatggttgggaggaaaaccacacggagaaattcctcattcaacttcatcaacagctagaatacctagaagcactcatgggactggaagcagagaagctaagtggtactttgggtagtgataaccttagattacaagttaaaatgtacttccgaaggatccatgattacctggaaaaccaggactacagcacctgtgcctgggccattgtccaagtagaaatcagccgatgtctgttctttgtgttcagtctcacagaaaaactgagcaaacaaggaagacccttgaacgacatgaagcaagagcttactacagagtttagaagcccgaggtaggtggagggactagaggacttctccagacatgattcttcatagagtggtaatacaatttatagtacaatcacattgctttgattttgtgtatatatatatttatctgagttttaagattgtgcatattgaccacaattgtttttattttgtaatgtggctttatatattctatccattttaaattgtttgtatgtcaaaataaattcattaatatggttgattcttcaaaaaaaaaaaaaaaaaaaaaaaaaaaaa

SEQ ID NO: 59283 - DNA, 2943 bp, Homo sapiens
accaggcaacaccattgaaggctcatatgtaaaaatccatgccttcctttctcccaatctccattcccaaacttagccactggcttctggctgaggccttacgcatacctcccggggcttgcacacaccttcttctacagaagacacaccttgggcatatcctacagaagaccaggcttctctctggtccttggtagagggctactttactgtaacagggccagggtggagagttctctcctgaagctccatcccctctataggaaatgtgttgacaatattcagaagagtaagaggatcaagacttctttgtgctcaaataccactgttctcttctctaccctgccctaaccaggagcttgtcaccccaaactctgaggtgatttatgccttaatcaagcaaacttccctcttcagaaaagatggctcattttccctcaaaagttgccaggagctgccaagtattctgccaattcaccctggagcacaatcaacaaattcagccagaacacaactacagctactattagaactattattattaataaattcctctccaaatctagccccttgacttcggatttcacgatttctcccttcctcctagaaacttgataagtttcccgcgcttccctttttctaagactacatgtttgtcatcttataaagcaaaggggtgaataaatgaaccaaatcaataacttctggaatatctgcaaacaacaataatatcagctatgccatctttcactattttagccagtatcgagttgaatgaacatagaaaaatacaaaactgaattcttccctgtaaattccccgttttgacgacgcacttgtagccacgtagccacgcctacttaagacaattacaaaaggcgaagaagactgactcaggcttaagctgccagccagagagggagtcatttcattggcgtttgagtcagcaaagaagtcaagatggccaaagttccagacatgtttgaagacctgaagaactgttacagtgaaaatgaagaagacagttcctccattgatcatctgtctctgaatcagaaatccttctatcatgtaagctatggcccactccatgaaggctgcatggatcaatctgtgtctctgagtatctctgaaacctctaaaacatccaagcttaccttcaaggagagcatggtggtagtagcaaccaacgggaaggttctgaagaagagacggttgagtttaagccaatccatcactgatgatgacctggaggccatcgccaatgactcagaggaagaaatcatcaagcctaggtcagcaccttttagcttcctgagcaatgtgaaatacaactttatgaggatcatcaaatacgaattcatcctgaatgacgccctcaatcaaagtataattcgagccaatgatcagtacctcacggctgctgcattacataatctggatgaagcagtgaaatttgacatgggtgcttataagtcatcaaaggatgatgctaaaattaccgtgattctaagaatctcaaaaactcaattgtatgtgactgcccaagatgaagaccaaccagtgctgctgaaggagatgcctgagatacccaaaaccatcacaggtagtgagaccaacctcctcttcttctgggaaactcacggcactaagaactatttcacatcagttgcccatccaaacttgtttattgccacaaagcaagactactgggtgtgcttggcaggggggccaccctctatcactgactttcagatactggaaaaccaggcgtaggtctggagtctcacttgtctcacttgtgcagtgttgacagttcatatgtaccatgtacatgaagaagctaaatcctttactgttagtcatttgctgagcatgtactgagccttgtaattctaaatgaatgtttacactctttgtaagagtggaaccaacactaacatataatgttgttatttaaagaacaccctatattttgcatagtaccaatcattttaattattattcttcataacaattttaggaggaccagagctactgactatggctaccaaaaagactctacccatattacagatgggcaaattaaggcataagaaaactaagaaatatgcacaatagcagttgaaacaagaagccacagacctaggatttcatgatttcatttcaactgtttgccttctacttttaagttgctgatgaactcttaatcaaatagcataagtttctgggacctcagttttatcattttcaaaatggagggaataatacctaagccttcctgccgcaacagttttttatgctaatcagggaggtcattttggtaaaatacttcttgaagccgagcctcaagatgaaggcaaagcacgaaatgttattttttaattattatttatatatgtatttataaatatatttaagataattataatatactatatttatgggaaccccttcatcctctgagtgtgaccaggcatcctccacaatagcagacagtgttttctgggataagtaagtttgatttcattaatacagggcattttggtccaagttgtgcttatcccatagccaggaaactctgcattctagtacttgggagacctgtaatcatataataaatgtacattaattaccttgagccagtaattggtccgatctttgactcttttgccattaaacttacctgggcattcttgtttcaattccacctgcaatcaagtcctacaagctaaaattagatgaactcaactttgacaaccatgagaccactgttatcaaaactttcttttctggaatgtaatcaatgtttcttctaggttctaaaaattgtgatcagaccataatgttacattattatcaacaatagtgattgatagagtgttatcagtcataactaaataaagcttgcaacaaaattctctgacaaaaaaaaaaaaaaaa

SEQ ID NO: 59284 - DNA, 2468 bp, Homo sapiens
gtgcttcggatggcggcgggaggttgatggcgagtggtgctgaagggacagctccagcagtggctgatttgggggagaaacaaaatctgcagatggaatccgagcagggcgacttcaccttcaagtggtgagctctcctgacctgcggccagtctccactccattcacggccagccgatctgcccgctcccggaggggtcgggcagtgccggctggacccgccccgagctccatggtttgcccaaccctgcgcgatggtgactctgggcgcggaggttggcgactggcaaatccgcagatcacagaatgaaggcggggagcgcggccggcggccggcgggggctttctcccccaccccagcgcccagggaagcggctcaaccacctgaatccggaaaacgccaacaagtagtttctcgtcggagaagggcggctcacctgggcgccaagactcagtcccgctgcccagagaacctcgtccactcggaaaccaaagcagaaccacttttctctcggtctcgttaagtcatgtctgagtcacagagatgggcaagatcgagaacaacgagagggtgatcctcaatgtcgggggcacccggcacgaaacctaccgcagcaccctcaagaccctgcctggaacacgcctggcccttcttgcctcctccgagcccccaggcgactgcttgaccacggcgggcgacaagctgcagccgtcgccgcctccactgtcgccgccgccgagagcgcccccgctgtcccccgggccaggcggctgcttcgagggcggcgcgggcaactgcagttcccgcggcggcagggccagcgaccatcccggtggcggccgcgagttcttcttcgaccggcacccgggcgtcttcgcctatgtgctcaattactaccgcaccggcaagctgcactgccccgcagacgtgtgcgggccgctcttcgaggaggagctggccttctggggcatcgacgagaccgacgtggagccctgctgctggatgacctaccggcagcaccgcgacgccgaggaggcgctggacatcttcgagacccccgacctcattggcggcgaccccggcgacgacgaggacctggcggccaagaggctgggcatcgaggacgcggcggggctcgggggccccgacggcaaatctggccgctggaggaggctgcagccccgcatgtgggccctcttcgaagacccctactcgtccagagccgccaggtttattgcttttgcttctttattcttcatcctggtttcaattacaactttttgcctggaaacacatgaagctttcaatattgttaaaaacaagacagaaccagtcatcaatggcacaagtgttgttctacagtatgaaattgaaacggatcctgccttgacgtatgtagaaggagtgtgtgtggtgtggtttacttttgaatttttagtccgtattgttttttcacccaataaacttgaattcatcaaaaatctcttgaatatcattgactttgtggccatcctacctttctacttagaggtgggactcagtgggctgtcatccaaagctgctaaagatgtgcttggcttcctcagggtggtaaggtttgtgaggatcctgagaattttcaagctcacccgccattttgtaggtctgagggtgcttggacatactcttcgagctagtactaatgaatttttgctgctgataattttcctggctctaggagttttgatatttgctaccatgatctactatgccgagagagtgggagctcaacctaacgacccttcagctagtgagcacacacagttcaaaaacattcccattgggttctggtgggctgtagtgaccatgactaccctgggttatggggatatgtacccccaaacatggtcaggcatgctggtgggagccctgtgtgctctggctggagtgctgacaatagccatgccagtgcctgtcattgtcaataattttggaatgtactactccttggcaatggcaaagcagaaacttccaaggaaaagaaagaagcacatccctcctgctcctcaggcaagctcacctactttttgcaagacagaattaaatatggcctgcaatagtacacagagtgacacatgtctgggcaaagacaatcgacttctggaacataacagatcagtgttatcaggtgacgacagtacaggaagtgagccgccactatcacccccagaaaggctccccatcagacgctctagtaccagagacaaaaacagaagaggggaaacatgtttcctactgacgacaggtgattacacgtgtgcttctgatggagggatcaggaaaggatatgaaaaatcccgaagcttaaacaacatagcgggcttggcaggcaatgctctgaggctctctccagtaacatcaccctacaactctccttgtcctctgaggcgctctcgatctcccatcccatctatcttgtaaaccaaac

SEQ ID NO: 59285 - DNA, 11507 bp, Homo sapiens
cgggggaccccacttgtgtgcagcctagacgctggttcagggagtcgtacatggaagccttgcggaaccccatgcccctgggcagctctgaggaggccctcggggacctggcctgcagctccctgactggagccagcagggacctggggactggggcagtagccagtgggacccaggaggaaacctctggcccccggggagacccccaacagaccccaagtctagagaaggagaggcacacacccagccggacaggtccaggagctgcagggcggactcttcccaggagatctcggtcctgggaaagggcacccagaagctccagaggggcccaggctgcagcctgccacacctcccaccactcagcaggctccaggcctgggggccacctaggaggacaagctgtggggaccccaaactgtgtcccagtagagggtcccggctgcaccaaagaggaagacgttcttgcatcctcagcctgtgtcagcacagacggcggcagcctccattgccacaaccccagcgggccttccgatgtgcctgcccggcagccacaccccgagcaagaagggtggccacccggcacaggagacttccccagccaggtgcccaagcaggtgctggacgtcagtcaggagctgctgcagtccggggtcgtcaccctcccagggacccgagaccgtcatggcagagcagtggtgcaggtccgcaccaggagcctgctctggaccagggaacactcgtcctgtgctgagctgacccgcctgctgctgtacttccatagcatccccaggaaagaggtccgggacctggggctggttgtcctggtggatgcacgcaggagtccagctgcccctgccgtctcccaggccctctcaggattgcagaacaacacatctcctataattcatagtatcttgctgttggtagataaagaatctgcatttaggcctgacaaggatgcaataattcagtgtgaggtcgtgagctccctgaaggccgtgcacaaatttgttgacagctgccagctgaccgcagacctcgacggctcctttccctacagccatggtgactggatctgcttccgtcagaggctggaacacttcgctgcaaactgtgaagaagccatcattttcctacagaattcattctgctccctgaacacccacagaaccccaagaacagcccaggaagtcgccgagttaattgaccagcatgagacgatgatgaagcttgtcctggaagacccactgcttgtgtctctcaggctggaggggggcaccgtcctggcgcggctgaggagagaagagcttggcacagaagacagccgggacaccctggaggccgccacaagcctgtacgaccgagtggatgaggaggtgcacaggctggtcctcacctcgaacaatcgtctccagcagctggagcacctccgggagctggcgtcactcctggaagggaatgaccagcaatcctgccagaaaggactacagctggcgaaggagaacccgcaacgtacagaggaaatggtccaggatttcagaaggggcctgagcgccgtggtcagccaggctgagtgcagggagggagagctggccaggtggacccgctcgtccgagttgtgcgagacggtgagcagctggatggggcccctggacccggaggcttgtccctcctcacccgtggctgagtgtttgaggagctgtcaccaggaggctacctcggtggctgcagaggccttccccggggcaggtgtggcagtgctgaagcctcatgccctggggaaaccgtgggcatcacagcaagacctgtggctgcagtacccccagacccggctccgtctggaagaggccctttctgaggctgccccagaccccagcttaccgccccttgcccagagccccccaaagcatgagcgtgcccaggaggccatgaggaggcaccagaagccaccctcattccccagcacggacagtgggggtggtgcctgggaacctgcccaaccactgtccggcctccctggacgagcgcttctgtgtggacaggacggggagcccctgggcccagggctgtgtgctctgtgggacccactgtccctcctcaggggccttccaggggcaggggccaccacggcccacctggaggacagctctgcctgttcctctgagcccacccagaccctggccagccgccccaggaaacatccccagaagaaaatgataaagaaaacgcaaagtttcgagatacctcagcccgacagtggccccagggactcctgccagccagaccatactagtgtcttcagcaagggcctggaggtaaccagcactgtagccacagagaagaagctcccgctgtggcagcatgccaggagccccccggtcactcagagccggagtctgtcctccccctcggggctccaccctgctgaggaggatgggaggcagcaggtgggcagcagccgactgaggcacatcatggccgagatgatcgccacagagagggagtacattcggtgcttaggatacgtcattgacaactattttccagaaatggaaagaatggacttgccccagggccttcgagggaagcaccacgttattttcggcaacttggagaagctccacgacttccaccagcagcacttcctccgggagctggagcgctgccagcactgccccttggccgtgggccgcagtttcctgagacacgaagagcagtttgggatgtacgtgatctacagcaaaaacaagccgcagtcggatgccctgctcagcagccatggcaacgccttcttcaaggacaagcagcgggagctaggtgacaaaatggacctggcctcctacctgctgcggcccgtgcagcgtgtggccaagtacgcgctgctactccaggacctgctcaaggaggccagctgtggcctggcccaggggcaggagctgggcgagctccgagccgccgaggtcgtggtctgcttccagctgcgtcacggcaatgacctgctggccatggacgccatccgcggctgtgacgtgaatttgaaggaacaggggcagctgagatgccgggatgagtttatcgtttgctgcgggaggaagaagtatctgaggcatgtgttcctctttgaagacctcatcctgtttagcaagacccagaaggtggagggcagccacgacgtctacctgtacaagcagtccttcaagacggccgagatcgggatgacagagaacgtcggggacagtggcttgaggtttgagatttggtttcgcaggcggcggaaatctcaggacacctacattctccaagcaagctcggcagaggtcaagagtgcatggaccgatgtcatagggaggatcctgtggcggcaggcactaaagagcagagaactcagaatccaagaaatggcatccatgggtataggcaaccagccattcatggatgtcaagcccagagaccggacccctgactgtgcagtgataagcgaccgggctcccaaatgtgcagtgatgagcgaccgagtccccgacagcatcgtcaagggcacagagtcacaaatgagagggtccacagcggtgtcctcctctgaccacgccgcccccttcaagcgaccacactccaccatctcagacagcagcacctcctcttctagcagccagtcctcctccatcctggggtcgctgggcctgcttgtgtcctccagcccagcccacccgggcctatggagccctgcccacagcccctggtcatctgatatcagagcctgcgtcgaggaagatgagccagagccagaactagagacgggcacccaggctgcagtgtgtgagggggctcctgctgtgctgctgagccgcacacgccaggcctgatgactgtcagggtggcagtgcccatcatgtggctagaacaatacagagggagcagcacgccaggcctgatgactctgggggtggcggtgcccatcgcgtggctggaacgatccagagggaatagcacagcaggtgtccaggtatttcccaggattttagacattccctaacattttcaaacaaatttataattttgtcttatttaaaaaacaaaccttccacttccacccaagacaacagcataggaaacagacctaaaacaagacaaaaaaagactaaacatgaaacaaaagatgtcaagacacaagacatttggcaacaaaggaccgcgatccctgagagacaggaaaacgggaggtgagcccggtgatggcctcagacctccctccgccttgagagtttgcaggcctcagtgcagggaggggcccaggaagagcccagcagcctccgtgagttgaagagaccaagtcagcaggagttggcaggtcagagtgccagagagagatgcctgcatggggaaagactcaccagatcagcccctccagcacctagtgggttgctacccattcgcacactcaaacagggaggctaccaaggctgggagcaacctttgaaaagaccaaagatcaattcctggtactcatgtgggctggggacaggacccgttcccaccagccagactagggaaactctcaatagatcaattcctgatactcatgtgggctggggacaggacccactcccaccagccagactaggaaaactcccaatctgtgagcattaggtggagttctcagaaaatcttgcctcaggaatggggataattagccctagactgagccctgctcctgactcgcctacaaaatcataaaagcaagacctaaaatgatcaaaccattcccagataattcactttatcccagaacaaagctccagatgatctaggggttaccaaagtgtccacaccctgcaaggtaaactcacagtgcctgacctcggagtgccaggcgtgcagaggagcagccaagggcaaacactccaaggagagtcgcctggcaaagccaaccacccagagccagcgtctgtgctagaatcacagaattcaaactgtggctgaaatcgcagcccaggcgtccagaaagttaaagttaagaacctataatcccagcactttgggaggccgaggcaggcggatcacgaggtcaggagatcaagaccatcctggctaacatggtgaaaccccgcctactaaaaatacaaaaaattagccgggcatggtgttggccgcctgtagtcccagctacttgggaggctgaggcaggagaatggcatgaacccgggaggcggagtttgcagtgagctgagatcacgccactgcactccagcctgggcgacagagcaagactctgtctcacaaaaaaggttaagaaatgacttaatggaagagattcagaagacccagaccgaccttacagggatgagaaactacaatattgacagtggaaactatcctggatggggtaacagattggatttcacagaagagaccatgaggcaccttgaagacacatcagtggaaactatttgcatttgttgggcctccagagagacagaaccaataggagatagctagatatatatacagacagatagatagatagatagatcgatagatagatagatagatagatagatagatagatagactgacagacagatgagaggggccttaggggcattggctgacacaattttggcaggtcaagagccccacaataggccatccacaagctggagacccaaggaagctgctagtgtgcccagtccgagtcctaaagcctcagagccagggaagccagtggtgtaattctcagaggccaaaggcctgagaacctgggggccactggtataagtctgagtccatagacccagtgaactccaaacacaagagatacgagtgcacatcataatcaaattgcatataaccagtgataaacagaaaatcctaaaaccagtcagaggacaagggcatgttctgttgggaggcacaaagctgatgaggatggctgactcctcaggagcagcatgggtgagaggcagtggaatgtactaaggagaaaactgccaaattcacattctgtacctgacaaaatctttccgaagcgatggtgacataaagacattttcatacacacagaaactaagagtttcatccccagcagacctgcactacaagaaatgttaaatgatgtgcttcagggaaaagaaaaatgaagagcatgtgcaccatccaggattttcctcgttatttaaatccctttagcccatctcccatttgccccaaggaatgagtgctggcagtgagctgcactttttttttctctaaacgggaaatgggttaaaagatgagtggcttggccgggtgcggtggctcatgtctctaatcccagcactttgggaggctgaggccagaggatcacttgacttgagcccaggaactggggggtcatgctgggaaacatggcaagaccgcatctctattaaaaataaataaaagttaactgactgtttaaacaaaagtattaacgtatctgcggtttgtactatacgcacaggtaaactgtgtgaccacagcagcgtgatggctgggagacgctggatgtgatacgtgaagtgaggggtatcacttgaaggtagattgtggtaagctaaagatgtactgataaacccttgaaacacccactaacaaagaattacagctaatagaccaacagaggagataaaatggaatttttaaaaatccagtccaaaaatacgtagagaaagagggaaagggaagaatggacttgggggcgacacagaagacaagtggagagagactgaagcagccactggccatcacagcaaacacaagcagggcgcaggacgccggcaagccacagacaggcctgctctctgaattggtgaccacatgagtaacttcacgggtctgttctatgtccagagttgtcaaactgcatgctttaaagatgtgcagtggatcgtatgtcgcttaaatcccaacaaagcagtatttttttaaagtacaatcatgcacacagcacttcccctgggaggcaggggctgtgcccacagaagtcgttacctctgcgtcctgagtatggacagccaccatcacacagccccagaggccgcccaggctctagccacactctggcactgcctgggacaggtgccctcaggaacccaaatgccactgcccccgtgaaagccacttcaagcgtgttgcttcaaatcagaaggcatctacgcctgtggaagaggaggctgctgggggcccaggtgtgcagggggcagggccaggtgcaggggcacagcttatgcctgtggccaacccactggggagcaaggctggggatatgcccaggccagcagggccagcaggagtgactgcgccatcctgaacacgtccttgggcctcccaggaccttggtgcctcccatctgggctggcacaagcctccagtcaaaagatgggtctctctctcctgatagcatggagcctggatgtgggaatggagccacaccagccccacgggagccccacgacccatcgggctgtgggatgcatccccacggccgggacccctcagcctgtgacttggtctgggcagatgcaaaggccaccctgcagggctgaggtgtctgtggggaaggaggtgcccagccctgggaggccatcttgctcctgctttttatttaacccatggggctctttggcctcattttctgttttttgagtttctcgtgcactccaaactgtcctggagccagccctggtgtgaaacagaggcttcctgctggcagaagaggcccaccgagttacgtccacaccagctggccctgggcacctctctctctggccttctgtccacactgggatttggctctgatttccagaaggcagggttaggaaacacctgtttccaggcagagtaatgcttctgtctgaatcaggcctcatgggcttcaccagcagacacgaaggtttcatttagatggcgaacacgtgttctcatttctccagggttctggacccgtgagctgaagcaggtgctgagaagtgggagaggcggccactgggtccctcagggtcactcaccccgccacgtgaggccacttccgcccagcactgggggcgctgggagctgaggggcccacaggggacgtgggagacagccccgatgcgtccccatccgcagtgacgctagcgcggagtcgtcgccaagcacgtggagggacagccctggagccctggcctggcccagcatctcccagagtcacttcctgatgcctccccagccctgcccaggaagggtttgtggccacagccccacagcggccccctcgcctcgaccaccagtgcctccttccaagctgcctgagcaatcctgggtggtgagctccaccactcccacccacgcctcagcactgggaccccccagggatggtgtggggattcctgccccccgtccatgcctcagcactgggagctgggaaggtgtgtgatttcctcccccacctcagtactgggacccccaggaagggtgtgtggccccaccatcctgaatgctcagggctggtggtcagcgaggtggtttctaaaccaagccctgggaggagccatcctgggactgtgcttggacaaggttggggctcccgcagtgagctctagccctccccaggaccctcccacggccccagggtgccggccttcagattgaccccattcgtggatgagtctacaaggctccccagtgcccagcaagagtgtttttacattcagaggtgaggaaggggtgccggcatctgccccagacacaaccgggcaggtacagatgtcatccccttgaggacagcagggaggcgactcaggagaggctgatcagacgggagccgcatccccatcaccttccagagagacctcttcttttgccaggtgtcgtgagggctgtggcttagctgggcctgcgtccatccccggttctggggagatgcccgggcccctcctggatggcagcagcagtggaggtttgggttttgagggagccctaagaacctgagagacttagatggagcatggcacgccctggagagtccacgtccccagacccctcatgccaacaccattccacccagcagtttcttccctgtggtcagaacaaaacccccaagcctcaggcctcaggctggttttctgacaggcaaaatgctccttacataaggaaagacctttccttggctgaccctaaagtagccaaggggagctcacatcgcctggcctgccgccaccaccaggctgcctgaccagctcaccgccttgttctagatgcttctgaagcaacagctcgcctggccccacccccatcaagcatctgctgggcagcctccctccccggcccgcctgtagctcccaaaggtctcaagcctcaacatcctggtaaccaagtgcacccagagggctggcagggtcacatggaggcaggggacccttggccccagggtggtcgtcttcccaggaggtccgcctgtcaggtcagagggcagcaggaggccaccccacctccccgggttccctcgagcattcctttgtcaggagcagctcccccaggatccaggcatccctggcccccctttgcccccgccctgctctcaggagccccctgccaggtgctctgaccacaggaaacaggagccctcagggccactgccagaggacggattctgctgccaaccagaggtcctggggctggcggcgctggtgtgcctgccctgggccttcagcagcccccataaggagaaagctccagcctcccgttcagagaaggctccatcctggggacacgcctctcccaaggtcacccacgtgggggctttgttactcatgcttcccagactgcgtgctgtgtcagagttttcacacctgcctgatgtcctgggggggctcacagaggaccgaccctgcagggagatgctgacccaccctgagacccaggagaagaaaacggccagggtccaggctgctcccaccatccctgggggattagcaccttggctgagcccgaactgaccacctggggcgtaggtccaagatttaattacaaaacgataggtgaatgtgggttctgtgtgcctgtgacatagagaatgttttccacaccgcgtgtgaaatgacgagagcttttgtgtcacacatgtagctgctacgagacagacgctcttgttccggatcagagcagcagacagaaccggcacttttagggtccaaaccctgttgcccacagaacgcccatgacaccagctgggtggagctgccgccgagtccacgccccgtctggctgggacctggagctcccctcaagctgcagatccactctgcaccacaaggtggcctcgcagaggagcctcccgagctttggaaccagaggcaggctcagcgatgctctccatccggcctggccccaccgtgtgtatcaggtgtcagaggccttgctgggtgccaggccacgtctgtgctgtcacagctttgaggggccagcgggtcctagggagaggcccgtgcgacgtgagtaacagcagtttttcttctgacagctgggatggaggtgggtcctccagggagtgccccagtcctcgagagccagacttgtgcacgggcctggaaatgaaggtctcaggcaggggctgcgcacaccgatggtcagcattgccgttcggggcctgcagtcgcccataatgggccctgccccctaggcctggcctcttttgctttcctcctggatggttcctctacccctggtccagcagggactcagcagtgcctgccagctgcagacccccatgctcctgcagcctggaaccctcctgccctccaaaggtcatggggtgacccagggtgggaacaccagaccccctcaccccgtgtccaccgcccatggccgggctcacagtgtctcagagccgtggtgagccatcctaggaccagtgtacctcacaacctttcagaccagtgaaggccagtgggctgggtggtccaggcatgtccccaacgcaggtccagccatctctgcacagaactggaatctcggttcatttcggtttcagcaggtcccatgtagttagcaggacagcacttgagttaggtctgagaaagaacgcctgtttgtcatggcatttcctgtaaggagcccagagccgtggccccaggttgggacggcggcgccagagctgggcctgagtctgacccaacctgtgctgagtggtcctgctggaatgggaaccccaagaggaccacccctctctaaaagaagggaaaacagtaagcgagagggaggctgcaggggcccagaccttggctgaccttcctagccatggtctccaccctccgagacccaggggccccgcagtgacagcagggtgttgggccacacagagcccgagtaggtaaaggaaggttctggaaaccacttttcagaacccaaaaggtgtctgggaaatggcgttacctgccactgttgttaagtgtttactttgtatcaatactgaattgttaaaaattttaatcataaaaaccaatggaaca

SEQ ID NO: 59286 - DNA, 1347 bp, Homo sapiens
atggccacagcaggaaatccctggggctggttcctggggtacctcatccttggtgtcgcaggatcgctcgtctctggtagctgcagccaaatcataaacggcgaggactgcagcccgcactcgcagccctggcaggcggcactggtcatggaaaacgaattgttctgctcgggcgtcctggtgcatccgcagtgggtgctgtcagccgcacactgtttccagaactcctacaccatcgggctgggcctgcacagtcttgaggccgaccaagagccagggagccagatggtggaggccagcctctccgtacggcacccagagtacaacagacccttgctcgctaacgacctcatgctcatcaagttggacgaatccgtgtccgagtctgacaccatccggagcatcagcattgcttcgcagtgccctaccgcggggaactcttgcctcgtttctggctggggtctgctggcgaacggcagaatgcctaccgtgctgcagtgcgtgaacgtgtcggtggtgtctgaggaggtctgcagtaagctctatgacccgctgtaccaccccagcatgttctgcgccggcggagggcacgaccagaaggactcctgcaacggtgactctggggggcccctgatctgcaacgggtacttgcagggccttgtgtctttcggaaaagccccgtgtggccaagttggcgtgccaggtgtctacaccaacctctgcaaattcactgagtggatagagaaaaccgtccaggccagttaactctggggactgggaacccatgaaattgacccccaaatacatcctgcggaaggaattcaggaatatctgttcccagcccctcctccctcaggcccaggagtccaggcccccagcccctcctccctcaaaccaagggtacagatccccagcccctcctccctcagacccaggagtccagaccccccagcccctcctccctcagacccaggagtccagcccctcctccctcagacccaggagtccagaccccccagcccctcctccctcagacccaggagtccagcccctcctccctcagacccaggagtccagaccccccagcccctcctccctcagacccaggggtccaggcccccaacccctcctccctcagactcagaggtccaggcccccaacccctccttccccagacccagaggtccaggtcccagcccctcctccctcagacccagcggtccaatgccacctagactctccctgtacacagtgcccccttgtggcacgttgacccaaccttaccagttggtttttcattttttgtccctttcccctagatccagaaataaagtctaagagaagcgc

SEQ ID NO: 59287 - DNA, 1986 bp, Homo sapiens
cgcgccaacgctcgccacagccctctcatctcctggaaccatggccagcacatccaccaccatcaggagccacagcagcagccgccggggtttcagtgccaactcagccaggctccctggggtcagccgctctggcttcagcagcatctccgtgtcccgctccaggggcagtggtggcctgggtggtgcatgtggaggagctggctttggcagccgcagcttatatggcctggggggatccaagaggatctccattggagggggcagctgtgccatcagtggcggctatggcagcagagccagaggcagctatggctttggtggcgccgggagtggatttggtttcggtggtggagccggcattggctttgatctgggtggtggagccggccttgctggtggctttgggggccctggcttccctgtgtgcccccctggaggcatccaagaggtcactgtcaaccagagtctcctgactcccctcaacctgcaaattgaccccgccatccagcgggtgcgggccgaggagcgtgagcagatcaagaccctcaacaacaagtttgcctccttcatcgacaaggtgcggttcctagagcagcagaacaaggttctggacaccaagtggaccctgctgcaggagcagggcaccaagactgtgaggcagaacctggagccgttgttcgagcagtacatcaacaacctcaggaggcagctggacaacatcgtgggggaacggggccgcctggactcggagctgagaaacatgcaggacctggtggaggacctcaagaacaaatatgaggatgaaatcaacaagcgcacagcagcagagaatgaatttgtgactctgaagaaggatgtggatgctgcctacatgaacaaggttgaactgcaagccaaggcagacactctcacagatgagatcaacttcctgagagccttgtatgatgcagagctgtcccagatgcagacccacatctcagacacatccgtggtgctatccatggacaacaaccgcaacctggacctggacagcatcatcgctgaggtcaaggcccaatacgaggagattgctcagaggagccgggctgaggctgagtcctggtaccagaccaagtacgaggagctgcaggtcacagcaggcagacatggggacgacctgcgcaacaccaagcaggagattgctgagatcaaccgcatgatccagaggctgagatctgagatcgaccatgtcaagaagcagtgtgccagcctgcaggctgccattgctgatgctgagcagcgtggggagatggccctcaaggatgctaagaacaagctggaagggctggaggatgccctgcagaaggccaagcaggacctggcccggctgctgaaggagtaccaggagctgatgaatgtcaagctggccctggacgtggagatcgccacctaccgcaagctgctggagggcgaggagtgcaggctgaatggcgaaggcattggacaagtcaacgtctctgtagtacagtccaccatctccagtggctatggcggtgccagtggtgtcggcagtggcttaggcctgggtggaggaagcagctactcctatggcagtggtcttggcattggaggtggcttcagttccagcagtggcagagccattgggggtggcctcagctctgttggaggcggcagttccaccatcaagtacaccaccacctcctcctccagcaggaagagctacaagcactaaagtgctgcctccagctctcggtcccacagtcctcaggcccttctctggctgcagagccgtcttctcaggttgcctgtcgtctcctggcctctagtcttccctgctctccgaggtagagctgggtatggatgcttagtgccctcacttctctctgtctatacctgccccatctgagcacccattgctcaccatcagatcaacctttgattttacatcataatgtattcaccactggagcttcactttgttac

SEQ ID NO: 59288 - DNA, 5601 bp, Homo sapiens
gggatgcctccagcagtgaggcggtcagcctgcagcatgggatggctgtggatctttggggcagccctggggcagtgtctgggctacagttcacagcagcaaagggtgccatttcttcagcctcccggtcaaagtcaactgcaagcgagttatgtggagtttagacccagccagggttgtagccctggatactatcgggatcataaaggcttgtataccggacggtgtgttccctgcaattgcaacggacattcaaatcaatgccaggatggctcaggcatatgtgttaactgtcagcacaacaccgcgggagagcactgtgaacgctgccaggagggctactatggcaacgccgtccacggatcctgcagggcctgcccatgtcctcacactaacagctttgccactggctgtgtggtgaatgggggagacgtgcggtgctcctgcaaagctgggtacacaggaacacagtgtgaaaggtgtgcaccgggatatttcgggaatccccagaaattcggaggtagctgccaaccatgcagttgtaacagcaatggccagctgggcagctgtcatcccctgactggagactgcataaaccaagaacccaaagatagcagccctgcagaagaatgtgatgattgcgacagctgtgtgatgaccctcctgaacgacctggccaccatgggcgagcagctccgcctggtcaagtctcagctgcagggcctgagtgccagcgcagggcttctggagcagatgaggcacatggagacccaggccaaggacctgaggaatcagttgctcaactaccgttctgccatttcaaatcatggatcaaaaatagaaggcctggaaagagaactgactgatttgaatcaagaatttgagactttgcaagaaaaggctcaagtaaattccagaaaagcacaaacattaaacaacaatgttaatcgggcaacacaaagcgcaaaagaactggatgtgaagattaaaaatgtcatccggaatgtgcacattcttttaaagcagatctctgggacagatggagagggaaacaacgtgccttcaggtgacttttccagagagtgggctgaagcccagcgcatgatgagggaactgcggaacaggaactttggaaagcacctcagagaagcagaagctgataaaagggagtcgcagctcttgctgaaccggataaggacctggcagaaaacccaccagggggagaacaatgggcttgctaacagtatccgggattctttaaatgaatacgaagccaaactcagtgaccttcgtgctcggctgcaggaggcagctgcccaagccaagcaggcaaatggcttgaaccaagaaaacgagagagctttgggagccattcagagacaagtgaaagaaataaattccctgcagagtgatttcaccaagtatctaaccactgcagactcatctttgttgcaaaccaacattgcgctgcagctgatggagaaaagccagaaggaatatgaaaaattagctgccagtttaaatgaagcaagacaagaactaagtgacaaagtaagagaactttccagatctgctggcaaaacatcccttgtggaggaggcagaaaagcacgcgcggtccttacaagagctggcaaagcagctggaagagatcaagagaaacgccagcggggatgagctggtgcgctgtgctgtggatgccgccaccgcctacgagaacatcctcaatgccatcaaagcggccgaggacgcagccaacagggctgccagtgcatctgaatctgccctccagacagtgataaaggaagatctgccaagaaaagctaaaaccctgagttccaacagtgataaactgttaaatgaagccaagatgacacaaaagaagctaaagcaagaagtcagtccagctctcaacaacctacagcaaaccctgaatattgtgacagttcagaaagaagtgatagacaccaatctcacaactctccgagatggtcttcatgggatacagagaggtgatattgatgctatgatcagtagtgcaaagagcatggtcagaaaggccaacgacatcacagatgaggttctggatgggctcaaccccatccagacagatgtggaaagaattaaggacacctatgggaggacacagaacgaagacttcaaaaaggctctgactgatgcagataactcggtgaataagttaaccaacaaactacctgatctttggcgcaagattgaaagtatcaaccaacagctgttgcccttgggaaacatctctgacaacatggacagaatacgagaactaattcagcaggccagagatgctgccagtaaggttgctgtccccatgaggttcaatggtaaatctggagtcgaagtccgactgccaaatgacctggaagatttgaaaggatatacatctctgtccttgtttctccaaaggcccaactcaagagaaaatgggggtactgagaatatgtttgtgatgtaccttggaaataaagatgcctcccgggactacatcggcatggcagttgtggatggccagctcacctgtgtctacaacctgggggaccgtgaggctgaactccaagtggaccagatcttgaccaagagtgagactaaggaggcagttatggatcgggtgaaatttcagagaatttatcagtttgcaaggcttaattacaccaaaggagccacatccagtaaaccagaaacacccggagtctatgacatggatggtagaaatagcaatacactccttaatttggatcctgaaaatgttgtattttatgttggaggttacccacctgattttaaacttcccagtcgactaagtttccctccatacaaaggttgtattgaattagatgacctcaatgaaaatgttctgagcttgtacaacttcaaaaaaacattcaatctcaacacaactgaagtggagccttgtagaaggaggaaggaagagtcagacaaaaattattttgaaggtacgggctatgctcgagttccaactcaaccacatgctcccatcccaacctttggacagacaattcagaccaccgtggatagaggcttgctgttctttgcagaaaacggggatcgcttcatatctctaaatatagaagatggcaagctcatggtgagatacaaactgaattcagagctaccaaaagagagaggagttggagacgccataaacaacggcagagaccattcgattcagatcaaaattggaaaactccaaaagcgtatgtggataaatgtggacgttcaaaacactataattgatggtgaagtatttgatttcagcacatattatctgggaggaattccaattgcaatcagggaaagatttaacatttctacgcctgctttccgaggctgcatgaaaaatttgaagaaaaccagtggtgtcgttagattgaatgatactgtgggagtaaccaaaaagtgctcggaagactggaagcttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcagcccaatttttaaatctccacagacgtatatggatggtttactgcattatgtatctgtaataagcgacaactctggactacggcttctcatcgatgaccagcttctgagaaatagcaaaaggctaaaacacatttcaagttcccggcagtctctgcgtctgggcgggagcaattttgagggttgtattagcaatgtttttgtccagaggttatcactgagtcctgaagtcctagatttgaccagtaactctctcaagagagatgtgtccctgggaggctgcagtttaaacaaaccaccttttctaatgttgcttaaaggttctaccaggtttaacaagaccaagacttttcgtatcaaccagctgttgcaggacacaccagtggcctccccaaggagcgtgaaggtgtggcaagatgcttgctcaccacttcccaagacccaggccaatcatggagccctccagtttggggacattcccaccagccacttgctattcaagcttcctcaggagctgctgaaacccaggtcacagtttgctgtggacatgcagacaacatcctccagaggactggtgtttcacacgggcactaagaactcctttatggctctttatctttcaaaaggacgtctggtctttgcactggggacagatgggaaaaaattgaggatcaaaagcaaggagaaatgcaatgatgggaaatggcacacggtggtgtttggccatgatggggaaaaggggcgcttggttgtggatggactgagggcccgggagggaagtttgcctggaaactccaccatcagcatcagagcgccagtttacctgggatcacctccatcagggaaaccaaagagcctccccacaaacagctttgtgggatgcctgaagaactttcagctggattcaaaacccttgtataccccttcttcaagcttcggggtgtcttcctgcttgggtggtcctttggagaaaggcatttatttctctgaagaaggaggtcatgtcgtcttggctcactctgtattgttggggccagaatttaagcttgttttcagcatccgcccaagaagtctcactgggatcctaatacacatcggaagtcagcccgggaagcacttatgtgtttacctggaggcaggaaaggtcacggcctctatggacagtggggcaggtgggacctcaacgtcggtcacaccaaagcagtctctgtgtgatggacagtggcactcggtggcagtcaccataaaacaacacatcctgcacctggaactggacacagacagtagctacacagctggacagatccccttcccacctgccagcactcaagagccactacaccttggaggtgctccagccaatttgacgacactgaggatccctgtgtggaaatcattctttggctgtctgaggaatattcatgtcaatcacatccctgtccctgtcactgaagccttggaagtccaggggcctgtcagtctgaatggttgtcctgaccagtaacccaagcctatttcacagcaaggaaattcaccttcaaaagcactgattacccaatgcacctccctccccagctcgagatcattcttcactcaggacacaaaccagacaggtttaatagcgaatctaattttgaattctgaccatggatacccatcactttggcattcagtgctacatgtgtattttatataaaaatcccatttcttgaagataaaaaaattgttattcaaattgttatgcacagaatgtttttggtaatattaatttccactaaaaaattaaatgtcttttaagaaacattcttttccacttgttaaaaaaattaaatatattttaaagcactttaagaatatgaaactttcatatatgttaaaggattataatttatggaattaaaaaatgcagtgtagtccttaaaaaaaa

SEQ ID NO: 59289 - DNA, 10511 bp, Homo sapiens
gcaggtccgggaggcgcaggcggagagcggcggtgcccccgagcccctctgcggacggctcaggcgggaggaccccgcgcggctggatggcggcggccgcgcggcctcggggtcgggcactggggccagtactgccgccgacgccgctgctcctgctggtactgcgggtgctgccagcctgcggggcgaccgctcgggatcccggggccgcggccgggctcagccttcacccgacttacttcaacctggccgaggcggcgaggatttgggccaccgccacctgcggggagaggggacccggcgaggggaggccccagcccgagctctactgcaagttggtcgggggccccaccgccccaggcagcggccacaccatccagggccagttctgtgactattgcaattctgaagaccccaggaaagcacatcctgtcaccaatgccatcgatggatctgaacgttggtggcaaagccctcccctgtcctcaggcacacagtacaacagagtcaacctcaccttggatctggggcagctcttccatgtggcctatattttaatcaaatttgcaaattctcctcgccctgatctttgggtcttggaaagatctgtagactttggaagcacctactcaccatggcaatattttgctcattctaaagtagactgtttaaaagaatttgggcgggaggcaaatatggctgtcacccgggatgatgatgtactttgtgttactgaatattcccgtattgtacctttggaaaatggtgaggttgtggtgtccttgataaacggtcgtccaggtgcaaaaaattttactttctctcacaccctgagggagtttaccaaggcaacaaacatccgcttgcgttttcttagaaccaatacgcttcttggacacctcatctccaaagcccagcgagatccaactgtcactcggcggtattattacagcataaaggacatcagcattggtgggcagtgtgtttgcaatggccatgctgaagtgtgcaatataaacaatcctgaaaaactgtttcggtgtgaatgccagcaccacacctgtggggagacgtgtgatcgctgctgcacagggtacaatcagaggcgctggcggcccgccgcttgggagcagagccacgagtgtgaagcatgcaactgccacggccatgccagcaactgttactatgatccagatgttgagcggcagcaggcaagcttgaatacccagggcatctatgctggtggaggggtctgcattaactgtcagcacaacacagctggagtaaactgtgaacagtgtgctaagggctattaccgcccttatggggttccagtggatgcccctgatggctgcatcccctgcagctgtgaccctgagcatgcggatggctgtgaacagggttcaggccgctgtcactgcaagccaaatttccacggagacaactgtgagaagtgtgcaattggatactacaatttcccattttgcttgagaattcccatttttcctgtttctacaccaagttcagaagatccagtagctggagatataaaagggtgtgactgtaatctggaaggtgttctccctgaaatatgtgatgcccacggacggtgcctgtgccgccctggggttgagggccctcgatgtgatacctgccgctctggtttctactcattccctatttgccaagcctgctggtgttcagcccttggatcctaccagatgccctgcagctcagtgactggacagtgtgaatgtcggccaggagttacaggacagcggtgtgacaggtgtctctcaggagcttatgatttcccccactgccaaggttccagcagtgcttgtgacccagctggtaccatcaactccaatttggggtattgccaatgcaagcttcatgttgaaggtcctacttgtagccgctgcaaactgttatattggaatctggacaaagaaaaccccagtggatgttcagaatgcaagtgccataaggcgggaacagtgagtggaactggagagtgtaggcagggagatggtgactgtcactgcaagtcccatgtgggtggcgattcctgcgacacctgtgaagatggatattttgctttggaaaagagcaattactttgggtgtcaagggtgtcagtgtgacattggtggggcattgtcctccatgtgcagtgggccctcgggagtgtgccagtgccgagagcatgtcgtgggaaaggtgtgccagcggcctgaaaacaactactatttcccagatttgcatcatatgaagtatgagattgaagacggcagcacacctaatgggagagaccttcgatttggatttgatccgctggcatttcctgagtttagctggagaggatatgcccaaatgacctcagtacagaatgatgtaagaataacattgaatgtagggaagtcaagtggctccttgtttcgtgttattctgagatacgttaaccctggaactgaagcagtatctggccatataactatttatccatcctggggtgctgctcaaagcaaagagatcatcttcctgccgagtaaggagccagcctttgtcactgtccctggaaatggttttgcagacccattttcaatcacaccaggaatatgggttgcttgtattaaggcagaaggagtccttctggattacctggtgctgctccccagggactactatgaagcctctgtactgcagctgccagtcacagaaccatgtgcctacgcaggacctccccaagaaaattgcttactctaccagcatttgccagtgaccagattcccctgtaccctggcttgtgaggccagacacttcctgcttgatggggagccaagacccgtggcagtgaggcagcccacacctgcacaccctgtcatggtggacctcagcgggagagaggtggaattgcatctgcggctgcgcatcccacaggttggccactacgtggttgtggtcgagtattccacggaggcagctcagctgtttgtggttgatgtgaatgtgaagagctccgggtctgttctggcaggccaggtgaacatttacagctgcaactacagtgttctctgccggagtgctgtgattgatcacatgagccgcatcgccatgtatgagctattggcagatgcagacattcagctcaagggacacatggcccgattccttctgcatcaagtttgtatcatacctattgaagaattctcagctgagtatgtgagaccacaagtccactgcattgccagttatgggcgatttgtcaatcaaagtgccacctgtgtctccttggcccatgaaactcctccaacagcattaattttggatgttctaagtggcaggcctttccctcacctgccccagcagtcgtcaccttctgttgatgttcttcctggggtcaccttgaaggcaccgcagaatcaagtgaccctgagaggacgtgtaccacacctgggccgatacgtctttgtcatccatttttaccaagcagcgcacccgacgtttcccgcgcaggtgtcggtggatggcgggtggccacgggcaggctccttccatgcctctttttgcccccatgtgcttggctgccgggatcaagtgattgccgaaggccagattgagtttgacatctcagagcctgaagtggccgcaactgtgaaggttccagaaggaaagtccttggttttggtccgtgttctagtggtgcctgcagaaaactatgactaccaaatacttcacaaaaaatccatggacaagtcactcgagtttatcaccaattgtggaaaaaacagcttttaccttgacccccagacagcctccagattctgtaagaattccgccaggtccctggtggccttttaccacaagggcgccctgccttgtgagtgccaccccactggggccaccggccctcactgcagccctgagggtgggcagtgcccatgccagcccaacgtcatcgggcggcagtgcacccgctgtgcaacaggccactacggattcccacgctgcaagccgtgcagctgtggtcggcgcctttgtgaagagatgacggggcagtgccgctgccctccccgcacggtcaggccccagtgtgaggtgtgtgagacacactcattcagcttccaccccatggccggctgcgaaggctgcaactgttccaggaggggcaccatcgaggctgccatgccggagtgtgaccgggacagcgggcagtgcagatgcaagcccagaatcacagggcggcagtgtgaccgatgtgcttccgggttttaccgctttcctgagtgtgttccctgcaattgcaacagagatgggactgagccaggagtgtgtgacccagggaccggggcttgcctctgcaaggaaaatgtagaaggcacagagtgtaatgtgtgtcgagaaggctcattccatttggacccagccaatctcaagggttgtaccagctgtttctgttttggagtaaataatcaatgtcacagctcacataagcgaaggactaagtttgtggatatgctgggctggcacctggagacagcagacagagtggacatccctgtctctttcaacccaggcagcaacagtatggtggcggatctccaggagctgcccgcaaccatccacagcgcgtcctgggtcgcacccacctcctacctgggggacaaggtttcttcatatggtggttacctcacttaccaagccaagtcctttggcttgcctggcgacatggttcttctggaaaagaagccggatgtacagctcactggtcagcacatgtccatcatctatgaggagacaaacaccccacggccagaccggctgcatcatggacgagtgcacgtggtcgagggaaacttcagacatgccagcagccgtgccccagtgtctagggaggagctgatgacagtgctgtctagactggcagatgtgcgcatccaaggcctctacttcacagagactcaaaggctcaccctgagcgaggtggggctagaggaagcctctgacacaggaagtgggcgcatagcacttgctgtggaaatctgtgcctgcccccctgcctacgctggtgactcttgtcagggttgtagccctggatactatcgggatcataaaggcttgtataccggacggtgtgttccctgcaattgcaacggacattcaaatcaatgccaggatggctcaggcatatgtgttaactgtcagcacaacaccgcgggagagcactgtgaacgctgccaggagggctactatggcaacgccgtccacggatcctgcagggcctgcccatgtcctcacactaacagctttgccactggctgtgtggtgaatgggggagacgtgcggtgctcctgcaaagctgggtacacaggaacacagtgtgaaaggtgtgcaccgggatatttcgggaatccccagaaattcggaggtagctgccaaccatgcagttgtaacagcaatggccagctgggcagctgtcatcccctgactggagactgcataaaccaagaacccaaagatagcagccctgcagaagaatgtgatgattgcgacagctgtgtgatgaccctcctgaacgacctggccaccatgggcgagcagctccgcctggtcaagtctcagctgcagggcctgagtgccagcgcagggcttctggagcagatgaggcacatggagacccaggccaaggacctgaggaatcagttgctcaactaccgttctgccatttcaaatcatggatcaaaaatagaaggcctggaaagagaactgactgatttgaatcaagaatttgagactttgcaagaaaaggctcaagtaaattccagaaaagcacaaacattaaacaacaatgttaatcgggcaacacaaagcgcaaaagaactggatgtgaagattaaaaatgtcatccggaatgtgcacattcttttaaagcagatctctgggacagatggagagggaaacaacgtgccttcaggtgacttttccagagagtgggctgaagcccagcgcatgatgagggaactgcggaacaggaactttggaaagcacctcagagaagcagaagctgataaaagggagtcgcagctcttgctgaaccggataaggacctggcagaaaacccaccagggggagaacaatgggcttgctaacagtatccgggattctttaaatgaatacgaagccaaactcagtgaccttcgtgctcggctgcaggaggcagctgcccaagccaagcaggcaaatggcttgaaccaagaaaacgagagagctttgggagccattcagagacaagtgaaagaaataaattccctgcagagtgatttcaccaagtatctaaccactgcagactcatctttgttgcaaaccaacattgcgctgcagctgatggagaaaagccagaaggaatatgaaaaattagctgccagtttaaatgaagcaagacaagaactaagtgacaaagtaagagaactttccagatctgctggcaaaacatcccttgtggaggaggcagaaaagcacgcgcggtccttacaagagctggcaaagcagctggaagagatcaagagaaacgccagcggggatgagctggtgcgctgtgctgtggatgccgccaccgcctacgagaacatcctcaatgccatcaaagcggccgaggacgcagccaacagggctgccagtgcatctgaatctgccctccagacagtgataaaggaagatctgccaagaaaagctaaaaccctgagttccaacagtgataaactgttaaatgaagccaagatgacacaaaagaagctaaagcaagaagtcagtccagctctcaacaacctacagcaaaccctgaatattgtgacagttcagaaagaagtgatagacaccaatctcacaactctccgagatggtcttcatgggatacagagaggtgatattgatgctatgatcagtagtgcaaagagcatggtcagaaaggccaacgacatcacagatgaggttctggatgggctcaaccccatccagacagatgtggaaagaattaaggacacctatgggaggacacagaacgaagacttcaaaaaggctctgactgatgcagataactcggtgaataagttaaccaacaaactacctgatctttggcgcaagattgaaagtatcaaccaacagctgttgcccttgggaaacatctctgacaacatggacagaatacgagaactaattcagcaggccagagatgctgccagtaaggttgctgtccccatgaggttcaatggtaaatctggagtcgaagtccgactgccaaatgacctggaagatttgaaaggatatacatctctgtccttgtttctccaaaggcccaactcaagagaaaatgggggtactgagaatatgtttgtgatgtaccttggaaataaagatgcctcccgggactacatcggcatggcagttgtggatggccagctcacctgtgtctacaacctgggggaccgtgaggctgaactccaagtggaccagatcttgaccaagagtgagactaaggaggcagttatggatcgggtgaaatttcagagaatttatcagtttgcaaggcttaattacaccaaaggagccacatccagtaaaccagaaacacccggagtctatgacatggatggtagaaatagcaatacactccttaatttggatcctgaaaatgttgtattttatgttggaggttacccacctgattttaaacttcccagtcgactaagtttccctccatacaaaggttgtattgaattagatgacctcaatgaaaatgttctgagcttgtacaacttcaaaaaaacattcaatctcaacacaactgaagtggagccttgtagaaggaggaaggaagagtcagacaaaaattattttgaaggtacgggctatgctcgagttccaactcaaccacatgctcccatcccaacctttggacagacaattcagaccaccgtggatagaggcttgctgttctttgcagaaaacggggatcgcttcatatctctaaatatagaagatggcaagctcatggtgagatacaaactgaattcagagctaccaaaagagagaggagttggagacgccataaacaacggcagagaccattcgattcagatcaaaattggaaaactccaaaagcgtatgtggataaatgtggacgttcaaaacactataattgatggtgaagtatttgatttcagcacatattatctgggaggaattccaattgcaatcagggaaagatttaacatttctacgcctgctttccgaggctgcatgaaaaatttgaagaaaaccagtggtgtcgttagattgaatgatactgtgggagtaaccaaaaagtgctcggaagactggaagcttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcagcccaatttttaaatctccacagacgtatatggatggtttactgcattatgtatctgtaataagcgacaactctggactacggcttctcatcgatgaccagcttctgagaaatagcaaaaggctaaaacacatttcaagttcccggcagtctctgcgtctgggcgggagcaattttgagggttgtattagcaatgtttttgtccagaggttatcactgagtcctgaagtcctagatttgaccagtaactctctcaagagagatgtgtccctgggaggctgcagtttaaacaaaccaccttttctaatgttgcttaaaggttctaccaggtttaacaagaccaagacttttcgtatcaaccagctgttgcaggacacaccagtggcctccccaaggagcgtgaaggtgtggcaagatgcttgctcaccacttcccaagacccaggccaatcatggagccctccagtttggggacattcccaccagccacttgctattcaagcttcctcaggagctgctgaaacccaggtcacagtttgctgtggacatgcagacaacatcctccagaggactggtgtttcacacgggcactaagaactcctttatggctctttatctttcaaaaggacgtctggtctttgcactggggacagatgggaaaaaattgaggatcaaaagcaaggagaaatgcaatgatgggaaatggcacacggtggtgtttggccatgatggggaaaaggggcgcttggttgtggatggactgagggcccgggagggaagtttgcctggaaactccaccatcagcatcagagcgccagtttacctgggatcacctccatcagggaaaccaaagagcctccccacaaacagctttgtgggatgcctgaagaactttcagctggattcaaaacccttgtataccccttcttcaagcttcggggtgtcttcctgcttgggtggtcctttggagaaaggcatttatttctctgaagaaggaggtcatgtcgtcttggctcactctgtattgttggggccagaatttaagcttgttttcagcatccgcccaagaagtctcactgggatcctaatacacatcggaagtcagcccgggaagcacttatgtgtttacctggaggcaggaaaggtcacggcctctatggacagtggggcaggtgggacctcaacgtcggtcacaccaaagcagtctctgtgtgatggacagtggcactcggtggcagtcaccataaaacaacacatcctgcacctggaactggacacagacagtagctacacagctggacagatccccttcccacctgccagcactcaagagccactacaccttggaggtgctccagccaatttgacgacactgaggatccctgtgtggaaatcattctttggctgtctgaggaatattcatgtcaatcacatccctgtccctgtcactgaagccttggaagtccaggggcctgtcagtctgaatggttgtcctgaccagtaacccaagcctatttcacagcaaggaaattcaccttcaaaagcactgattacccaatgcacctccctccccagctcgagatcattcttcactcaggacacaaaccagacaggtttaatagcgaatctaattttgaattctgaccatggatacccatcactttggcattcagtgctacatgtgtattttatataaaaatcccatttcttgaagataaaaaaattgttattcaaattgttatgcacagaatgtttttggtaatattaatttccactaaaaaattaaatgtcttttaagaaacattcttttccacttgttaaaaaaattaaatatattttaaagcactttaagaatatgaaactttcatatatgttaaaggattataatttatggaattaaaaaatgcagtgtagtccttaaaaaaaa

SEQ ID NO: 59290 - DNA, 4093 bp, Homo sapiens
cagaggtgaggctgttgtttaaaaacctggagccgggaggggagacccccacattcaagaggagctttcaggcgatctggagaaagaacggcagaacacacagcaaggaaaggtcctttctggggatcaccccattggctgaagatgagaccattcttcctcttgtgttttgccctgcctggcctcctgcatgcccaacaagcctgctcccgtggggcctgctatccacctgttggggacctgcttgttgggaggacccggtttctccgagcttcatctacctgtggactgaccaagcctgagacctactgcacccagtatggcgagtggcagatgaaatgctgcaagtgtgactccaggcagcctcacaactactacagtcaccgagtagagaatgtggcttcatcctccggccccatgcgctggtggcagtcacagaatgatgtgaaccctgtctctctgcagctggacctggacaggagattccagcttcaagaagtcatgatggagttccaggggcccatgcccgccggcatgctgattgagcgctcctcagacttcggtaagacctggcgagtgtaccagtacctggctgccgactgcacctccaccttccctcgggtccgccagggtcggcctcagagctggcaggatgttcggtgccagtccctgcctcagaggcctaatgcacgcctaaatggggggaaggtccaacttaaccttatggatttagtgtctgggattccagcaactcaaagtcaaaaaattcaagaggtgggggagatcacaaacttgagagtcaatttcaccaggctggcccctgtgccccaaaggggctaccaccctcccagcgcctactatgctgtgtcccagctccgtctgcaggggagctgcttctgtcacggccatgctgatcgctgcgcacccaagcctggggcctctgcaggcccctccaccgctgtgcaggtccacgatgtctgtgtctgccagcacaacactgccggcccaaattgtgagcgctgtgcacccttctacaacaaccggccctggagaccggcggagggccaggacgcccatgaatgccaaaggtgcgactgcaatgggcactcagagacatgtcactttgaccccgctgtgtttgccgccagccagggggcatatggaggtgtgtgtgacaattgccgggaccacaccgaaggcaagaactgtgagcggtgtcagctgcactatttccggaaccggcgcccgggagcttccattcaggagacctgcatctcctgcgagtgtgatccggatggggcagtgccaggggctccctgtgacccagtgaccgggcagtgtgtgtgcaaggagcatgtgcagggagagcgctgtgacctatgcaagccgggcttcactggactcacctacgccaacccgcagggctgccaccgctgtgactgcaacatcctggggtcccggagggacatgccgtgtgacgaggagagtgggcgctgcctttgtctgcccaacgtggtgggtcccaaatgtgaccagtgtgctccctaccactggaagctggccagtggccagggctgtgaaccgtgtgcctgcgacccgcacaactccctcagcccacagtgcaaccagttcacagggcagtgcccctgtcgggaaggctttggtggcctgatgtgcagcgctgcagccatccgccagtgtccagaccggacctatggagacgtggccacaggatgccgagcctgtgactgtgatttccggggaacagagggcccgggctgcgacaaggcatcaggccgctgcctctgccgccctggcttgaccgggccccgctgtgaccagtgccagcgaggctactgtaatcgctacccggtgtgcgtggcctgccacccttgcttccagacctatgatgcggacctccgggagcaggccctgcgctttggtagactccgcaatgccaccgccagcctgtggtcagggcctgggctggaggaccgtggcctggcctcccggatcctagatgcaaagagtaagattgagcagatccgagcagttctcagcagccccgcagtcacagagcaggaggtggctcaggtggccagtgccatcctctccctcaggcgaactctccagggcctgcagctggatctgcccctggaggaggagacgttgtcccttccgagagacctggagagtcttgacagaagcttcaatggtctccttactatgtatcagaggaagagggagcagtttgaaaaaataagcagtgctgatccttcaggagccttccggatgctgagcacagcctacgagcagtcagcccaggctgctcagcaggtctccgacagctcgcgccttttggaccagctcagggacagccggagagaggcagagaggctggtgcggcaggcgggaggaggaggaggcaccggcagccccaagcttgtggccctgaggctggagatgtcttcgttgcctgacctgacacccaccttcaacaagctctgtggcaactccaggcagatggcttgcaccccaatatcatgccctggtgagctatgtccccaagacaatggcacagcctgtggctcccgctgcaggggtgtccttcccagggccggtggggccttcttgatggcggggcaggtggctgagcagctgcggggcttcaatgcccagctccagcggaccaggcagatgattagggcagccgaggaatctgcctcacagattcaatccagtgcccagcgcttggagacccaggtgagcgccagccgctcccagatggaggaagatgtcagacgcacacggctcctaatccagcaggtccgggacttcctaacagaccccgacactgatgcagccactatccaggaggtcagcgaggccgtgctggccctgtggctgcccacagactcagctactgttctgcagaagatgaatgagatccaggccattgcagccaggctccccaacgtggacttggtgctgtcccagaccaagcaggacattgcgcgtgcccgccggttgcaggctgaggctgaggaagccaggagccgagcccatgcagtggagggccaggtggaagatgtggttgggaacctgcggcaggggacagtggcactgcaggaagctcaggacaccatgcaaggcaccagccgctcccttcggcttatccaggacagggttgctgaggttcagcaggtactgcggccagcagaaaagctggtgacaagcatgaccaagcagctgggtgacttctggacacggatggaggagctccgccaccaagcccggcagcagggggcagaggcagtccaggcccagcagcttgcggaaggtgccagcgagcaggcattgagtgcccaagagggatttgagagaataaaacaaaagtatgctgagttgaaggaccggttgggtcagagttccatgctgggtgagcagggtgcccggatccagagtgtgaagacagaggcagaggagctgtttggggagaccatggagatgatggacaggatgaaagacatggagttggagctgctgcggggcagccaggccatcatgctgcgctcagcggacctgacaggactggagaagcgtgtggagcagatccgtgaccacatcaatgggcgcgtgctctactatgccacctgcaagtgatgctacagcttccagcccgttgccccactcatctgccgcctttgcttttggttgggggcagattgggttggaatgctttccatctccaggagactttcatgcagcctaaagtacagcctggaccacccctggtgtgtagctagtaagattaccctgagctgcagctgagcctgagccaatgggacagttacacttgacagacaaagatggtggagattggcatgccattgaaactaagagctctcaagtcaaggaagctgggctgggcagtatcccccgcctttagttctccactggggaggaatcctggaccaagcacaaaaacttaacaaaagtgatgtaaaaatgaaaagccaaataaaaatctttggaaaagagcctggaggttcaacgaggaaaaaaaaaaaaaaaaaaaaaaaaaaaaaaaaaa

SEQ ID NO: 59291 - DNA, 4339 bp, Homo sapiens
cttttctcctgcaaagggtccagccttttcctgctccccacgttgtccttacggctgtgtggggtagggcagggtccacactccttcccatccattttagaggaggaagctggagtctgggaagggatgggattttcccagggcaccctgtgagtcacatgccacttgagacaagggtctagagctccagcattttccaagctacaaatgtatctgctgctccaagtgtcctagatcaggaccctaggtaaagacttctgaaaaatacttgagtctagaaacagaaaagaaaaagggctagtgtgctctaggggtttgcactgttgtacccagtttgctttgctgtgtcctaggaaaggtcctttctggggatcaccccattggctgaagatgagaccattcttcctcttgtgttttgccctgcctggcctcctgcatgcccaacaagcctgctcccgtggggcctgctatccacctgttggggacctgcttgttgggaggacccggtttctccgagcttcatctacctgtggactgaccaagcctgagacctactgcacccagtatggcgagtggcagatgaaatgctgcaagtgtgactccaggcagcctcacaactactacagtcaccgagtagagaatgtggcttcatcctccggccccatgcgctggtggcagtcacagaatgatgtgaaccctgtctctctgcagctggacctggacaggagattccagcttcaagaagtcatgatggagttccaggggcccatgcccgccggcatgctgattgagcgctcctcagacttcggtaagacctggcgagtgtaccagtacctggctgccgactgcacctccaccttccctcgggtccgccagggtcggcctcagagctggcaggatgttcggtgccagtccctgcctcagaggcctaatgcacgcctaaatggggggaaggtccaacttaaccttatggatttagtgtctgggattccagcaactcaaagtcaaaaaattcaagaggtgggggagatcacaaacttgagagtcaatttcaccaggctggcccctgtgccccaaaggggctaccaccctcccagcgcctactatgctgtgtcccagctccgtctgcaggggagctgcttctgtcacggccatgctgatcgctgcgcacccaagcctggggcctctgcaggcccctccaccgctgtgcaggtccacgatgtctgtgtctgccagcacaacactgccggcccaaattgtgagcgctgtgcacccttctacaacaaccggccctggagaccggcggagggccaggacgcccatgaatgccaaaggtgcgactgcaatgggcactcagagacatgtcactttgaccccgctgtgtttgccgccagccagggggcatatggaggtgtgtgtgacaattgccgggaccacaccgaaggcaagaactgtgagcggtgtcagctgcactatttccggaaccggcgcccgggagcttccattcaggagacctgcatctcctgcgagtgtgatccggatggggcagtgccaggggctccctgtgacccagtgaccgggcagtgtgtgtgcaaggagcatgtgcagggagagcgctgtgacctatgcaagccgggcttcactggactcacctacgccaacccgcagggctgccaccgctgtgactgcaacatcctggggtcccggagggacatgccgtgtgacgaggagagtgggcgctgcctttgtctgcccaacgtggtgggtcccaaatgtgaccagtgtgctccctaccactggaagctggccagtggccagggctgtgaaccgtgtgcctgcgacccgcacaactccctcagcccacagtgcaaccagttcacagggcagtgcccctgtcgggaaggctttggtggcctgatgtgcagcgctgcagccatccgccagtgtccagaccggacctatggagacgtggccacaggatgccgagcctgtgactgtgatttccggggaacagagggcccgggctgcgacaaggcatcaggccgctgcctctgccgccctggcttgaccgggccccgctgtgaccagtgccagcgaggctactgtaatcgctacccggtgtgcgtggcctgccacccttgcttccagacctatgatgcggacctccgggagcaggccctgcgctttggtagactccgcaatgccaccgccagcctgtggtcagggcctgggctggaggaccgtggcctggcctcccggatcctagatgcaaagagtaagattgagcagatccgagcagttctcagcagccccgcagtcacagagcaggaggtggctcaggtggccagtgccatcctctccctcaggcgaactctccagggcctgcagctggatctgcccctggaggaggagacgttgtcccttccgagagacctggagagtcttgacagaagcttcaatggtctccttactatgtatcagaggaagagggagcagtttgaaaaaataagcagtgctgatccttcaggagccttccggatgctgagcacagcctacgagcagtcagcccaggctgctcagcaggtctccgacagctcgcgccttttggaccagctcagggacagccggagagaggcagagaggctggtgcggcaggcgggaggaggaggaggcaccggcagccccaagcttgtggccctgaggctggagatgtcttcgttgcctgacctgacacccaccttcaacaagctctgtggcaactccaggcagatggcttgcaccccaatatcatgccctggtgagctatgtccccaagacaatggcacagcctgtggctcccgctgcaggggtgtccttcccagggccggtggggccttcttgatggcggggcaggtggctgagcagctgcggggcttcaatgcccagctccagcggaccaggcagatgattagggcagccgaggaatctgcctcacagattcaatccagtgcccagcgcttggagacccaggtgagcgccagccgctcccagatggaggaagatgtcagacgcacacggctcctaatccagcaggtccgggacttcctaacagaccccgacactgatgcagccactatccaggaggtcagcgaggccgtgctggccctgtggctgcccacagactcagctactgttctgcagaagatgaatgagatccaggccattgcagccaggctccccaacgtggacttggtgctgtcccagaccaagcaggacattgcgcgtgcccgccggttgcaggctgaggctgaggaagccaggagccgagcccatgcagtggagggccaggtggaagatgtggttgggaacctgcggcaggggacagtggcactgcaggaagctcaggacaccatgcaaggcaccagccgctcccttcggcttatccaggacagggttgctgaggttcagcaggtactgcggccagcagaaaagctggtgacaagcatgaccaagcagctgggtgacttctggacacggatggaggagctccgccaccaagcccggcagcagggggcagaggcagtccaggcccagcagcttgcggaaggtgccagcgagcaggcattgagtgcccaagagggatttgagagaataaaacaaaagtatgctgagttgaaggaccggttgggtcagagttccatgctgggtgagcagggtgcccggatccagagtgtgaagacagaggcagaggagctgtttggggagaccatggagatgatggacaggatgaaagacatggagttggagctgctgcggggcagccaggccatcatgctgcgctcagcggacctgacaggactggagaagcgtgtggagcagatccgtgaccacatcaatgggcgcgtgctctactatgccacctgcaagtgatgctacagcttccagcccgttgccccactcatctgccgcctttgcttttggttgggggcagattgggttggaatgctttccatctccaggagactttcatgcagcctaaagtacagcctggaccacccctggtgtgtagctagtaagattaccctgagctgcagctgagcctgagccaatgggacagttacacttgacagacaaagatggtggagattggcatgccattgaaactaagagctctcaagtcaaggaagctgggctgggcagtatcccccgcctttagttctccactggggaggaatcctggaccaagcacaaaaacttaacaaaagtgatgtaaaaatgaaaagccaaataaaaatctttggaaaagagcctggaggttcaacgaggaaaaaaaaaaaaaaaaaaaaaaaaaaaaaaaaaa

SEQ ID NO: 59292 - DNA, 5175 bp, Homo sapiens
acagcggagcgcagagtgagaaccaccaaccgaggcgccgggcagcgacccctgcagcggagacagagactgagcggcccggcaccgccatgcctgcgctctggctgggctgctgcctctgcttctcgctcctcctgcccgcagcccgggccacctccaggagggaagtctgtgattgcaatgggaagtccaggcagtgtatctttgatcgggaacttcacagacaaactggtaatggattccgctgcctcaactgcaatgacaacactgatggcattcactgcgagaagtgcaagaatggcttttaccggcacagagaaagggaccgctgtttgccctgcaattgtaactccaaaggttctcttagtgctcgatgtgacaactctggacggtgcagctgtaaaccaggtgtgacaggagccagatgcgaccgatgtctgccaggcttccacatgctcacggatgcggggtgcacccaagaccagagactgctagactccaagtgtgactgtgacccagctggcatcgcagggccctgtgacgcgggccgctgtgtctgcaagccagctgttactggagaacgctgtgataggtgtcgatcaggttactataatctggatggggggaaccctgagggctgtacccagtgtttctgctatgggcattcagccagctgccgcagctctgcagaatacagtgtccataagatcacctctacctttcatcaagatgttgatggctggaaggctgtccaacgaaatgggtctcctgcaaagctccaatggtcacagcgccatcaagatgtgtttagctcagcccaacgactagaccctgtctattttgtggctcctgccaaatttcttgggaatcaacaggtgagctatgggcaaagcctgtcctttgactaccgtgtggacagaggaggcagacacccatctgcccatgatgtgattctggaaggtgctggtctacggatcacagctcccttgatgccacttggcaagacactgccttgtgggctcaccaagacttacacattcaggttaaatgagcatccaagcaataattggagcccccagctgagttactttgagtatcgaaggttactgcggaatctcacagccctccgcatccgagctacatatggagaatacagtactgggtacattgacaatgtgaccctgatttcagcccgccctgtctctggagccccagcaccctgggttgaacagtgtatatgtcctgttgggtacaaggggcaattctgccaggattgtgcttctggctacaagagagattcagcgagactggggccttttggcacctgtattccttgtaactgtcaagggggaggggcctgtgatccagacacaggagattgttattcaggggatgagaatcctgacattgagtgtgctgactgcccaattggtttctacaacgatccgcacgacccccgcagctgcaagccatgtccctgtcataacgggttcagctgctcagtgatgccggagacggaggaggtggtgtgcaataactgccctcccggggtcaccggtgcccgctgtgagctctgtgctgatggctactttggggacccctttggtgaacatggcccagtgaggccttgtcagccctgtcaatgcaacaacaatgtggaccccagtgcctctgggaattgtgaccggctgacaggcaggtgtttgaagtgtatccacaacacagccggcatctactgcgaccagtgcaaagcaggctacttcggggacccattggctcccaacccagcagacaagtgtcgagcttgcaactgtaaccccatgggctcagagcctgtaggatgtcgaagtgatggcacctgtgtttgcaagccaggatttggtggccccaactgtgagcatggagcattcagctgtccagcttgctataatcaagtgaagattcagatggatcagtttatgcagcagcttcagagaatggaggccctgatttcaaaggctcagggtggtgatggagtagtacctgatacagagctggaaggcaggatgcagcaggctgagcaggcccttcaggacattctgagagatgcccagatttcagaaggtgctagcagatcccttggtctccagttggccaaggtgaggagccaagagaacagctaccagagccgcctggatgacctcaagatgactgtggaaagagttcgggctctgggaagtcagtaccagaaccgagttcgggatactcacaggctcatcactcagatgcagctgagcctggcagaaagtgaagcttccttgggaaacactaacattcctgcctcagaccactacgtggggccaaatggctttaaaagtctggctcaggaggccacaagattagcagaaagccacgttgagtcagccagtaacatggagcaactgacaagggaaactgaggactattccaaacaagccctctcactggtgcgcaaggccctgcatgaaggagtcggaagcggaagcggtagcccggacggtgctgtggtgcaagggcttgtggaaaaattggagaaaaccaagtccctggcccagcagttgacaagggaggccactcaagcggaaattgaagcagataggtcttatcagcacagtctccgcctcctggattcagtgtctcggcttcagggagtcagtgatcagtcctttcaggtggaagaagcaaagaggatcaaacaaaaagcggattcactctcaacgctggtaaccaggcatatggatgagttcaagcgtacacaaaagaatctgggaaactggaaagaagaagcacagcagctcttacagaatggaaaaagtgggagagagaaatcagatcagctgctttcccgtgccaatcttgctaaaagcagagcacaagaagcactgagtatgggcaatgccactttttatgaagttgagagcatccttaaaaacctcagagagtttgacctgcaggtggacaacagaaaagcagaagctgaagaagccatgaagagactctcctacatcagccagaaggtttcagatgccagtgacaagacccagcaagcagaaagagccctggggagcgctgctgctgatgcacagagggcaaagaatggggccggggaggccctggaaatctccagtgagattgaacaggagattgggagtctgaacttggaagccaatgtgacagcagatggagccttggccatggaaaagggactggcctctctgaagagtgagatgagggaagtggaaggagagctggaaaggaaggagctggagtttgacacgaatatggatgcagtacagatggtgattacagaagcccagaaggttgataccagagccaagaacgctggggttacaatccaagacacactcaacacattagacggcctcctgcatctgatggaccagcctctcagtgtagatgaagaggggctggtcttactggagcagaagctttcccgagccaagacccagatcaacagccaactgcggcccatgatgtcagagctggaagagagggcacgtcagcagaggggccacctccatttgctggagacaagcatagatgggattctggctgatgtgaagaacttggagaacattagggacaacctgcccccaggctgctacaatacccaggctcttgagcaacagtgaagctgccataaatatttctcaactgaggttcttgggatacagatctcagggctcgggagccatgtcatgtgagtgggtgggatggggacatttgaacatgtttaatgggtatgctcaggtcaactgacctgaccccattcctgatcccatggccaggtggttgtcttattgcaccatactccttgcttcctgatgctgggcaatgaggcagatagcactgggtgtgagaatgatcaaggatctggaccccaaagaatagactggatggaaagacaaactgcacaggcagatgtttgcctcataatagtcgtaagtggagtcctggaatttggacaagtgctgttgggatatagtcaacttattctttgagtaatgtgactaaaggaaaaaactttgactttgcccaggcatgaaattcttcctaatgtcagaacagagtgcaacccagtcacactgtggccagtaaaatactattgcctcatattgtcctctgcaagcttcttgctgatcagagttcctcctacttacaacccagggtgtgaacatgttctccattttcaagctggaagaagtgagcagtgttggagtgaggacctgtaaggcaggcccattcagagctatggtgcttgctggtgcctgccaccttcaagttctggacctgggcatgacatcctttcttttaatgatgccatggcaacttagagattgcatttttattaaagcatttcctaccagcaaagcaaatgttgggaaagtatttactttttcggtttcaaagtgatagaaaagtgtggcttgggcattgaaagaggtaaaattctctagatttattagtcctaattcaatcctacttttcgaacaccaaaaatgatgcgcatcaatgtattttatcttattttctcaatctcctctctctttcctccacccataataagagaatgttcctactcacacttcagctgggtcacatccatccctccattcatccttccatccatctttccatccattacctccatccatccttccaacatatatttattgagtacctactgtgtgccaggggctggtgggacagtggtgacatagtctctgccctcatagagttgattgtctagtgaggaagacaagcatttttaaaaaataaatttaaacttacaaactttgtttgtcacaagtggtgtttattgcaataaccgcttggtttgcaacctctttgctcaacagaacatatgttgcaagaccctcccatgggggcacttgagttttggcaaggctgacagagctctgggttgtgcacatttctttgcattccagctgtcactctgtgcctttctacaactgattgcaacagactgttgagttatgataacaccagtgggaattgctggaggaaccagaggcacttccaccttggctgggaagactatggtgctgccttgcttctgtatttccttggattttcctgaaagtgtttttaaataaagaacaattgttagatgcc

SEQ ID NO: 59293 - DNA, 4297 bp, Homo sapiens
acagcggagcgcagagtgagaaccaccaaccgaggcgccgggcagcgacccctgcagcggagacagagactgagcggcccggcaccgccatgcctgcgctctggctgggctgctgcctctgcttctcgctcctcctgcccgcagcccgggccacctccaggagggaagtctgtgattgcaatgggaagtccaggcagtgtatctttgatcgggaacttcacagacaaactggtaatggattccgctgcctcaactgcaatgacaacactgatggcattcactgcgagaagtgcaagaatggcttttaccggcacagagaaagggaccgctgtttgccctgcaattgtaactccaaaggttctcttagtgctcgatgtgacaactctggacggtgcagctgtaaaccaggtgtgacaggagccagatgcgaccgatgtctgccaggcttccacatgctcacggatgcggggtgcacccaagaccagagactgctagactccaagtgtgactgtgacccagctggcatcgcagggccctgtgacgcgggccgctgtgtctgcaagccagctgttactggagaacgctgtgataggtgtcgatcaggttactataatctggatggggggaaccctgagggctgtacccagtgtttctgctatgggcattcagccagctgccgcagctctgcagaatacagtgtccataagatcacctctacctttcatcaagatgttgatggctggaaggctgtccaacgaaatgggtctcctgcaaagctccaatggtcacagcgccatcaagatgtgtttagctcagcccaacgactagaccctgtctattttgtggctcctgccaaatttcttgggaatcaacaggtgagctatgggcaaagcctgtcctttgactaccgtgtggacagaggaggcagacacccatctgcccatgatgtgattctggaaggtgctggtctacggatcacagctcccttgatgccacttggcaagacactgccttgtgggctcaccaagacttacacattcaggttaaatgagcatccaagcaataattggagcccccagctgagttactttgagtatcgaaggttactgcggaatctcacagccctccgcatccgagctacatatggagaatacagtactgggtacattgacaatgtgaccctgatttcagcccgccctgtctctggagccccagcaccctgggttgaacagtgtatatgtcctgttgggtacaaggggcaattctgccaggattgtgcttctggctacaagagagattcagcgagactggggccttttggcacctgtattccttgtaactgtcaagggggaggggcctgtgatccagacacaggagattgttattcaggggatgagaatcctgacattgagtgtgctgactgcccaattggtttctacaacgatccgcacgacccccgcagctgcaagccatgtccctgtcataacgggttcagctgctcagtgatgccggagacggaggaggtggtgtgcaataactgccctcccggggtcaccggtgcccgctgtgagctctgtgctgatggctactttggggacccctttggtgaacatggcccagtgaggccttgtcagccctgtcaatgcaacaacaatgtggaccccagtgcctctgggaattgtgaccggctgacaggcaggtgtttgaagtgtatccacaacacagccggcatctactgcgaccagtgcaaagcaggctacttcggggacccattggctcccaacccagcagacaagtgtcgagcttgcaactgtaaccccatgggctcagagcctgtaggatgtcgaagtgatggcacctgtgtttgcaagccaggatttggtggccccaactgtgagcatggagcattcagctgtccagcttgctataatcaagtgaagattcagatggatcagtttatgcagcagcttcagagaatggaggccctgatttcaaaggctcagggtggtgatggagtagtacctgatacagagctggaaggcaggatgcagcaggctgagcaggcccttcaggacattctgagagatgcccagatttcagaaggtgctagcagatcccttggtctccagttggccaaggtgaggagccaagagaacagctaccagagccgcctggatgacctcaagatgactgtggaaagagttcgggctctgggaagtcagtaccagaaccgagttcgggatactcacaggctcatcactcagatgcagctgagcctggcagaaagtgaagcttccttgggaaacactaacattcctgcctcagaccactacgtggggccaaatggctttaaaagtctggctcaggaggccacaagattagcagaaagccacgttgagtcagccagtaacatggagcaactgacaagggaaactgaggactattccaaacaagccctctcactggtgcgcaaggccctgcatgaaggagtcggaagcggaagcggtagcccggacggtgctgtggtgcaagggcttgtggaaaaattggagaaaaccaagtccctggcccagcagttgacaagggaggccactcaagcggaaattgaagcagataggtcttatcagcacagtctccgcctcctggattcagtgtctcggcttcagggagtcagtgatcagtcctttcaggtggaagaagcaaagaggatcaaacaaaaagcggattcactctcaacgctggtaaccaggcatatggatgagttcaagcgtacacaaaagaatctgggaaactggaaagaagaagcacagcagctcttacagaatggaaaaagtgggagagagaaatcagatcagctgctttcccgtgccaatcttgctaaaagcagagcacaagaagcactgagtatgggcaatgccactttttatgaagttgagagcatccttaaaaacctcagagagtttgacctgcaggtggacaacagaaaagcagaagctgaagaagccatgaagagactctcctacatcagccagaaggtttcagatgccagtgacaagacccagcaagcagaaagagccctggggagcgctgctgctgatgcacagagggcaaagaatggggccggggaggccctggaaatctccagtgagattgaacaggagattgggagtctgaacttggaagccaatgtgacagcagatggagccttggccatggaaaagggactggcctctctgaagagtgagatgagggaagtggaaggagagctggaaaggaaggagctggagtttgacacgaatatggatgcagtacagatggtgattacagaagcccagaaggttgataccagagccaagaacgctggggttacaatccaagacacactcaacacattagacggcctcctgcatctgatgggtatgtgaacccacaacccacaaccttccagctccatgctccagggctttgctccagaacactcactatacctagccccagcaaaggggagtctcagctttccttaaggatatcagtaaatgtgctttgtttccaggcccagataactttcggcaggttcccttacatttactggaccctgttttaccgttgctaagatgggtcactgaacacctattgcacttgggggtaaaggtctgtgggccaaagaacaggtgtatataagcaacttcacagaacacgagacagcttgggaatcctgctaaagagtctggcctggaccctgagaagccagtggacagttttaagcagaggaataacatcaccactgtatatttcagaaagatcactagggcagccgagtggaggaaagcttgaagagggggttagagagaaggcaggttgagactacttaagatattgttgaaataattgaagagagaaatgacaggagcctgctctaaggcagtagaatggtggctgggaagatgtgaaggaagattttcccagtctgtgaagtcaagaatcacttgccggccgggtgtggtggctcacgcctgtaattctagcactttgggagactgaagcgggtggatcacccgaggtcaggagttgaagaccagcctggccaacatggtgaaaccctgtctctactaaaagtacaaaaattagctggatgtggtggtgggcgcctgtaattccagctactcaggagtctgaggcaggagaatcgcttgaacccaggaggcggaggttacagtgagccaagattgcaccactgctctccagcctggggaacagagcaagactgtctcaaaaaaaaaaaaaaaaggaaaaataa

SEQ ID NO: 59294 - DNA, 1795 bp, Homo sapiens
cgatgccggcggtcagtggtccaggtcccttattctgccttctcctcctgctcctggacccccacagccctgagacggggtgtcctcctctacgcaggtttgagtacaagctcagcttcaaaggcccaaggctggcattgcctggggctggaatacccttctggagccatcatggagacgccatcctgggcctggaggaagtgcggctgacgccatccatgaggaaccggagtggcgccgtgtggagcagggcctctgtccccttctctgcctgggaagtagaggtgcagatgagggtgacgggactggggcgccggggagcccagggcatggccgtgtggtacacccggggcaggggccatgtaggctctgtccttggggggctggcttcgtgggacggcatcgggatcttctttgactctccggcagaggatactcaggacagtcctgccatccgtgtgctggccagcgacgggcacatcccctctgagcagcctggggatggagctagccaagggctgggctcctgtcattgggacttccggaaccggccacaccccttcagagcacggatcacctactgggggcagaggctgcgcatgtccttgaacagtggcctcactcccagtgatccaggtgagttctgtgtggatgtggggcccctgcttttggtccctggaggtttctttggggtctcagcagccaccggcaccctggcagatgatcatgatgtcctgtccttcctgaccttcagcctgagtgagcccagcccagaggttccccctcagcccttcctggagatgcagcagctccgcctggcgaggcagctggaagggctgtgggcaaggctgggcttgggcaccagggaggatgtaactccaaaatcagactctgaagctcaaggagaaggggaaaggctctttgacctggaggagacgctgggcagacaccgccggatcctgcaggctctgcggggtctctccaagcagctggcccaggctgagagacaatggaagaagcagctggggcccccaggccaagccaggcctgacggaggctgggccctggatgcttcctgccagattccatccaccccagggaggggtggccacctctccatgtcactcaataaggactctgccaaggtcggtgccctgctccatggacagtggactctgctccaggccctgcaagagatgagggatgcagctgtccgcatggctgcagaagcccaggtctcctacctgcctgtgggcattgagcatcatttcttagagctggaccacatcctgggcctcctgcaggaggagcttcggggcccggcgaaggcagcagccaaggccccccgcccacctggccagcccccaagggcctcctcgtgcctgcagcctggcatcttcctgttctacctcctcattcagactgtaggcttcttcggctacgtgcacttcaggcaggagctgaacaagagccttcaggagtgtctgtccacaggcagccttcctctgggtcctgcaccacacacccccagggccctggggattctgaggaggcagcctctccctgccagcatgcctgcctgacccacctcagagcctgctttgcatcactgggaagcaggcagtgtcttgggtgggggcttggtcagtatcctctccgtctgggtgcccagctcccacgcacacctgagctttcggcatgctcccacctcgttaaaggtgatttccctctccccaaaaaaaaaaaaaaaaaaaaaaaaaaaaaaaaaaaaaaaaaaaaaaaaaaaaaaaaaaaa

SEQ ID NO: 59295 - DNA, 1852 bp, Homo sapiens
tatctagggagccagcaaagattctgtcctgtctaccattttcccatgaatgacatcataatagaacctcccggtcttattgccttttcttattggtaacaaaagatgacaaactaggtaatttatattaaaaagtttatttagctcatagttctagaggctggaagtccacagtgccggcatctgtgagggccttcttgctgcctcacctcatggcagagggcatcacatgctcagagtgggagcaagggagccagggagagctcacaggcacaagaataacgctgctgtgataataaacccactcctgggacagcaacattcatcccgtcatgagaacagagccctcattcatccattcatctcatcataggggcagaaggattacatttctaacacatgaacttttgggggacacattcaatacctagcactcccaaaatattcactaagagtgagagtaaattgatttaatttcagactgttcttggcagtccataagtagagatttccaagttttacaatagagaattaaaatgattgaaaaatattctaaaaaaaaaaaaacaacctgcagaagaaagctagaaaatcagaagatgaaatattttttaggcataaaatatgcatgcagtttatagacaatggagatgtgctaactcttgaaaacgtgcttcgacatctcaaattgcttaaggcttttgcaacaaaataacttaccagtgtcaggccatggtagaatatgagttcacaatgaatttttatgcctgggtttctgtgacccaagttatgctgaagaatatgagagacaccaccttttaaaaatttttacatagcctgcggccactgcaattcgttaatccctttggaaaattgcttaagcctggcatgttttgtaatgaactttatctcttcactaccaaaagtcgtaaaaaggaacttcagtgaggaaagaaacacaattgataattgaatatttcaaagagatcagcattttagaaaactggctttttggattggctcacagttttcctacttttctgtcctgtcagttgagaagaatacatttcaagagatgctcttggaaaacacgtttgatggagaggttgatttttgtaacctgtatgccgtagtcagaagagccgtcctctggcagatatgtgaaagaactgcctatgaggagcgagaggctacttcgcacacctcgcagctcaggtccccggagacggctttacaggcacacaagcccctctcccaagccatctgccaggagccccatgaggaacacagcacagcgcctgcatcagaagcccatgggtttgcctatcacatgtcttgttttctcctgatccgtggctcacaggctcagtgtgacccaacctcctagatttccccatcagtgctatttgcagtgcccccaagcactttcctccactccagtccctgagcgcatgccaacggccctattttcagccacccctctccatgcctcttgtctgtctctagctgacaagcagattatctcttctgtccactttgtttgccaatgtactttggcaccattgaattccaacacatgaagtaaactgaactgtgtacaacgctgagcacacacgtggtttggagagcagccccttgtcaggatccaaaatgttcccaagccttgttgatatttgggtcactgcagatctctgagtcccccttcctttttaatcttcttcccctcaactcattctcaatttctctctctgaaaccacctgtgaacacacttatgcattcaaatagatgcatactgttcatgcttatatttttctgtaaccgtcatatctaataaatacttatcatccagga

SEQ ID NO: 59296 - DNA, 1852 bp, Homo sapiens
tatctagggagccagcaaagattctgtcctgtctaccattttcccatgaatgacatcataatagaacctccctgtcttattgccttttcttattggtaacaaaagatgacaaactaggtaatttatattaaaaagtttatttagctcatagttctagaggctggaagtccacagtgccggcatctgtgagggccttcttgctgcctcacctcatggcagagggcatcacatgctcagagtgggagcaagggagccagggagagctcacaggcacaagaataacgctgctgtgataataaacccactcctgggacagcaacattcatcccgtcatgagaacagagccctcattcatccattcatctcatcataggggcagaaggattacatttctaacacatgaacttttgggggacacattcaatacctagcactcccaaaatattcactaagagtgagagtaaattgatttaatttcagactgttcttggcagtccataagtagagatttccaagttttacaatagagaattaaaatgattgaaaaatattctaaaaaaaaaaaaacaacctgcagaagaaagctagaaaatcagaagatgaaatattttttaggcataaaatatgcatgcagtttatagacaatggagatgtgctaactcttgaaaacgtgcttcgacatctcaaattgcttaaggcttttgcaacaaaataacttaccagtgtcaggccatggtagaatatgagttcacaatgaatttttatgcctgggtttctgtgacccaagttatgctgaagaatatgagagacaccaccttttaaaaatttttacatagcctgcggccactgcaattcgttaatccctttggaaaattgcttaagcctggcatgttttgtaatgaactttatctcttcactaccaaaagtcgtaaaaaggaacttcagtgaggaaagaaacacaattgataattgaatatttcaaagagatcagcattttagaaaactggctttttggattggctcacagttttcctacttttctgtcctgtcagttgagaagaatacatttcaagagatgctcttggaaaacacgtttgatggagaggttgatttttgtaacctgtatgccgtaatcagaagagccgtcctctggcagatatgtgaaagaactgcccatgaggagcgagaggctacttcgcacacctcgcagctcaggtccccggagacggctttacaggcacacaagcccctctcccaagccatctgccaggagccccatgaggaacacagcacagcgcctgcatcagaagcccatgggtttgcctatcacatgtcttgttttctcctgatccgtggctcacaggctcagtgtgacccaacctcctagatttccccatcagtgctatttgcagtgcccccaagcactttcctccactccagtccctgagcgcatgccaacggccctattttcagccacccctctccatgcctcttgtctgtctctagctgacaagcagattatctcttctgtccactttgtttgccaatgtactttggcaccattgaattccaacacatgaagtaaactgaactgtgtacaacgctgagcacacacgtggtttggagagcagccccttgtcaggatccaaaatgttcccaagccttgttgatatttgggtcactgcagatctctgagtcccccttcctttttaatcttcttcccctcaactcattctcaatttctctctctgaaaccacctgtgaacacacttatgcattcaaatagatgcatactgttcatgcttatatttttctgtaaccgtcatatctaataaatacttatcatccagga

SEQ ID NO: 59297 - DNA, 942 bp, Homo sapiens
atgtctggagcccttgatgccctgcaaatgaaggaggaggatgtccttgcagcaggaaccaacttaggtggcaccaatcttgacttccagatggaatggtacatctgtaaaaggaaaagtgatggcatccacatcataaatctgaagaggacctgggagaagcttctgctgtcagctcgtgccattgttgccattgaaaaccctgctgatgtcagtgtcatatcctccaggaatactggccagagggccatgctgaagtttgttgctgccacaggagacactccaattgctggctgcttcactcctggaactttcactaaccagatccaggcaaccttctgggagccacgggttcttgtggttactgatcccagggctgaccaccagcctctcatggaggcatcttatgttaacctacctaccattgctctgtgtaacacagattctcctttgcgctatgtggacattgccatcccatgcaacaacaagggagctcactcagtgggtttgatgtggtggatgctggcttgcaaagttctgcacatgtgtggcaccatttcctgtgaacacctgtgggaggtaatgcctgatctctacttctacagagatcctgaagagactgaaaaagaaaagcaggctgctgttgaaaaggctgtgaccaaggaggaatttcagggtgaatggactgctctagctcctgagttcactgctactcagcctaaggttgcaggctggtctgaaggagtgcaggcaccctctgtgcctattcagaggttccctacggaagactggagtgctcagcctgccacggaagactggtctgcagctcccactgctcaggccactgaatgggtaggagcaaccactgaatggtcttaagctgttcttgcacgggctcttaagcaacatggaaataaggttgatggaaaataaacatcagtt

SEQ ID NO: 59298 - DNA, 1071 bp, Homo sapiens
ctgtaattgcacagattgttcctcttacaagagaaatatccagagctctaagaaaacaactgatgaaaacgacatgcgtgacatttggtgctgaagacccaggtcagagagactcctttgggggaccagtccgctgtccttgccctcactctgtgaggagacccacctacgacctcgggtcctcagaccaaccagctcaaggaacatctcaccaatttcaaatcgggaccccactggaaaatggactgtccaactcacccggcagccactcccagagcccctggaactctggcccaaggctctctgactgactccttcccagatcttctcggctcagcagctgaagactgacactgcttgattgcctgggaagcctataggaccatcacagacactttggataactcttacagtgaaggacaaaaaagcgccactgcagggaggaatgccagggtcccatagagggagaccgacagtgaagtggagcctgccatgaattcaccaaaggccattctccctttcttccagaagaacagcatttagctgggcctatggctacctacctaaagactgcacctcttagtcacccttgtggccaggtgtggccacgtgacagtggaatgtaagtggaagtgatgtatgcacttgggttcattggtttaaaaaaaaatatgaccgccctccatttccactctttgtcttatctgtgaatgggaacatggctgtgtctgcagcccgactttgtgcagcaaaggacaaggccctaggggaaggtggagaaacaagatggaacaacttggacccaacaacttggatccctatgtggccatgtggagtcatctcacccacctgggccactcaccccgaagactgttgtgtgagggtgaaataaacttctgtatcactagcccctgcatttcagaaattctttgttatggcagttttgcctttatcctaacacagacagcaaagtatcttctgtggccccatgactaatttcgttgtttaaactcattataaaaactatataaataaaatattaaaaatcaaataaaatagcaagataacact

SEQ ID NO: 59299 - DNA, 2779 bp, Homo sapiens
cagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgacacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctggcactgctccttgccatgcttggcggccgctgctgcccggctgggggtcccgagtcgcacacgccctgcaagccctggccaccgatccggagggaacgccctgggctgcggtccccgaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggccccgcttcttcatcgcacttgcggccccggctgcccggggcctgcgagtttccagccagggcccgggactctggcgcggtccggccgcgaggaaggaaggcgtggcccgggtgggggtagcggcaggcctgcggctcaggccatggggcaggggcagaaaaacgaccccggcgctgtccgggcatccagctcggttcccgctgcagccaggagactcccgggagcgctctaggaaccacagagccctggaactcacctggcagcctcgcggcgctaaagccggcggagcctgagacagcgcgcggcgaggcggtcacgctccacccccgcgtggcggcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacgtcccggttgctgagcggagtcaggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcacaggtgcccgccccacctgtccctcggtcaccccaaccctgtttcctcgacccccagcactcctccaggcctagttcgcttcagaggcgcaagacccggaaaacaaggaagaagcgagctcagcctcaatccccgtccccaccccactttcgggaccgctaagctggagaattgaagggggcggaccccggattaaagccgctcccttcccagcctcgccccgctttcctaatgtccgtgatgatttcgttattggcagggaagagccagactccctgcgctcccaagacggggcgattgggagggggttctggagctcatgcctggggtcggcccggcgggggtgaccccgcgccctcgccggtgcaaggagaacagctggttcccgccggggcagggaagcgtggacggtgtgggctcaggcgcctggcaggcacacggggcctctaaagcttggtcactgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagcggtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggtagcgctgggagcggggcctcggaggctgggcctggggacccaaggttgggcggggcgcaggaggtgggctcagggttctccagagaatccccatgagctgacccgcagggcggccgtgccagtaggcaccgggcccccgcggtgacctgcggccccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttccaaaacaaacaaacaaaaaaaaaaaaaaaaaa

SEQ ID NO: 59300 - DNA, 2086 bp, Homo sapiens
acttcattttcaagttatattattttattaatgtagtttggtgatcttacagcagagctggaagctgtatcttcaaaatatgtctgtttgactcaaaacaatcaaggtattcaacaggagttattatgtatgaaaaaatacaacaggaatgtaaaaatcttgaggaggctaaaaagatgttggaaaaagtaatattaaatcttaaaaaacgtatggaaagtacacattggtgaagacacattggtgaagtacaaaaatataaattggatctagaagaaagggcaatgcaggcaatggaaaaattagtacaaatccctttacagtaatgattctcagtgtggagtcatttgattattaagacccattgacatgagattacatcctctgcctataaaaatcctggaagaaaacctaggaaatattcacctggacattgcacttggcaatgaatttatggatagaaaatgcagttgaaagatatttcataaaggaagaaaaagtaagaatacagctttaaccgtttattgtggtggagtctttaagattttctctaccttgagtgcgccaggcgcggggagcctaggacctggagcgagagccgcctacctgcagccgccgcccacggcacggcagccaccgtggcgctcctgctgcgcttcgtgctcctgtgcagagtcgcggatttcatcagaggttggagtatcactactcctgagcagatgattgaaaaagccaaaggggaaactgcctatctgccatgcaaatttacgcttagtcctgaagaccagggaccactggacatcgagtggctgatatcaccagctgataatcagaaggtggatcaagtgattattttatattctggagacaaaaattatgatgactactatccagatctgaaaggccgagtacattttaagagtaatgatctcaaatctggtgatgcatcaataaatgtaacgaattttcagctgtcagatattggcacagatcagtgcaaagtgaaaagagctcctggtgttgcaaataggaagattcagctggtagttcttggtaagccttcaggtacaagatgttacgttgatggatcagaagaaattggaagtgactttaaattaaaatgtgaaccaaaagaaggttcacttccattacagtatgagtggcaaaaattgtctgactcacagaaaatgcccacttcatggttagcagaaatgacttcatctgttatatctgtaaaaatgcttcttctgagtactctgggacatacagctgtacatcagaaacagagtgggctctgatcagtgcctgttgcgtgtaaacgttgtccctccttcaaataaagctggactaattgcaggagccattataggaactttgcttgctctagtgctcattggtcttatcatcttttgctgtcgtaaaaagcgcagagaagaaaaatatgaaaaggaagttcatcacgatatcaaggaagatgtgccgcctccaaagagccacacgtccactgccagaagctacataggcagtaatcattcatccctgggatccatatctccttccaacatggaaggatattccaagactcagtataaacaagtaccaagtgaagactttgaacgcactcctcagagtccgactctcccacctgctaaggtagctgcccctaatctaagtcgaatgggcgcgattcctgtgatgattcccgcacagagcaaggatgggtctatagtatagagcctccatacatctcatctgtgctctccgtgttcctttcctttttttgatatatgaaaacctattctggtctaaattttgttactagcctcagaatgtatcagaaaataagttaatcaggagctgtaaggaatatatttttaaaaatttttgtttggttatatcgaaatagttacgggcattaaagttagtaaagacaagtttaccatctgaaaaggctggattttctttaagaggctgattataaaggtttctaaatgttatcagtacctaagtaagatgtagcactttgagtatgaaatcataggtgaagaaatcggtgaacttacttgcataccaagttgatacttga

SEQ ID NO: 59301 - DNA, 942 bp, Homo sapiens
atgtctggagcccttgatgccctgcaaatgaaggaggaggatgtccttgcagcaggaaccaacttaggtggcaccaatcttgacttccagatggaatggtacatctgtaaaaggaaaagtgatggcatccacatcataaatctgaagaggacctgggagaagcttctgctgtcagctcgtgccattgttgccattgaaaaccctgctgatgtcagtgtcacatcctccaggaatactggccagagggccatgctgaagtttgttgctgccacaggagacactccaattgctggctgcttcactcctggaactttcactaaccagatccaggcaaccttctgggagccacgggttcttgtggttactgatcccagggctgaccaccagcctctcatggaggcatcttatgttaacctacctaccattgctctgtgtaacacagattctcctttgcgctatgtggacattgccatcccatgcaacaacaagggagctcactcagtgggtttgatgtggtggatgctggcttgcaaagttctgcacatgtgtggcaccatttcctgtgaacacctgtgggaggtaatgcctgatctctacttctacagagatcctgaagagactgaaaaagaaaagcaggctgctgttgaaaaggctgtgaccaaggaggaatttcagggtgaatggactgctctagctcctgagttcactgctactcagcctaaggttgcaggctggtctgaaggagtgcaggcaccctctgtgcctattcagaggttccctacggaagactggagtgctcagcctgccacggaagactggtctgcagctcccactgctcaggccactgaatgggtaggagcaaccactgaatggtcttaagctgttcttgcacgggctcttaagcaacatggaaataaggttgatggaaaataaacatcagtt

SEQ ID NO: 59302 - DNA, 1071 bp, Homo sapiens
ctgtaattgcacagattgttcctcttacaagagaaatatccagagctctaagaaaacaactgatgaaaacgacatgcgtgacatttggtgctgaagacccaggtcagagagactcctttgggggaccagtccgctgtccttgccctcactctgtgaggagacccacctacgacctcgggtcctcagaccaaccagctcaaggaacatctcaccaatttcaaatcgggaccccactggaaaatggactgtccaactcacccggcagccactcccagagcccctggaactctggcccaaggctctctgactgactccttcccagatcttctcggctcagcagctgaagactgacactgcttgattgcctgggaagcctataggaccatcacagacactttggataactcttacagtgaaggacaaaaaagcgccatcgcagggaggaatgccagggtcccatagagggagaccgacagtgaagtggagcctgccatgaattcaccaaaggccattctccctttcttccagaagaacagcatttagctgggcctatggctacctacctaaagactgcacctcttagtcacccttgtggccaggtgtggccatgtgacagtggaatgtaagtggaagtgatgtatgcacttgggttcattggtttaaaaaaaaatatgaccgccctccatttccactctttgtcttatctgtcaatgggaacatggctgtgtctgcagcccgactttgtgcagcaaaggacaaggccctaggggaaggtggagaaacaagatggaacaacttggacccaacaacttggatccctatgtggccatgtggagtcatctcacccacctgggccactcaccccgaagactgttgtgtgagggtgaaataaacttctgtatcactagcccctgcatttcagaaattctttgttatggcagttttgcctttatcctaacacagacagcaaagtatcttctgtggccccatgactaatttcgttgtttaaactcattataaaaactatataaataaaatattaaaaatcaaataaaatagcaagataacact

SEQ ID NO: 59303 - DNA, 1221 bp, Homo sapiens
atgtggctgctatctcagtgtatatggggtgtaaacgtcctacttcggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttctgtctctaattagttacctcagtttgattgaagccagtggagttgtgcttttcctctacttctacttcctctcccccacctttttctgcccagtgtaggtgtattcttaaattcagacgggaagattctttcacatatcactcagttacctcccaatctgggggagtttttcttacaacttgataccagataccattaattttacattcctgaataaaggcctagtacccacgcatatttcaaccatgcatatatcaagttcaaccgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagctaaacctaaataagttatcctgttccctaggaccttctctgtaaatagtgaattttagacgagtagtctgtcctaaatcttaaatagaaaaaaaaactaaagcgatttgcttaagccattgtacattataaagagctgttttgttttgctttgctttgctttgttttgtttttttaaagctgcattcagagccacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatgaccattcttcctttaattttttgttatgcccacatattgtatgtaaaaatataaataaatagtacttaaagtataga

SEQ ID NO: 59304 - DNA, 2413 bp, Homo sapiens
aaactgataccgggttggagaggcaggaaaagcggaagagggagcgaaaaccaacgtgttcggtgacagaccccagcgccgactgagcctctaaagcgacttcagctctgccccaccaacaccaccgcgcgcccgggaacagccgctccgggaagaaacctgaggggactgcggggggcacgagggacagctgagggaagggaggacgcgagagaaacagcgcgagcacgctgagggccgggggttgccaggagaggggcccgcggacccgcagagcggaggaaggtccgggagaaaaggggcgggacggaggagaatccgggatcgcctggcagaaaaagagaagggagtttctgaatcctgggaagaggaggcgtgggtagggacgcttagcccgagatccgacagcagggaaccggagcgctccgggggaggggcttaatgctggggaagggatgtcttaaaagaggagaagctttaaattagacgatcggagaaggctgagggaattgctatgaaggggcgggagctgaagtgtagaggactcctttagacagcagaaagggaaagccgttgagaagttcccttcaaactccacctgcctcctctccaattcaaactccactcccttctccaaaagttaaaaggaaagccaagtttgccacgctcccctgttcctactcaataaatacttcttctactccgccaccgggaaaacagaaaaaaaaactaatttccttcccaatattaggacttagaaaagctctaggtcccgcaatttgaattttagcctaggggaatcaaaatagtaggagcattactcttgtttcctttttcaaaatcccacacctcatccttcctgcgacgccatgtctaccaacatttgtagtttcaaggacaggtgcgtgtccatcctgtgttgcaaattctgtaaacaagtgctcagctctaggggaatgaaggctgttttgctggctgatactgaaatagaccttttctctacagacatccctcctaccaacgcagtggacttcactggaagatgctatttcaccaaaatctgcaaatgtaaactgaaggacatcgcatgtttaaaatgtgggaacattgtaggttatcatgtgattgttccatgtagttcctgtcttctttcctgcaacaacggacacttctggatgtttcacagccaggcagtttatgatattaacagactagactccacaggtgtaaacgtcctactttggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttccgtctctaattagttacctcagtttgattgaagccagtgaagttgtgcttttcctctacttctacttcctctccccgacctttttctgcccagtgtaggtgtattcttaaattcagacaggggaagattctttcacatatcactcagttacctcccaatctgggggagtttttcttacaacttgataccagataccattaattttacattcctgaataaaggcctagtacccacgcatatttcaaccatgcatatatcaagttcaaccgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagctaaacctaaataagttatcctgttccctaggaccttctctgtaaatagtgaattttagacgagtagtctgtcctaaatcttaaatagaaaaaaaactaaagcgatttgcttaagccattgtacattataaagagctgttttgttttgctttgctttgctttgttttgtttttttaaagctgcattcagagccacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatgaccattcttcctttaattttttgttatgcccacatattgtatgtaaaaatataaataaatagtacttaaagt

SEQ ID NO: 59305 - DNA, 1608 bp, Homo sapiens
tgggacccgggctgtccgccagggctgggagacactggaggaggccggccgatgattacgcgcgatgccaacgacgactgccctacggtggaccgcggctgcccgtgtgcggaggaaagggagaggcggctgggtgccggctgcgctgcggtccgtgagccaggacggagtcccaggctgtacagtgatgggcggagagactcgcagtcctgagaacgcagtggacttcactggaagatgctatttcaccaaaatctgcaaatgtaaactgaaggacatcgcatgtttaaaatgtgggaacattgtaggttatcatgtgattgttccatgtagttcctgtcttctttcctgcaacaacggacacttctggatgtttcacagccaggcagtttatgatattaacagactagactccacaggtgtaaacgtcctactttggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttccgtctctaattagttacctcagtttgattgaagccagtgaagttgtgcttttcctctacttctacttcctctccccgacctttttctgcccagtgtaggtgtattcttaaattcagacaggggaagattctttcacatatcactcagttacctcccaatctgggggagtttttcttacaacttgataccagataccattaattttacattcctgaataaaggcctagtacccacgcatatttcaaccatgcatatatcaagttcaaccgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagctaaacctaaataagttatcctgttccctaggaccttctctgtaaatagtgaattttagacgagtagtctgtcctaaatcttaaatagaaaaaaaactaaagcgatttgcttaagccattgtacattataaagagctgttttgttttgctttgctttgctttgttttgtttttttaaagctgcattcagagccacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatgaccattcttcctttaattttttgttatgcccacatattgtatgtaaaaatataaataaatagtacttaaagt

SEQ ID NO: 59306 - DNA, 2293 bp, Homo sapiens
aaactgataccgggttggagaggcaggaaaagcggaagagggagcgaaaaccaacgtgttcggtgacagaccccagcgccgactgagcctctaaagcgacttcagctctgccccaccaacaccaccgcgcgcccgggaacagccgctccgggaagaaacctgaggggactgcggggggcacgagggacagctgagggaagggaggacgcgagagaaacagcgcgagcacgctgagggccgggggttgccaggagaggggcccgcggacccgcagagcggaggaaggtccgggagaaaaggggcgggacggaggagaatccgggatcgcctggcagaaaaagagaagggagtttctgaatcctgggaagaggaggcgtgggtagggacgcttagcccgagatccgacagcagggaaccggagcgctccgggggaggggcttaatgctggggaagggatgtcttaaaagaggagaagctttaaattagacgatcggagaaggctgagggaattgctatgaaggggcgggagctgaagtgtagaggactcctttagacagcagaaagggaaagccgttgagaagttcccttcaaactccacctgcctcctctccaattcaaactccactcccttctccaaaagttaaaaggaaagccaagtttgccacgctcccctgttcctactcaataaatacttcttctactccgccaccgggaaaacagaaaaaaaaactaatttccttcccaatattaggacttagaaaagctctaggtcccgcaatttgaattttagcctaggggaatcaaaatagtaggagcattactcttgtttcctttttcaaaatcccacacctcatccttcctgcgacgccatgtctaccaacatttgtagtttcaaggacagcgcagtggacttcactggaagatgctatttcaccaaaatctgcaaatgtaaactgaaggacatcgcatgtttaaaatgtgggaacattgtaggttatcatgtgattgttccatgtagttcctgtcttctttcctgcaacaacggacacttctggatgtttcacagccaggcagtttatgatattaacagactagactccacaggtgtaaacgtcctactttggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttccgtctctaattagttacctcagtttgattgaagccagtgaagttgtgcttttcctctacttctacttcctctccccgacctttttctgcccagtgtaggtgtattcttaaattcagacaggggaagattctttcacatatcactcagttacctcccaatctgggggagtttttcttacaacttgataccagataccattaattttacattcctgaataaaggcctagtacccacgcatatttcaaccatgcatatatcaagttcaaccgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagctaaacctaaataagttatcctgttccctaggaccttctctgtaaatagtgaattttagacgagtagtctgtcctaaatcttaaatagaaaaaaaactaaagcgatttgcttaagccattgtacattataaagagctgttttgttttgctttgctttgctttgttttgtttttttaaagctgcattcagagccacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatgaccattcttcctttaattttttgttatgcccacatattgtatgtaaaaatataaataaatagtacttaaagt

SEQ ID NO: 59307 - DNA, 1376 bp, Homo sapiens
atgaaaagacttatctggctagttattacatggtatctagtaacatttactttcttttctagtgggaacattgtagtttatcatgtgattgttccatgtagttcctgtcttctttcctgcaacaacagacacttctggatgtttcacagccaggcagtttatgatattaacagactagactccacaggtgtaaacgtcctacttcggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttctgtctctaattagttacctcagtttgattgaagccagtggagttgtgcttttcctctacttctacttcctctcccccacctttttctgcccagtgtaggtgtattcttaaattcagacgggaagattctttcacatatcactcagttacctcccaatctgggggagtttttcttacaacttgataccagataccattaattttacattcctgaataaaggcctagtacccacgcatatttcaaccatgcatatatcaagttcaaccgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagctaaacctaaataagttatcctgttccctaggaccttctctgtaaatagtgaattttagacgagtagtctgtcctaaatcttaaatagaaaaaaaaactaaagcgatttgcttaagccattgtacattataaagagctgttttgttttgctttgctttgctttgttttgttttttttaaagctgcattcagagccacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatgaccattcttcctttaattttttgttatgcccacatattgtatgtaaaaatataaataaatggtacttaaagt

SEQ ID NO: 59308 - DNA, 2412 bp, Homo sapiens
aaactgataccgggttggagaggcaggaaaagcggaagagggagcgaaaaccaacgtgttcggtgacagaccccagcgccgactgagcctctaaagcgacttcagctctgccccaccaacaccaccgcgcgcccgggaacagccgctccgggaagaaacctgaggggactgcggggggcacgagggacagctgagggaagggaggacgcgagagaaacagcgcaagcacgctgagggccgggggttgccaggagaggggcccgcggacccgcagagcggaggaaggtccgggagaaaaggggcgggacggaggagaatccgggatcgcctggcagaaaaagagaagggagtttctgaatcctgggaagaggaggcgtgggtagggatgcttagcccgagatccgacagcagggaaccggagcgctccgggggaggggcttaatgctggggaagggatgtcttaaaagaggagaagctttaaattagacgatcggagaaggctgagggaattgctatgaaggggcgggagctgaagtgtagaggactcctttagacagcagaaagggaaagccgttgagaagttcccttcaaactccacctgcctcctctccaattcaaactccactcccttctccaaaagttaaaaggaaagccaagtttgccacgctcccctgttcctactcaataaatacttcttctactccgccaccgggaaaacagaaaaaaaaaactaatttccttcccaatattaggacttagaaaagctctaggtcccgcaacttgaattttagcctaggggaatcaaaatagtaggagcattactcttgtttcctttttcaaaatcccacacctcatccttcctgcgacgccatgtctaccaacatttgtagtttcaaggacaggtgcgtgtccatcctgtgttgcaaattctgtaaacaagtgctcagctctaggggaatgaaggctgttttgctggctgatactgaaatagaccttttctctacagacatccctcctaccaacgcagtggacttcactggaagatgctatttcaccaaaatctgcaaatgtaaactgaaggacatcgcatgtttaaaatgtgggaacattgtaggttatcatgtgattgttccatgtagttcctgtcttccttcctgcaacaacggacacttctggatgtttcacagccaggcagtttatgatattaacagactagactccacaggtgtaaacatcctactttggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttccgtctctaattagttacctcagtttgattgaagccagtggagttgtgcttttcctctacttctacttcctctcccccacctttttctgcccagtgtaggtgtattcttaaattcagacgggaagattctttcacatatcactcagttacctcccaatctgggggagtttttcttacaacttgataccagataccattaattttacattcctgaataaaggcctagtacccacgcatatttcaaccatgcatatatcaagttcaactgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagctaaacctaaataagttatcctgttccctaggaccttctctgtaaatagtgaattttagacgagtagtctgtcctaaatcttaaatagaaaaaaaactaaagcgatttgcttaagccattgtacattataaagagctgttttgttttgctttgctttgctttgttttgtttttttaaagctgcattcagagccacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatgaccattcttcctttaattttttgttatgcccacatattgtatgtaaaaatataaataaatagtacttaaagt

SEQ ID NO: 59309 - DNA, 1606 bp, Homo sapiens
tgggacccgggctgtccgccagggctgggagacactggaggaggccggccgatgattacgcgcgatgccaacgacgactgccctacggtggaccgcggctgcccgtgtgcggaggaaagggagaggcggctgggtgctggctgcgctgcggtccgtgagccaggacggagtcccaggctgtacagtgatgggcggagagactcgcagtcctgagaacgcagtggacttcactggaagatgctatttcaccaaaatctgcaaatgtaaactgaaggacatcgcatgtttaaaatgtgggaacattgtaggttatcatgtgattgttccatgtagttcctgtcttccttcctgcaacaacggacacttctggatgtttcacagccaggcagtttatgatattaacagactagactccacaggtgtaaacatcctactttggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttccgtctctaattagttacctcagtttgattgaagccagtggagttgtgcttttcctctacttctacttcctctcccccacctttttctgcccagtgtaggtgtattcttaaattcagacgggaagattctttcacatatcactcagttacctcccaatctgggggagtttttcttacaacttgataccagataccattaattttacattcctgaataaaggcctagtacccacgcatatttcaaccatgcatatatcaagttcaactgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagctaaacctaaataagttatcctgttccctaggaccttctctgtaaatagtgaattttagacgagtagtctgtcctaaatcttaaatagaaaaaaaactaaagcgatttgcttaagccattgtacattataaagagctgttttgttttgctttgctttgctttgttttgtttttttaaagctgcattcagagccacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatgaccattcttcctttaattttttgttatgcccacatattgtatgtaaaaatataaataaatagtacttaaagt

SEQ ID NO: 59310 - DNA, 2292 bp, Homo sapiens
aaactgataccgggttggagaggcaggaaaagcggaagagggagcgaaaaccaacgtgttcggtgacagaccccagcgccgactgagcctctaaagcgacttcagctctgccccaccaacaccaccgcgcgcccgggaacagccgctccgggaagaaacctgaggggactgcggggggcacgagggacagctgagggaagggaggacgcgagagaaacagcgcaagcacgctgagggccgggggttgccaggagaggggcccgcggacccgcagagcggaggaaggtccgggagaaaaggggcgggacggaggagaatccgggatcgcctggcagaaaaagagaagggagtttctgaatcctgggaagaggaggcgtgggtagggatgcttagcccgagatccgacagcagggaaccggagcgctccgggggaggggcttaatgctggggaagggatgtcttaaaagaggagaagctttaaattagacgatcggagaaggctgagggaattgctatgaaggggcgggagctgaagtgtagaggactcctttagacagcagaaagggaaagccgttgagaagttcccttcaaactccacctgcctcctctccaattcaaactccactcccttctccaaaagttaaaaggaaagccaagtttgccacgctcccctgttcctactcaataaatacttcttctactccgccaccgggaaaacagaaaaaaaaaactaatttccttcccaatattaggacttagaaaagctctaggtcccgcaacttgaattttagcctaggggaatcaaaatagtaggagcattactcttgtttcctttttcaaaatcccacacctcatccttcctgcgacgccatgtctaccaacatttgtagtttcaaggacagcgcagtggacttcactggaagatgctatttcaccaaaatctgcaaatgtaaactgaaggacatcgcatgtttaaaatgtgggaacattgtaggttatcatgtgattgttccatgtagttcctgtcttccttcctgcaacaacggacacttctggatgtttcacagccaggcagtttatgatattaacagactagactccacaggtgtaaacatcctactttggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttccgtctctaattagttacctcagtttgattgaagccagtggagttgtgcttttcctctacttctacttcctctcccccacctttttctgcccagtgtaggtgtattcttaaattcagacgggaagattctttcacatatcactcagttacctcccaatctgggggagtttttcttacaacttgataccagataccattaattttacattcctgaataaaggcctagtacccacgcatatttcaaccatgcatatatcaagttcaactgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagctaaacctaaataagttatcctgttccctaggaccttctctgtaaatagtgaattttagacgagtagtctgtcctaaatcttaaatagaaaaaaaactaaagcgatttgcttaagccattgtacattataaagagctgttttgttttgctttgctttgctttgttttgtttttttaaagctgcattcagagccacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatgaccattcttcctttaattttttgttatgcccacatattgtatgtaaaaatataaataaatagtacttaaagt

SEQ ID NO: 59311 - DNA, 2496 bp, Homo sapiens
gcagcccgggctcaactcaaacaatgcacttccctgaaagctccacagcttcaggtcgtagtgaagaatcaagaacttcccacagcagcacaacacacacaatatcttcacctcctagcaccacatctgcccttgttgaagaacctaccagctaccacagcagcccgggctcaattgcaacaacacactttcctgagagctccacaacctccggccgtagtgaggaatcaacagcatcccacagcagcccagatacaaatggaatcacacccttacctgcccattttactacctcaggccgcattgcagaatctaccaccttctatatctctccaggctcaatggaaacaacattagccagcactgccacaacaccaggcctcagtgcaaaatctaccatcctttacagtagctccagatcaccagaccaaacactctcacctgccagcatgacaagctccagcatcagtggagaacccaccagcttgtatagccaagcagagtcaacacacacaacagcgttccctgccagcaccaccacctcaggcctcagtcaggaatcaacaactttccacagtaagccaggctcaactgagacaacactgtcccctggcagcatcacaacttcatcttttgctcaagaatttaccacccctcatagccaaccaggctcagctctgtcaacagtgtcacctgccagcaccacagtgccaggccttagtgaggaatctaccaccttctacagcagcccaggctcaactgaaaccacagcgttttctcacagcaacacaatgtccattcatagtcaacaatctacacccttccctgacagcccaggcttcactcacacagtgttacctgccaccctcacaaccacagacattggtcaggaatcaacagccttccacagcagctcagacgcaactggaacaacacccttacctgcccgctccacagcctcagaccttgttggagaacctacaactttctacatcagcccatcccctacttacacaacactctttcctgcgagttccagcacatcaggcctcactgaggaatctaccaccttccacaccagtccaagcttcacttctacaattgtgtctactgaaagcctggaaaccttagcaccagggttgtgccaggaaggacaaatttggaatggaaaacaatgcgtctgtccccaaggctacgttggttaccagtgcttgtcccctctggaatccttccctgtagaaaccccggaaaaactcaacgccactttaggtatgacagtgaaagtgacttacagaaatttcacagaaaagatgaatgacgcatcctcccaggaataccagaacttcagtaccctcttcaagaatcggatggatgtcgttttgaagggcgacaatcttcctcagtatagaggggtgaacattcggagattgctcaacggtagcatcgtggtcaagaacgatgtcatcctggaggcagactacactttagagtatgaggaactgtttgaaaacctggcagagattgtaaaggccaagattatgaatgaaactagaacaactcttcttgatcctgattcctgcagaaaggccatactgtgctatagtgaagaggacactttcgtggattcatcggtgactccgggctttgacttccaggagcaatgcacccagaaggctgccgaaggatatacccagttctactatgtggatgtcttggatgggaagctggcctgtgtgaacaagtgcaccaaaggaacgaagtcgcaaatgaactgtaacctgggcacatgtcagctgcaacgcagtggcccccgctgcctgtgcccaaatacgaacacacactggtactggggagagacctgtgaattcaacatcgccaagagcctcgtgtatgggatcgtgggggctgtgatggcggtgctgctgctcgcattgatcatcctaatcatcttattcagcctatcccagagaaaacggcacagggaacagtatgatgtgcctcaagagtggcgaaaggaaggcacccctggcatcttccagaagacggccatctgggaagaccagaatctgagggagagcagattcggccttgagaacgcctacaacaacttccggcccaccctggagactgttgactctggcacagagctccacatccagaggccggagatggtagcatccactgtgtgagccaacgggggcctcccaccctcatctagctctgttcaggagagctgcaaacacagagcccaccacaagcctccggggcgggtcaagaggagaccgaagtcaggccctgaagccggtcctgctctgagctgacagacttggccagtcccctgcctgtgctcctgctggggaaggctgggggctgtaagcctctccatccgggagcttccagactcccagaagcctcggcacccctgtctcctcctgggtggctccccactctggaatttccctaccaataaaagcaaatctgaaagctcagaatgag

SEQ ID NO: 59312 - DNA, 2496 bp, Homo sapiens; identical to SEQ ID NO: 59311

SEQ ID NO: 59313 - DNA, 2958 bp, Homo sapiens
gtacttgttggagaacctacaatgtcacccatcagttcaggctcaacggaaacaacagcgttacctggcagtaccacaacagcaggcctgagtgagaaatctaccaccttctacagtagccccagatcaccggacacaacactctcacctgccagcacgacaagctcaggcgtcagtgaagaatccaccacctcccacagccgaccaggctcaacgcacacaacagcattccctggcagtaccaccatgccaggcgtcagtcaggaatctacagcttcccacagcagcccaggctccacagacacaacactgtcccctggcagtaccacagcatcatcccttggtccagaatctactaccttccacagcggcccaggctccactgaaacaacactcttacctgacaacaccacagcctcaggcctccttgaagcatctacgcccgtccacagcagcactggatcgccacacacaacactgtcccctgccggctctacaacccgtcagggagaatctaccaccttccagagctggccaaactcgaaggacactacccctgcacctcctactaccacatcagcctttgttgagctatctacaacctcccacggcagcccgagctcaactccaacaacccacttttctgccagctccacaaccttgggccgtagtgaggaatcgacaacagtccacagcagcccagttgcaactgcaacaacaccctcgcctgcccgctccacaacctcaggcctcgttgaagaatctacggcctaccacagcagcccgggctcaactcaaacaatgcacttccctgaaagctccacagcttcaggtcgtagtgaagaatcaagaacttcccacagcagcacaacacacacaatatcttcacctcctagcaccacatctgcccttgttgaagaacctaccagctaccacagcagcccgggctcaattgcaacaacacactttcctgagagctccacaacctccggccgtagtgaggaatcaacagcatcccacagcagcccagatacaaatggaatcacacccttacctgcccattttactacctcaggccgcattgcagaatctaccaccttctatatctctccaggctcaatggaaacaacattagccagcactaccacaacaccaggcctcagtgcaaaatctaccatcctttacagtagctccagatcaccagaccaaacactctcacctgccagcatgacaagctccagcatcagtggagaacccaccagcttgtatagccaagcagagtcaacacacacaacagcgttccctgccagcaccaccacctcaggcctcagtcaggaatcaacaactttccacagtaagccaggctcaactgagacaacactgtcccctggcagcatcacaacttcatcttttgctcaagaatttaccacccctcatagccaaccaggctcagctctgtcaacagtgtcacctgccagcaccacagtgccaggccttagtgaggaatctaccaccttctacagcagcccaggctcaactgaaaccacagcgttttctcacagcaacacaatgtccattcatagtcaacaatctacacccttccctgacagcccaggcttcactcacacagtgttacctgccaccctcacaaccacagacattggtcaggaatcaacagccttccacagcagctcagacgcaactggaacaacacccttacctgcccgctccacagcctcagaccttgttggagaacctacaactttctacatcagcccatcccctacttacacaacactctttcctgcgagttccagcacatcaggcctcactgaggaatctaccaccttccacaccagtccaagcttcacttctacaattgtgtctactgaaagcctggaaaccttagcaccagggttgtgccaggaaggacaaatttggaatggaaaacaatgcgtctgtccccaaggctacgttggttaccagtgcttgtcccctctggaatccttccctgtagaaaccccggaaaaactcaacgccactttaggtatgacagtgaaagtgacttacagaaatttcacagaaaagatgaatgacgcatcctcccaggaataccagaacttcagtaccctcttcaagaatcggatggatgtcgttttgaagggcgacaatcttcctcagtatagaggggtgaacattcggagattgctcaacggtagcatcgtggtcaagaacgatgtcatcctggaggcagactacactttagagtatgaggaactgtttgaaaacctggcagagattgtaaaggccaagattatgaatgaaactagaacaactcttcttgatcctgattcctgcagaaaggccatactgtgctatagtgaagaggacactttcgtggattcatcggtgactccgggctttgacttccaggagcaatgcacccagaaggctgccgaaggatatacccagttctactatgtggatgtcttggatgggaagctggcctgtgtgaacaagtgcaccaaaggaacgaagtcgcaaatgaactgtaacctgggcacatgtcagctgcaacgcagtggcccccgctgcctgtgcccaaatacgaacacacactggtactggggagagacctgtgaattcaacatcgccaagagcctcgtgtatgggatcgtgggggctgtgatggcggtgctgctgctcgcattgatcatcctaatcatcttattcagcctatcccagagaaaacggcacagggaacagtatgatgtgcctcaagagtggcgaaaggaaggcacccctggcatcttccagaagacggccatctgggaagaccagaatctgagggagagcagattcggccttgagaacgcctacaacaacttccggcccaccctggagactgttgactctggcacagaggtgactcagctgcgagctgcccccaccccctga

SEQ ID NO: 59314 - DNA, 3695 bp, Homo sapiens
gccccgtcccggcctcgcgcacctgctcaggccatgatgagcttcggcggcgcggacgcgctgctgggcgccccgttcgcgccgctgcatggcggcggcagcctccactacgcgctagcccgaaagggtggcgcaggcgggacgcgctccgccgctggctcctccagcggcttccactcgtggacacggacgtccgtgagctccgtgtccgcctcgcccagccgcttccgtggcgcaggcgccgcctcaagcaccgactcgctggacacgctgagcaacgggccggagggctgcatggtggcggtggccacctcacgcagtgagaaggagcagctgcaggcgctgaacgaccgcttcgccgggtacatcgacaaggtgcggcagctggaggcgcacaaccgcagcctggagggcgaggctgcggcgctgcggcagcagcaggcgggccgctccgctatgggcgagctgtacgagcgcgaggtccgcgagatgcgcggcgcggtgctgcgcctgggcgcggcgcgcggtcagctacgcctggagcaggagcacctgctcgaggacatcgcgcacgtgcgccagcgcctagacgacgaggcccggcagcgagaggaggccgaggcggcggcccgcgcgctggcgcgcttcgcgcaggaggccgaggcggcgcgcgtggacctgcagaagaaggcgcaggcgctgcaggaggagtgcggctacctgcggcgccaccaccaggaagaggtgggcgagctgctcggccagatccagggctccggcgccgcgcaggcgcagatgcaggccgagacgcgcgacgccctgaagtgcgacgtgacgtcggcgctgcgcgagattcgcgcgcagcttgaaggccacgcggtgcagagcacgctgcagtccgaggagtggttccgagtgaggctggaccgactgtcggaggcagccaaggtgaacacagacgctatgcgctcagcgcaggaggagataactgagtaccggcgtcagctgcaggccaggaccacagagctggaggcactgaaaagcaccaaggactcactggagaggcagcgctctgagctggaggaccgtcatcaggccgacattgcctcctaccaggaagccattcagcagctggacgctgagctgaggaacaccaagtgggagatggccgcccagctgcgagaataccaggacctgctcaatgtcaagatggctctggatatagagatagccgcttacagaaaactcctggaaggtgaagagtgtcggattggctttggcccaattcctttctcgcttccagaaggactccccaaaattccctctgtgtccactcacataaaggtgaaaagcgaagagaagatcaaagtggtggagaagtctgagaaagaaactgtgattgtggaggaacagacagaggagacccaagtgactgaagaagtgactgaagaagaggagaaagaggccaaagaggaggagggcaaggaggaagaagggggtgaagaagaggaggcagaagggggagaagaagaaacaaagtctcccccagcagaagaggctgcatccccagagaaggaagccaagtcaccagtaaaggaagaggcaaagtcaccggctgaggccaagtccccagagaaggaggaagcaaaatccccagccgaagtcaagtcccctgagaaggccaagtctccagcaaaggaagaggcaaagtcaccgcctgaggccaagtccccagagaaggaggaagcaaaatctccagctgaggtcaagtcccccgagaaggccaagtccccagcaaaggaagaggcaaagtcaccggctgaggccaagtctccagagaaggccaagtccccagtgaaggaagaagcaaagtcaccggctgaggccaagtccccagtgaaggaagaagcaaaatctccagctgaggtcaagtccccggaaaaggccaagtctccaacgaaggaggaagcaaagtcccctgagaaggccaagtccccagagaaggaagaggccaagtcccctgagaaggccaagtccccagtgaaggcagaagcaaagtcccctgagaaggccaagtccccagtgaaggcagaagcaaagtcccctgagaaggccaagtccccagtgaaggaagaagcaaagtcccctgagaaggccaagtccccagtgaaggaagaagcaaagtcccctgagaaggccaagtccccagtgaaggaagaagcaaagacccccgagaaggccaagtccccagtgaaggaagaagccaagtccccagagaaggccaagtccccagagaaggccaagactcttgatgtgaagtctccagaagccaagactccagcgaaggaggaagcaaggtcccctgcagacaaattccctgaaaaggccaaaagccctgtcaaggaggaggtcaagtccccagagaaggcgaaatctcccctgaaggaggatgccaaggcccctgagaaggagatcccaaaaaaggaagaggtgaagtccccagtgaaggaggaggagaagccccaggaggtgaaagtcaaagagcccccaaagaaggcagaggaagagaaagcccctgccacaccaaaaacagaggagaagaaggacagcaagaaagaggaggcacccaagaaggaggctccaaagcccaaggtggaggagaagaaggaacctgctgtcgaaaagcccaaagaatccaaagttgaagccaagaaggaagaggctgaagataagaaaaaagtccccaccccagagaaggaggctcctgccaaggtggaggtgaaggaagacgctaaacccaaagaaaagacagaggtagccaagaaggaaccagatgatgccaaggccaaggaacccagcaaaccagcagagaagaaggaggcagcaccggagaaaaaagacaccaaggaggagaaggccaagaagcctgaggagaaacccaagacagaggccaaagccaaggaagatgacaagaccctctcaaaagagcctagcaagcctaaggcagaaaaggctgaaaaatcctccagcacagaccaaaaagacagcaagcctccagagaaggccacagaagacaaggccgccaaggggaagtaaggcagggagaaaggaacatccggaacagccaaagaaactcagaagagtcccggagctcaaggatcagagtaacacaattttcactttttctgtctttatgtaagaagaaactgcttagatgacggggcctccttcttcaaacaggaatttctgttagcaatatgttagcaagagagggcactcccaggcccctgcccccaggccctccccaggcgatggacaattatgatagcttatgtagctgaatgtgatacatgccgaatgccacacgtaaacacttgactataaaaactgcccccctcctttccaaataagtgcatttattgcctctatgtgcaactgacagatgaccgcaataatgaatgagcagttagaaatacattatgcttgagatgtcttaacctattcccaaatgccttctgttttccaaaggagtggtcaagcccttgcccagagctctctattctggaagagcggtccaggtggggccggggactggccactgaattatgccagggcgcactttccactggagttcactttcaattgcttctgtgcaataaaaccaagtgcttataaaatgaaaaaaaaaaaaaaaa

SEQ ID NO: 59315 - DNA, 3266 bp, Homo sapiens
gcggtgcgggccgggcgggtgcattcaggccaaggcggggccgccgggatgctcagggttccggagccgcggcccggggaggcgaaagcggagggggccgcgccgccgaccccgtccaagccgctcacgtccttcctcatccaggacatcctgcgggacggcgcgcagcggcaaggcggccgcacgagcagccagagacagcgcgacccggagccggagccagagccagagccagagggaggacgcagccgcgccggggcgcagaacgaccagctgagcaccgggccccgcgccgcgccggaggaggccgagacgctggcagagaccgagccagaaaggcacttggggtcttatctgttggactctgaaaacacttcaggcgcccttccaaggcttccccaaacccctaagcagccgcagaagcgctcccgagctgccttctcccacactcaggtgatcgagttggagaggaagttcagccatcagaagtacctgtcagcccctgaacgggcccacctggccaagaacctcaagctcacggagacccaagtgaagatatggttccagaacagacgctataagactaagcgaaagcagctctcctcggagctgggagacttggagaagcactcctctttgccggccctgaaagaggaggccttctcccgggcctccctggtctccgtgtataacagctatccttactacccatacctgtactgcgtgggcagctggagcccagctttttggtaatgccagctcaggtgacaaccattatgatcaaaaactgccttccccagggtgtctcatatgaaaagcacaaggggccaaggtcagggagcaagaggtgtgcacaccaaaactattggagaattgcgtggaaatcttcagattcttcactggtgagacaatgaaacaacagagacagtgaaagttttaatacctaagtcattcccccagtgcatactgtagcgtcaagtttttgcttctggctacctgtttgaaggggagagagggaaaatcaagtggtattttccagcactttgtatgattttggatgagctgtacacccaaggattctgttctgcaactccatcctcctgtgtcactgaatatcaactctgaaagagcaaacctaacaggagaaaggacaaccaggatgaggatgtcaccaactgaattaaacttaagtccagaagcctcctgttggccttggaatatggccaaggctctctctgtccctgtaaaagagaggggcaaatagtctccaaagagaacgccctcatgctcagcacatatttgcatggaagggggagatgggtgggaggagatgaaaatatcagcttttcttattcctttttattccttttaaaatggtatgccaacttaagtatttacagggtggcccaaatagaacaagatgcactcgctgtgattttaagacaagctgtataaacagaactccactgcaagagggagggccgggccaggagaatctccgcttgtccaagacaggggcctaaggagggtctccacactgctgctaggggctgttgcatttttttattagtagaaagtggaaaggcctcttctcaacttttttcccttgggctggagaatttagaatcagaagtttcctggagttttcaggctatcatatatactgtatcctgaaaggcaacataattcttccttccctccttttaaaattttgtgttcctttttgcagcaattactcactaaagggcttcattttagtccagatttttagtctggctgcacctaacttatgcctcgcttatttagcccgagatccggtctttttttttttttttttttccgtctccccaaagctttatctgtcttgactttttaaaaaagtttgggggcagattctgaattggctaaaagacatgcatttttaaaactagcaactcttatttctttcctttaaaaatacatagcattaaatcccaaatcctatttaaagacctgacagcttgagaagggtcactactgcatttataggaccttctggtggttctgctgttacgtttgaagtctgacaatccttgagaatctttgcatgcagaggaggtaagaggtattggattttcacagagggaagaacacagcgcagaatgaaggcgcaggcttactgagctgtccagtggagggctcatgggtgggacatggaaaagaaggcagcctaggccctggggagcccagtccactgagcaagcaagggactgagtgagccttttgcaggaaaaggctaagaaaaaggaaaaccattctaaaacacaacaagaaactgtccaaatgctttgggaactgtgtttattgcctataatggggtccccaaaatgggtaacctagacttcagagagaatgagcagagagcaaaggagaaatctgggctgtccttccattttcattctgttatctcaggtgagctggtagaggggagacattagaaaaaaatgaaacaacaaaacaattactaatgaggtacgctgaggcctgggagtctcttgagctccacgacttcaaaattaaaatgagccatgagtcaaaccactgcaatccagcctgggcaacgagcaagacccagtctctactgttggtggcaaaattgccaacataagttaatagaaagttggccaatttcaccccattttctgtggtttgggctccacattgcaatgttcaatgccacgtgctgctgacaccgaccggagtactagccagcacaaaaggcagggtagcctgaattgctttctgctctttacatttcttttaaaataagcatttagtgctcagtccctactgagtactctttctctcccctcctctgaatttaattctttcaacttgcaatttgcaagggttacacatttcactgtgatgtatattgtgttgcaaaaaaaaaaaagtgtctttgtttaaaattacttggtttgtgaatccatcttgctttccccattggaactagtcattaacccatctctgaactggtagaaaaacatctgaagagctagtctatcagcatctgacaggtgaattggatggttctcagaaccatttcacccagacagcctgtttctatcctgtttaataaattagtttgggttctctacatgcataacaaaccctgctccaatctgtcacataaaagtctgtgacttgaagtttagtcagcacccccaccaaactttatttttctatgtgttttttgcaacatatgagtgttttgaaaataaagt

SEQ ID NO: 59316 - DNA, 4131 bp, Homo sapiens
tcaagctcgccccgcgcagcccgagccgggctgggcgctgtcctcgggggcctggggaaccgcgcggtttggagatcggaggcacctggaacccgtggcaagcgccgagccgggagacagcccgaggaaccacgggttctggagctaggagccggaagctgggagtccggaggagagcggagcccggagcccggagcccggggcggcgcgtctgggtctggcgcttcccgactggacggcgcgcccgctggtcttcgccacgcgccctcccctgggctcgcgttcatcggtccccgcctgagacgcgcccactcctgcccggacttccagccccggaggcgccggacagagccgcggactccagcgcccaccatgcgcctcaacagctccgcgccgggaaccccgggcacgccggccgccgaccccttccagcgggcgcaggccggactggaggaggcgctgctggccccgggcttcggcaacgcttcgggcaacgcgtcggagcgcgtcctggcggcacccagcagcgagctggacgtgaacaccgacatctactccaaagtgctggtgaccgccgtgtacctggcgctcttcgtggtgggcacggtgggcaacacggtgacggcgttcacgctggcgcggaagaagtcgctgcagagcctgcagagcacggtgcattaccacctgggcagcctggcgctgtccgacctgctcaccctgctgctggccatgcccgtggagctgtacaacttcatctgggtgcaccacccctgggccttcggcgacgccggctgccgcggctactacttcctgcgcgacgcctgcacctacgccacggccctcaacgtggccagcctgagtgtggagcgctacctggccatctgccaccccttcaaggccaagaccctcatgtcccgaagccgcaccaagaagttcatcagcgccatctggctcgcctcggccctgctgacggtgcctatgctgttcaccatgggcgagcagaaccgcagcgccgacggccagcacgccggcggcctggtgtgcacccccaccatccacactgccaccgtcaaggtcgtcatacaggtcaacaccttcatgtccttcatattccccatggtggtcatctcggtcctgaacaccatcatcgccaacaagctgaccgtcatggtacgccaggcggccgagcagggccaagtgtgcacggtcgggggcgagcacagcacattcagcatggccatcgagcctggcagggtccaggccctgcggcacggcgtgcgcgtcctacgtgcagtggtcatcgcctttgtggtctgctggctgccctaccacgtgcggcgcctcatgttctgctacatctcggatgagcagtggactccgttcctctatgacttctaccactacttctacatggtgaccaacgcactcttctacgtcagctccaccatcaaccccatcctgtacaacctcgtctctgccaacttccgccacatcttcctggccacactggcctgcctctgcccggtgtggcggcgcaggaggaagaggccagccttctcgaggaaggccgacagcgtgtccagcaaccacaccctctccagcaatgccacccgcgagacgctgtactaggctgtgcgccccggaacgtgtccaggaggagcctggccatgggtccttgcccccgacagacagagcagcccccacccgggagccttgatgggggtcaggcagaggccagcctgcactggagtctgaggcctgggacccccccctcccaccccctaacccatgtttctcattagtgtctcccgggcctgtccccaactcctccccacccctcccccatctcctctttgaaagccagaacaagagagcgctcctctcccagataggaaaagggcctctaacaaggagaaattagtgtgcggcaaaaggcagttttctttgttctcagactaatggatggttccagagaaggaaatgaaatgtgctgggtggggccgggcctccggcggcccggctgctgttcccatgtccacatctctgaggcctgcaccccctctgtctagctcggggagtccagccccagtcccgcaggctccgtggctttgggcctcacgtgcagaccctgccatgcagacccatgcccccctcccccaggcagctccaagaaagctccctgactcgccccttcaggcctggcaagctgggggcccatcgccgtggggagtccctcccaccaccctcgccgcaggcagctgcagcccccagaggggaccacaagcccaaaaaggacaaaaatgggctggcctggaatggcccagaccccagcctcccctcctccctcccatcctcacccaggccaaggcccaggggctctgccaggacaccacatgggagggggctcaggcctcagcctcaagatcttcagctgtggcctctcgggctcggcagaagggacgccggatcaggggcctggtctccagcacctgcccgagtggccgtggccaggatggggtgcgcattccgtgtgctttgcttgtagctgtgcaggctgaggtctggagccaggcccagagctggcttcagggtggggccttgagaaggggaatgtgggacaggggcgatggtgcctggtctctgagtaagatgccaggtcccaggaactcaggcttcaggtgagaaggagcggtgtgtccaggcaccgctggccggcagccctgggctgaggcacagactcatttgtcaccttctggcggcggcagccctggccccggcctccaagcagttgaaaaagctggcgcctccttggtctctaggatccaggctccacagagcacatgactagccaggcccctggcttaagaaggtcgcctaagcctaagagaagacagtcccaggagaagctggccgggaccagccaggagctgggagccacaggaagcaaaagtcagccttttcttcaagggatttccctgtctcagagcagcctttgccccagggaaatgggctctgggctggctgcctgcaccggccatgtcgacccaggacccggacacctggtcttgggctgtgttcagccactttgccttctctggactcagtttccccgtctgagaaatgagagtcgaatgctacagtatctgcagtcgcttggatctggctgttgagttgacgggttccttgaaccccacaaaatccctctccaaccacaggacccttcggctcaccaagaacggggcccaggggagtcaggcctattcgctgcacttcctgccaaactttgcccccacaagcctggtcatcagccaggcagccctcccagtgcccaagggccaccaaccccagggaaacagggccagcacagaggggccttcctcccccacagagctcccatgacatagtctgctctgggcggaagagctttgctgccagccagggatgtccagaggtcggtgcagcccctatccctgctcaggagtgggctcagagtctagcaaatgctaaggcccctcaggctgggctctgaacgaggacctggactcagagccagacagggcagcctcagacccttctctggggctcctggaccttgggccataatttctgagcctcggtttccccatctaaggaacagatgtggtcgttccgccctctcagctggatgagactgtcctggaggatccaccccggaacagacagaacggtgtctctcaggatggtgctctgagagagggcagagtggatgccccactgccctagaccctcggtagacgtggggtctctggggcggggtctgtggctgtgactgaagtcggctttcccgttgatgtcttgatgctcctatctgtgcacttaccgtaggtagggacacgtgtccatgcaccacagacacacccacgacacctgatctcgtatcactagcttgcggccaggtcatgatgtggccccggaagctggccctgcgtgccatgagtgcgtcggtcatggagtccggagcccctgagccggcccctggtgacggcacagccctcacagctcaaacgcccacccccactcccaccatctgcaggtggtgaaaacaaaccccgtgtatctctcaataaaggtggccgaagggcctcgatgtgg

SEQ ID NO: 59317 - DNA, 4476 bp, Homo sapiens
gcagcggcggcagccagaacaggagcagcgatagctcgggtttccggaacaggagccggggcagcggcggcagctcagtgctgggcacctgtgcggagcaggagtagcaggaccacggggtggggtcggcgccagccactctgagccagagaaggaaggggcatctcccagattccactgctgggaataatctccaggggaggtggcgctgaactgggaatactggtgggggtgaacatgtgcaggaacagctagaggcctcggggcaggaaaacatttggttcacgtgtaaacaggcaaggaaagctgtctgggaccatggcagcctcccgcctggactttggggaggtggaaactttcctggacaggcacccagagttgtttgaagattacttgatgcggaaggggaagcaggagatggttgaaaagtggctgcagaggcacagtcagggtcagggggctttaggtccaaggccctctttggctggtaccagcagcttggctcacagcacctgcagaggtggcagcagcgttggtggtggcactggaccaaatggctctgcccacagccagccccttcccggtggcggggactgtggtggggttcccttgagtcccagctgggccggtggcagcaggggcgatgggaacctgcagcggagagcttctcagaaagagctaaggaagagttttgcccgctccaaggccatccacgtgaacaggacctacgatgaacaggtgacctcccgggctcaggaacccctgagtagtgtacgacggagggcacttctccggaaggcaagctccctgccccccaccacagcccatattctcagtgcgctgctggaatcgagagtgaatctgcctcagtatccccctacagccatcgactacaagtgccatctgaaaaagcataatgagcgtcagttctttctggaattggtcaaagatatctccaatgaccttgacctcaccagcctgagctacaagattctcatctttgtctgccttatggtggatgctgaccgctgctctcttttcctggtggaaggggcagctgctggcaagaagaccttggtctccaaattctttgatgtgcatgcaggaacccctctgctgccttgcagcagcacagagaactcaaatgaggtgcaggtcccctggggcaaaggtatcattggctatgtcggggagcatggagaaacggtcaacattcctgatgcctaccaggatcgacgattcaatgatgaaatcgacaagctaactggatacaagacaaaatcattattgtgcatgcctatccgaagcagtgatggtgagattattggtgtggcccaagcgataaataagattcctgaaggagctccatttactgaagatgatgaaaaagttatgcagatgtatcttccattttgtggaatcgccatatctaacgctcagctctttgctgcctcaaggaaagaatatgaaagaagcagagctttgctagaggtggttaatgacctctttgaagaacagactgacctggagaaaattgtcaagaaaataatgcatcgggcccaaactctgctgaaatgtgaacgctgttctgttttactcctagaggacatcgaatcaccagtggtgaaatttaccaaatcctttgaattgatgtccccaaagtgcagtgctgatgctgagaacagtttcaaagaaagcatggagaaatcatcatactccgactggctaataaataacagcattgctgagctggttgcttcaacaggccttccagtgaacatcagtgatgcctaccaggatccgcgctttgatgcagaggcagaccagatatctggttttcacataagatctgttctttgtgtccctatttggaatagcaaccaccaaataattggagtggctcaagtgttaaacagacttgatgggaaaccttttgatgatgcagatcaacgactttttgaggcttttgtcatcttttgtggacttggcatcaacaacacaattatgtatgatcaagtgaagaagtcctgggccaagcagtctgtggctcttgatgtgctatcataccatgcaacatgttcaaaagctgaagttgacaagtttaaggcagccaacatccctctggtgtcagaacttgccatcgatgacattcattttgatgacttttctctcgacgttgatgccatgatcacagctgctctccggatgttcatggagctggggatggtacagaaatttaaaattgactatgagacactgtgtaggtggcttttgacagtgaggaaaaactatcggatggttctataccacaactggagacatgccttcaacgtgtgtcagctgatgttcgcgatgttaaccactgctgggtttcaagacattctgaccgaggtggaaattttagcggtgattgtgggatgcctgtgtcatgacctcgaccacaggggaaccaacaatgccttccaagctaagagtggctctgccctggcccaactctatggaacctctgctaccttggagcatcaccatttcaaccacgccgtgatgatccttcaaagtgagggtcacaatatctttgctaacctgtcctccaaggaatatagtgaccttatgcagcttttgaagcagtcaatattggcaacagacctcacgctgtactttgagaggagaactgaattctttgaacttgtcagtaaaggagaatacgattggaacatcaaaaaccatcgtgatatatttcgatcaatgttaatgacagcctgtgaccttggagccgtgaccaaaccgtgggagatctccagacaggtggcagaacttgtaaccagtgagttcttcgaacaaggagatcgggagagattagagctcaaactcactccttcagcaatttttgatcggaaccggaaggatgaactgcctcggttgcaactggagtggattgatagcatctgcatgcctttgtatcaggcactggtgaaggtcaacgtgaaactgaagccgatgctagattcagtagctacaaacagaagtaagtgggaagagctacaccaaaaacgactgctggcctcaactgcctcatcctcctcccctgccagtgttatggtagccaaggaagacaggaactaaacctccaggtcagctgcagctgcaaaatgactacagcctgaagggccattttcagtccagcaatgtcatccttttgttcttttagctcagaaagacctaacatctcaaggatgcactgggaaccatgcctgggctttcaccttgaagcatggtcagcagcagagagagcaacgggaaggacaaagaaagaggtggggcagggagcacaccccaggaccctcacttttccctaatgaacacgcatgggctgaaatgaaggctctgggtaggggactgttttggatccaaggacctgtggacagtcggcctacttactctgagctgagggaacactgaacagtaaaagcgtcattagcgctgcttcattttgtatagggcttttctgtttgttacaagccaaacattgcctgtctttgcttcccgtccctgaatgcctttttgtgccagactgtcccaagaatcctaatttgtattccatagaggtattttatttttaatcctagagcttcttattgatggatcctttagaattgcctacctaaaaggtaaactatactatccttataaatactgatcaatcccagttctccccctaaaaatgaatacatagtaggactatagcaaatgtgtttgatgggtaattctagactgggactatggtacccttttccagagttttaaaattcaaccttcattacagacaaagttttctcccagaaggaatggattgatagattttgattaaagtaagggtggaaggaaatctgtagctggatttaccacaagtgacatctagaaactatagttcacaggacagagcagagccatggagaataagcattgactaccttgagttctcctagtgaggagttctggtataaaatttaagattactaccagtaaccaacttaaagcaaactataggggtccctaattttggatttttccttaagtgtaagaaacaatgcttcaaatgttaagaaataacagtctgggcaaagaacgcatattctataggaagccaggtttacaataggtaagaataaactgtattaagtagatgtaatgactagaaagctgctttgctccctatattgagaaattgtggacatggtatgtgttatccaaagaacattgggctagaagatagatttctatccttagctttggcattattgactggattgacttgaacaagtcgcttaacttctacaagcttgtttccttatttgtcaaattagattacactaggaaacgattctcgaacatgttttaaccttacaactctttgttcaaataaatctttcaatgaatccccaacataaaaaaaaaaaaaaaaaaaaaaaaaaaaaa

SEQ ID NO: 59318 - DNA, 1849 bp, Homo sapiens
cgccgctctgggagccgctgctggtcccggccttgcggcctgcgggggaggctgcccggaggaggcagcggcggcggcagcgcgtcctcggtccccaggaccacggcttctttcctgccagatctatccatctggccatccatccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcgggttgccatcctacctgaagcatgcaagcaccgtggcaggcgggttcttcagcctctaccacttcttccagctgcacatggtttgggtcgtgctgctcagcctcctgtgctacctcgtgctgttcctctgccgacattcctcccatcgaggcgtcttcctatccgtcaccatcctcatctacctactcatgggtgagatgcacatggtagacaccgtgacatggcacaagatgcgaggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactgagctgccggtggctgcagaaggtggcccggagcctggcactggccctgctgtgccttgtgctgtccacttgcgtgggcccctacctcttcccgtacttcatccccctcaacggtgaccgcctccttcgcaagtggctgcgagcctacgagagtgctgtctccttccacttcagcaactattttgtgggctttctttccgaggccacggccacgttggcgggggctggctttaccgaggagaaggatcacctggaatgggacctgacggtgtccaagccactgaatgtggagctgcctcggtcaatggtggaagttgtcacaagctggaacctgcccatgtcttattggctaaataactatgttttcaagaatgctctccgcctggggaccttctcggctgtgctggtcacctatgcagccagcgccctcctacatggcttcagtttccacctggctgcggtcctgctgtccctggcttttatcacttacgtggagcatgtcctccggaagcgcctggctcggatcctcagtgcctgtgtcttgtcaaagcggtgcccgccagactgttcgcaccagcatcgcttgggcctgggggtgcgagccttaaacttgctctttggagctctggccatcttccacctggcctacctgggctccctgtttgatgtcgatgtggatgacaccacagaggagcagggctacggcatggcatacactgtccacaagtggtcagagctcagctgggccagtcactgggtcacttttggatgctggatcttctaccgtctcataggctgaggcacatctgtggaccctcataaccctcttaagacccctctcagggtgccactgatgggggatgagggaaggccctctctctactccttgaccccctccatccttgacccccaacacctcaacacacacacacacacacacacacaaaatcacaccattttcatgcctgtcaatccccaccccaccacaaggcaggaagggggtggtgcctgctggggcctagagggggatgcttggggaaacagagaaggggagatccagggcctccccgccttccttcttcctttttatatacaatttgttattgtcaaataaaagtaggaaatattcaataggct

SEQ ID NO: 59319 - DNA, 1867 bp, Homo sapiens
cgccgctctgggagccgctgctggtcccggccttgcggcctgcgggggaggctgcccggaggaggcagcggcggcggcagcgcgtcctcggtccccaggaccacggcttctttcctgccagatctatccatctggccatccatccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcgggttgccatcctacctgaagcatgcaagcaccgtggcaggcgggttcttcagcctctaccacttcttccagctgcacatggtttgggtcgtgctgctcagcctcctgtgctacctcgtgctgttcctctgccgacattcctcccatcgaggcgtcttcctatccgtcaccatcctcatctacctactcatgggtgagatgcacatggtagacaccgtgacatggcacaagatgcgaggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactgagctgccggtggctgcagaaggtggcccggagcctggcactggccctgctgtgccttgtgctgtccacttgcgtgggcccctacctcttcccgtacttcatccccctcaacggtgaccgcctccttcgcaacaagaaacgcaaagccaggtggctgcgagcctacgagagtgctgtctccttccacttcagcaactattttgtgggctttctttccgaggccacggccacgttggcgggggctggctttaccgaggagaaggatcacctggaatgggacctgacggtgtccaagccactgaatgtggagctgcctcggtcaatggtggaagttgtcacaagctggaacctgcccatgtcttattggctaaataactatgttttcaagaatgctctccgcctggggaccttctcggctgtgctggtcacctatgcagccagcgccctcctacatggcttcagtttccacctggctgcggtcctgctgtccctggcttttatcacttacgtggagcatgtcctccggaagcgcctggctcggatcctcagtgcctgtgtcttgtcaaagcggtgcccgccagactgttcgcaccagcatcgcttgggcctgggggtgcgagccttaaacttgctctttggagctctggccatcttccacctggcctacctgggctccctgtttgatgtcgatgtggatgacaccacagaggagcagggctacggcatggcatacactgtccacaagtggtcagagctcagctgggccagtcactgggtcacttttggatgctggatcttctaccgtctcataggctgaggcacatctgtggaccctcataaccctcttaagacccctctcagggtgccactgatgggggatgagggaaggccctctctctactccttgaccccctccatccttgacccccaacacctcaacacacacacacacacacacacacaaaatcacaccattttcatgcctgtcaatccccaccccaccacaaggcaggaagggggtggtgcctgctggggcctagagggggatgcttggggaaacagagaaggggagatccagggcctccccgccttccttcttcctttttatatacaatttgttattgtcaaataaaagtaggaaatattcaataggct

SEQ ID NO: 59320 - DNA, 1743 bp, Homo sapiens
atctatccatctggccatccatccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcgggttgccatcctacctgaagcatgcaagcaccgtggcaggcgggttcttcagcctctaccacttcttccagctgcacatggtttgggtcgtgctgctcagcctcctgtgctacctcgtgctgttcctctgccgacattcctcccatcgaggcgtcttcctatccgtcaccatcctcatctacctactcatgggtgagatgcacatggtagacaccgtgacatggcacaagatgcgaggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactgagctgccggtggctgcagaaggtggcccggagcctggcactggccctgctgtgccttgtgctgtccacttgcgtgggcccctacctcttcccgtacttcatccccctcaacggtgaccgcctccttcgcaagggcaccatggtaaggtggctgcgagcctacgagagtgctgtctccttccacttcagcaactattttgtgggctttctttccgaggccacggccacgttggcgggggctggctttaccgaggagaaggatcacctggaatgggacctgacggtgtccaagccactgaatgtggagctgcctcggtcaatggtggaagttgtcacaagctggaacctgcccatgtcttattggctaaataactatgttttcaagaatgctctccgcctggggaccttctcggctgtgctggtcacctatgcagccagcgccctcctacatggcttcagtttccacctggctgcggtcctgctgtccctggcttttatcacttacgtggagcatgtcctccggaagcgcctggctcggatcctcagtgcctgtgtcttgtcaaagcggtgcccgccagactgttcgcaccagcatcgcttgggcctgggggtgcgagccttaaacttgctctttggagctctggccatcttccacctggcctacctgggctccctgtttgatgtcgatgtggatgacaccacagaggagcagggctacggcatggcatacactgtccacaagtggtcagagctcagctgggccagtcactgggtcacttttggatgctggatcttctaccgtctcataggctgaggcacatctgtggaccctcataaccctcttaagacccctctcagggtgccactgatgggggatgagggaaggccctctctctactccttgaccccctccatccttgacccccaacacctcaacacacacacacacacacacacacaaaatcacaccattttcatgcctgtcaatccccaccccaccacaaggcaggaagggggtggtgcctgctggggcctagagggggatgcttggggaaacagagaaggggagatccagggcctccccgccttccttcttcctttttatatacaatttgttattgtcaaataaaagtaggaaatattcaataggct

SEQ ID NO: 59321 - DNA, 1761 bp, Homo sapiens
atctatccatctggccatccatccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcgggttgccatcctacctgaagcatgcaagcaccgtggcaggcgggttcttcagcctctaccacttcttccagctgcacatggtttgggtcgtgctgctcagcctcctgtgctacctcgtgctgttcctctgccgacattcctcccatcgaggcgtcttcctatccgtcaccatcctcatctacctactcatgggtgagatgcacatggtagacaccgtgacatggcacaagatgcgaggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactgagctgccggtggctgcagaaggtggcccggagcctggcactggccctgctgtgccttgtgctgtccacttgcgtgggcccctacctcttcccgtacttcatccccctcaacggtgaccgcctccttcgcaacaagaaacgcaaagccaggggcaccatggtaaggtggctgcgagcctacgagagtgctgtctccttccacttcagcaactattttgtgggctttctttccgaggccacggccacgttggcgggggctggctttaccgaggagaaggatcacctggaatgggacctgacggtgtccaagccactgaatgtggagctgcctcggtcaatggtggaagttgtcacaagctggaacctgcccatgtcttattggctaaataactatgttttcaagaatgctctccgcctggggaccttctcggctgtgctggtcacctatgcagccagcgccctcctacatggcttcagtttccacctggctgcggtcctgctgtccctggcttttatcacttacgtggagcatgtcctccggaagcgcctggctcggatcctcagtgcctgtgtcttgtcaaagcggtgcccgccagactgttcgcaccagcatcgcttgggcctgggggtgcgagccttaaacttgctctttggagctctggccatcttccacctggcctacctgggctccctgtttgatgtcgatgtggatgacaccacagaggagcagggctacggcatggcatacactgtccacaagtggtcagagctcagctgggccagtcactgggtcacttttggatgctggatcttctaccgtctcataggctgaggcacatctgtggaccctcataaccctcttaagacccctctcagggtgccactgatgggggatgagggaaggccctctctctactccttgaccccctccatccttgacccccaacacctcaacacacacacacacacacacacacaaaatcacaccattttcatgcctgtcaatccccaccccaccacaaggcaggaagggggtggtgcctgctggggcctagagggggatgcttggggaaacagagaaggggagatccagggcctccccgccttccttcttcctttttatatacaatttgttattgtcaaataaaagtaggaaatattcaataggct

SEQ ID NO: 59322 - DNA, 1778 bp, Homo sapiens
cgccgctctgggagccgctgctggtcccggccttgcggcctgcgggggaggctgcccggaggaggcagcggcggcggcagcgcgtcctcggtccccaggaccacggcttctttcctgccagatctatccatctggccatccatccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcgctgcacatggtttgggtcgtgctgctcagcctcctgtgctacctcgtgctgttcctctgccgacattcctcccatcgaggcgtcttcctatccgtcaccatcctcatctacctactcatgggtgagatgcacatggtagacaccgtgacatggcacaagatgcgaggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactgagctgccggtggctgcagaaggtggcccggagcctggcactggccctgctgtgccttgtgctgtccacttgcgtgggcccctacctcttcccgtacttcatccccctcaacggtgaccgcctccttcgcaagtggctgcgagcctacgagagtgctgtctccttccacttcagcaactattttgtgggctttctttccgaggccacggccacgttggcgggggctggctttaccgaggagaaggatcacctggaatgggacctgacggtgtccaagccactgaatgtggagctgcctcggtcaatggtggaagttgtcacaagctggaacctgcccatgtcttattggctaaataactatgttttcaagaatgctctccgcctggggaccttctcggctgtgctggtcacctatgcagccagcgccctcctacatggcttcagtttccacctggctgcggtcctgctgtccctggcttttatcacttacgtggagcatgtcctccggaagcgcctggctcggatcctcagtgcctgtgtcttgtcaaagcggtgcccgccagactgttcgcaccagcatcgcttgggcctgggggtgcgagccttaaacttgctctttggagctctggccatcttccacctggcctacctgggctccctgtttgatgtcgatgtggatgacaccacagaggagcagggctacggcatggcatacactgtccacaagtggtcagagctcagctgggccagtcactgggtcacttttggatgctggatcttctaccgtctcataggctgaggcacatctgtggaccctcataaccctcttaagacccctctcagggtgccactgatgggggatgagggaaggccctctctctactccttgaccccctccatccttgacccccaacacctcaacacacacacacacacacacacacaaaatcacaccattttcatgcctgtcaatccccaccccaccacaaggcaggaagggggtggtgcctgctggggcctagagggggatgcttggggaaacagagaaggggagatccagggcctccccgccttccttcttcctttttatatacaatttgttattgtcaaataaaagtaggaaatattcaataggct

SEQ ID NO: 59323 - DNA, 1331 bp, Homo sapiens
cctgcatctttttggaaggattctttttataaatcagaaagtgttcgaggttcaaaggtttgcctcggagcgtgtgaacattcctccgctcggttttcaactcgcctccaacctgcgccgcccggccagcatgtctccccgcccgtgaagcggggctgccgcctccctgccgctccggctgccactaacgacccgccctcgccgccacctggccctcctgatcgacgacacacgcacttgaaacttgttctcagggtgtgtggaatcaactttccggaagcaaccagcccaccagaggaggtcccgagcgcgagcggagacgatgcagcggagactggttcagcagtggagcgtcgcggtgttcctgctgagctacgcggtgccctcctgcgggcgctcggtggagggtctcagccgccgcctcaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacacaaagaaccaccccgtccgatttgggtctgatgatgagggcagatacctaactcaggaaactaacaaggtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctcgattcacggaggcattgaaattttcagcagagaccttccaaggacatattgcaggattctgtaatagtgaacatatggaaagtattagaaatatttattgtctgtaaatactgtaaatgcattggaataaaactgtctcccccattgctctatgaaactgcacattggtcattgtgaatattttttttttgccaaggctaatccaattattattatcacatttaccataatttattttgtccattgatgtatttattttgtaaatgtatcttggtgctgctgaatttctatattttttgtaacataatgcactttagatatacatatcaagtatgttgataaatgacacaatgaagtgtctctattttgtggttgattttaatgaatgcctaaatataattatccaaattgattttcctttgtgcatgtaaaaataacagtattttaaatttgtaaagaatgtctaataaaatataatctaattacatcatga

SEQ ID NO: 59324 - DNA, 1312 bp, Homo sapiens
ctggttcgcaaagaagctgacttcagagggggaaactttcttcttttaggaggcggttagccctgttccacgaacccaggagaactgctggccagattaattagacattgctatgggagacgtgtaaacacactacttatcattgatgcatatataaaaccattttattttcgctattatttcagaggaagcgcctctgatttgtttcttttttccctttttgctctttctggctgtgtggtttggagaaagcacagttggagtagccggttgctaaataagtcccgagcgcgagcggagacgatgcagcggagactggttcagcagtggagcgtcgcggtgttcctgctgagctacgcggtgccctcctgcgggcgctcggtggagggtctcagccgccgcctcaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacacaaagaaccaccccgtccgatttgggtctgatgatgagggcagatacctaactcaggaaactaacaaggtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctcgattcacggaggcattgaaattttcagcagagaccttccaaggacatattgcaggattctgtaatagtgaacatatggaaagtattagaaatatttattgtctgtaaatactgtaaatgcattggaataaaactgtctcccccattgctctatgaaactgcacattggtcattgtgaatattttttttttgccaaggctaatccaattattattatcacatttaccataatttattttgtccattgatgtatttattttgtaaatgtatcttggtgctgctgaatttctatattttttgtaacataatgcactttagatatacatatcaagtatgttgataaatgacacaatgaagtgtctctattttgtggttgattttaatgaatgcctaaatataattatccaaattgattttcctttgtgcatgtaaaaataacagtattttaaatttgtaaagaatgtctaataaaatataatctaattacatcatga

SEQ ID NO: 59325 - DNA, 1496 bp, Homo sapiens
gccgtgtcactggctcaggctcagttgctgggtcaccagtagaatggacccttcctccacctcagttcagagcacagtgatgattcgtgactttctttcccaatagaacttcaaatctctgaagacggggggtggggggatgtgcttgagtgtttgtactcatggtcttgttctagaagtgacaaagctgggacgcaatacctttatgcatgaaaaggttgtcacttgtcacaactaacaggctttcacctcacggaaattttcttcccttgtgcacttttcccctggcagtggacatggctgcactcttccaagaagcaagcagctgtcccgtctgctcagactatctagagaaaccaatgtccctggagtgtggatgcgctgtctgcttcaagtgcatcaattcactgcagaaggagccccatggggaggatctactttgctgttgctgttccatggtctctcagaagaacaaaatcaggcccagttggcagctagagaggctggcttcccacatcaaggaactggagcccaagctgaagaagattctgcagatgaacccaaggatgcggaagttccaagtggatatgaccttggatgccgacacagccaacaacttcctcctcatttctgacgacctcaggagcgtccgaagtgggtgcatcacacagaatcggcaagaccttgccgagagatttgacgtgtccatttgcatcctgggctcccctcgctttacctgtggccgccactactgggaggtggacgtgggaacaagcacagaatgggacctgggagtctgcagagaatctgttcaccgcaaagggaggatccatctgaccacagagcgtggattctggactgtgagtttgagggatggaagccgcctctctgccagcacggtgccgctgactttcctcttcgtagaccgcaagttacagcgagtggggatttttctggatatgggcatgcagaacgtttccttttttgatgctgaaggtggttcccatgtctatacattcaggagtgtctctgctgaggagccactgcacttgttttttgctcctccaagtccacctaatggtgataagagtgtcttgagtatctgtcctgtgataaacccgggcactactgatgctccagtccatcctggggaggccaaataagcccccactgcaaaaaaacaaaaaacaggttaagaaaattacttgggtgggcagacttaggaacgctctactcggtaaaagcgttatacaaagtcataggagaaaaatatgggacaattcatgattatacttaatctaatttgattagtttataaattgagtcctaagtattaattattgccaccatccaactcattgagtcttatggttcacatcttgtttcctatagaaatattctgtattctgggatcaatttccaaatgcttttttatttctgtaagttcaaattaatgtattatagaagttatgagttaaataaacattggaatatca

SEQ ID NO: 59326 - DNA, 1488 bp, Homo sapiens
gccacgtcactggctcaggctcagctgctgggtcaccaggagaatggacccttcctccacctcagctcagagcacagtgatgattcgtgactttcccaatagaacttcaaatctctgaggacggggggtggggggatgtgcttgagtgtttgtactcatggtcttgttctcggagtgacaaagctggaacacaatacctctatgcatgaaaaggttgtcacttgtcacaactaacaggctttcacctcaaggaaattttcttcccttgtgtacttttcccctggcagtggacatggctgcactcttccaagaagcaagcagctgtcccgtctgctcagactatctggaaaaaccaatgtccctggagtgtggatgcaccgtctgcctcaagtgcatcaattcgctgcagaaggagccccatggggaggatctgctttgctgttgctgttccatggtctctcagaggaacaaaatcaggcccaatcggcagctagagaggctggtttcccacatcaaggaactggagcccaagctgaagaagattctacagatgaacccaaggatgcggaagttccaagtggatatgaccttggatgccgacacagccaacaacttcctcctcatttctgacgacctcaggagcgtccgaagtgggctcatcacacagaatcggcaagaccttgccgagagatttgacgtgtccgtttgcatcctgggctcccctcgctttacctgtggccgccactactgggaggtggacgtgggaacaagcacagaatgggacctgggagtctgcagagaatctgttcactgcaaagggaagatccagctgaccacagagcttggattctggactgtgagtttgagggatggaagccgcctctctgccagcacggtgccgctgactttcctcttagtagaccgcaagttacagcgagtggggatttttctggatatgggcatgcagaacgtttccttttttgatgctgaaagtggttcccatgtctatacattcaggagcgtctctgctgaggagccactgcgcccatttttggctccttcaattccacctaatggtgatcaaggtgtcttgagcatctgtcctttgatgaactcaggcactactgatgctccagtccgtcctggggaggccaaataagccgccactgcaaaaaaaaacagggtcagaaaattacttgggtgggtagacttaggaattttctacttggtaaaagcattatacagtcataggagaaagatatgggacatttctataatctatattctaatttgattcgattattgagtcgtaagtattaattattgccaccatccaactcattgagtcttatggttcacatcttgtttcctatagaaatgttctgtattctcggatcaatttccaaatgctttactttttcatttctgtaagttcaaatcaatgtttaaattatagaagttatgaggtaaataaacatttggatatca

SEQ ID NO: 59327 - DNA, 1209 bp, Homo sapiens
aatatttgtgcaggcgccgcaggaacgggctccgcggacgacgggctccagggacgcacaggcagcgggcctcccaccgcgggtgccgggggcgggggggctgcccccatgcggggcccttcctggtcgcggcctcggccgctgctgctgctgttgctgctgctgtcgccttggcctgtctgggcccaggtgtcggccacggcctcgccctcggggtccctgggcgccccggactgccccgaggtgtgcacgtgcgtgccgggaggcctggccagctgctcggcactctcgctgcccgccgtgcccccgggcctgagcctgcgcctgcgcgcgctgctgctggaccacaaccgcgtccgtgcgctgccgccaggtgccttcgcgggagcgggcgcgctacagcgcctggacctgcgcgagaacgggctgcactcggtgcatgtgcgagccttctggggcctgggcgcgctgcagctgctggacctgagcgccaaccagctggaagcactggcaccagggactttcgcgccgctgcgcgcgctgcgcaacctctcattggccggcaaccggctggcgcgcctggagcccgcggcgctaggcgcgctcccgctgctgcgctcactcagcctgcaggacaacgagctggcggcactcgcgccggggctgctgggccgcctgcccgctctagacgcgctgcacctgcgcggcaacccttggggctgcgggtgcgcgctgcgcccgctctgcgcctggctgcgccggcacccgctgcccgcgtcagaggccgagacggtgctctgcgtgtggccgggacgcctgacgctcagccccctgactgccttttccgacgccgcctttagccattgcgcgcagccgctcgccctgcgggacctggccgtggtttacacgctcgggccggcctccttcctcgtcagcctggcttcctgcctggcgctgggctctgggctcaccgcctgccgtgcgcgccgccgccgcctccgcaccgccgccctccgcccgccgagaccgccagacccgaaccccgatcccgacccccacggctgtgcctcgcccgcggacccggggagccccgccgctgccgcccaagcctgagcggccgcggccgcctggagcgctcgaagcttcccccatgcctttgccctccctttacactgtctgccggcgtcaacaagcgacacagaccgaaaa

SEQ ID NO: 59328 - DNA, 5473 bp, Homo sapiens
ggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggggtattctactattttgtcagtgccctgggcataacagcaggagctcatcgtctgtggagccaccgctcttacaaagctcggctgcccctacggctctttctgatcattgccaacacaatggcattccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtactacaaacctggcttgctgatgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttctgtagcctaaaacgaatggtctttgctccagataactctctttccttgagctgttgtgagctttgaagtaggtggcttgagctagagataaaacagaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttttgggttaaaagatggttgtagcatttaaaatggaaaattttctccttggtttgctagtatcttgggtgtattctctgtaagtgtagctcaaataggtcatcatgaaaggttaaaaaagcgaggtggccatgttatgctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttgggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattttggaataatttctattaatatcaactctgaagctaattgtactaatctgagattgtgtttgttcataataaaagtgaagtgaatctgattgcaaaaaa

SEQ ID NO: 59329 - DNA, 2558 bp, Homo sapiens
ttgtgctcctcgcttgcctgttccttttccacgcattttccaggataactgtgactccaggcccgcaatggatgccctgcaactagcaaattcggcttttgccgttgatctgttcaaacaactatgtgaaaaggagccactgggcaatgtcctcttctctccaatctgtctctccacctctctgtcacttgctcaagtgggtgctaaaggtgacactgcaaatgaaattggacaggttcttcattttgaaaatgtcaaagatataccctttggatttcaaacagtaacatcggatgtaaacaaacttagttccttttactcactgaaactaatcaagcggctctacgtagacaaatctctgaatctttctacagagttcatcagctctacgaagagaccctatgcaaaggaattggaaactgttgacttcaaagataaattggaagaaacgaaaggtcagatcaacaactcaattaaggatctcacagatggccactttgagaacattttagctgacaacagtgtgaacgaccagaccaaaatccttgtggttaatgctgcctactttgttggcaagtggatgaagaaatttcctgaatcagaaacaaaagaatgtcctttcagactcaacaagacagacaccaaaccagtgcagatgatgaacatggaggccacgttctgtatgggaaacattgacagtatcaattgtaagatcatagagcttccttttcaaaataagcatctcagcatgttcatcctactacccaaggatgtggaggatgagtccacaggcttggagaagattgaaaaacaactcaactcagagtcactgtcacagtggactaatcccagcaccatggccaatgccaaggtcaaactctccattccaaaatttaaggtggaaaagatgattgatcccaaggcttgtctggaaaatctagggctgaaacatatcttcagtgaagacacatctgatttctctggaatgtcagagaccaagggagtggccctatcaaatgttatccacaaagtgtgcttagaaataactgaagatggtggggattccatagaggtgccaggagcacggatcctgcagcacaaggatgaattgaatgctgaccatccctttatttacatcatcaggcacaacaaaactcgaaacatcattttctttggcaaattctgttctccttaagtggcatagcccatgttaagtcctccctgacttttctgtggatgccgatttctgtaaactctgcatccagagattcattttctagatacaataaattgctaatgttgctggatcaggaagccgccagtacttgtcatatgtagccttcacacagatagacctttttttttttccaattctatcttttgtttccttttttcccataagacaatgacatacgcttttaatgaaaaggaatcacgttagaggaaaaatatttattcattatttgtcaaattgtccggggtagttggcagaaatacagtcttccacaaagaaaattcctataaggaagatttggaagctcttcttcccagcactatgctttccttctttgggatagagaatgttccagacattctcgcttccctgaaagactgaagaaagtgtagtgcatgggacccacgaaactgccctggctccagtgaaacttgggcacatgctcaggctactataggtccagaagtccttatgttaagccctggcaggcaggtgtttattaaaattctgaattttggggattttcaaaagataatattttacatacactgtatgttatagaacttcatggatcagatctggggcagcaacctataaatcaacaccttaatatgctgcaacaaaatgtagaatattcagacaaaatggatacataaagactaagtagcccataaggggtcaaaatttgctgccaaatgcgtatgccaccaacttacaaaaacacttcgttcgcagagcttttcagattgtggaatgttggataaggaattatagacctctagtagctgaaatgcaagaccccaagaggaagttcagatcttaatataaattcactttcatttttgatagctgtcccatctggtcatgtggttggcactagactggtggcaggggcttctagctgactcgcacagggattctcacaatagccgatatcagaatttgtgttgaaggaacttgtctcttcatctaatatgatagcgggaaaaggagaggaaactactgcctttagaaaatataagtaaagtgattaaagtgctcacgttaccttgacacatagtttttcagtctatgggtttagttactttagatggcaagcatgtaacttatattaatagtaatttgtaaagttgggtggataagctatccctgttgccggttcatggattacttctctataaaaaatatatatttaccaaaaaattttgtgacattccttctcccatctcttccttgacatgcattgtaaataggttcttcttgttctgagattcaatattgaatttctcctatgctattgacaataaaatattattgaactacc

SEQ ID NO: 59330 - DNA, 2876 bp, Homo sapiens
gaattcctgcagctcagcagccgccgccagagcaggacgaaccgccaatcgcaaggcacctctgagaacttcaggatgcagatgtctccagccctcacctgcctagtcctgggcctggcccttgtctttggtgaagggtctgctgtgcaccatcccccatcctacgtggcccacctggcctcagacttcggggtgagggtgtttcagcaggtggcgcaggcctccaaggaccgcaacgtggttttctcaccctatggggtggcctcggtgttggccatgctccagctgacaacaggaggagaaacccagcagcagattcaagcagctatgggattcaagattgatgacaagggcatggcccccgccctccggcatctgtacaaggagctcatggggccatggaacaaggatgagatcagcaccacagacgcgatcttcgtccagcgggatctgaagctggtccagggcttcatgccccacttcttcaggctgttccggagcacggtcaagcaagtggacttttcagaggtggagagagccagattcatcatcaatgactgggtgaagacacacacaaaaggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatactgagttcaccacgcccgatggccattactacgacatcctggaactgccctaccacggggacaccctcagcatgttcattgctgccccttatgaaaaagaggtgcctctctctgccctcaccaacattctgagtgcccagctcatcagccactggaaaggcaacatgaccaggctgccccgcctcctggttctgcccaagttctccctggagactgaagtcgacctcaggaagcccctagagaacctgggaatgaccgacatgttcagacagtttcaggctgacttcacgagtctttcagaccaagagcctctccacgtcgcgcaggcgctgcagaaagtgaagatcgaggtgaacgagagtggcacggtggcctcctcatccacagctgtcatagtctcagcccgcatggcccccgaggagatcatcatggacagacccttcctctttgtggtccggcacaaccccacaggaacagtccttttcatgggccaagtgatggaaccctgaccctggggaaagacgccttcatctgggacaaaactggagatgcatcgggaaagaagaaactccgaagaaaagaattttagtgttaatgactctttctgaaggaagagaagacatttgccttttgttaaaagatggtaaaccagatctgtctccaagaccttggcctctccttggaggacctttaggtcaaactccctagtctccacctgagaccctgggagagaagtttgaagcacaactcccttaaggtctccaaaccagacggtgacgcctgcgggaccatctggggcacctgcttccacccgtctctctgcccactcgggtctgcagacctggttcccactgaggccctttgcaggatggaactacggggcttacaggagcttttgtgtgcctggtagaaactatttctgttccagtcacattgccatcactcttgtactgcctgccaccgcggaggaggctggtgacaggccaaaggccagtggaagaaacaccctttcatctcagagtccactgtggcactggccacccctccccagtacaggggtgctgcaggtggcagagtgaatgtcccccatcatgtggcccaactctcctggcctggccatctccctccccagaaacagtgtgcatgggttattttggagtgtaggtgacttgtttactcattgaagcagatttctgcttccttttatttttataggaatagaggaagaaatgtcagatgcgtgcccagctcttcaccccccaatctcttggtggggaggggtgtacctaaatatttatcatatccttgcccttgagtgcttgttagagagaaagagaactactaaggaaaataatattatttaaactcgctcctagtgtttctttgtggtctgtgtcaccgtatctcaggaagtccagccacttgactggcacacacccctccggacatccagcgtgacggagcccacactgccaccttgtggccgcctgagaccctcgcgccccccgcgccccccgcgcccctctttttccccttgatggaaattgaccatacaatttcatcctccttcaggggatcaaaaggacggagtggggggacagagactcagatgaggacagagtggtttccaatgtgttcaatagatttaggagcagaaatgcaaggggctgcatgacctaccaggacagaactttccccaattacagggtgactcacagccgcattggtgactcacttcaatgtgtcatttccggctgctgtgtgtgagcagtggacacgtgaggggggggtgggtgagagagacaggcagctcggattcaactaccttagataatatttctgaaaacctaccagccagagggtagggcacaaagatggatgtaatgcactttgggaggccaaggcgggaggattgcttgagcccaggagttcaagaccagcctgggcaacataccaagacccccgtctctttaaaaatatatatattttaaatatacttaaatatatatttctaatatctttaaatatatatatatattttaaagaccaatttatgggagaattgcacacagatgtgaaatgaatgtaatctaatagaagc

SEQ ID NO: 59331 - DNA, 1336 bp, Homo sapiens
gagagacacagagtccggcattggtcccaggcagcagttagcccgccgcccgcctgtgtgtccccagagccatggagagagccagtctgatccagaaggccaagctggcagagcaggccgaacgctatgaggacatggcagccttcatgaaaggcgccgtggagaagggcgaggagctctcctgcgaagagcgaaacctgctctcagtagcctataagaacgtggtgggcggccagagggctgcctggagggtgctgtccagtattgagcagaaaagcaacgaggagggctcggaggagaaggggcccgaggtgcgtgagtaccgggagaaggtggagactgagctccagggcgtgtgcgacaccgtgctgggcctgctggacagccacctcatcaaggaggccggggacgccgagagccgggtcttctacctgaagatgaagggtgactactaccgctacctggccgaggtggccaccggtgacgacaagaagcgcatcattgactcagcccggtcagcctaccaggaggccatggacatcagcaagaaggagatgccgcccaccaaccccatccgcctgggcctggccctgaacttttccgtcttccactacgagatcgccaacagccccgaggaggccatctctctggccaagaccactttcgacgaggccatggctgatctgcacaccctcagcgaggactcctacaaagacagcaccctcatcatgcagctgctgcgagacaacctgacactgtggacggccgacaacgccggggaagaggggggcgaggctccccaggagccccagagctgagtgttgcccgccaccgccccgccctgccccctccagtcccccaccctgccgagaggactagtatggggtgggaggccccacccttctcccctaggcgctgttcttgctccaaagggctccgtggagagggactggcagagctgaggccacctggggctggggatcccactcttcttgcagctgttgagcgcacctaaccactggtcatgcccccacccctgctctccgcacccgcttcctcccgaccccaggaccaggctacttctcccctcctcttgcctccctcctgcccctgctgcctctgatcgtaggaattgaggagtgtcccgccttgtggctgagaactggacagtggcaggggctggagatgggtgtgtgtgtgtgtgtgtgtgtgtgtgtgtgtgtgcgcgcgcgccagtgcaagaccgagattgagggaaagcatgtctgctgggtgtgaccatgtttcctctcaataaagttcccctgtgacactcaaaaaaaaaaaaaaaaaaaaa

SEQ ID NO: 59332 - DNA, 2725 bp, Homo sapiens
agtaagcactctcccttgtcgtggaggtgggcaaatctttatcagccactgccttctgctgccaggaagccagctagagtggtctttaaagaaaactgggcatctcctgctacttaaaatcaaaaactacctaaaataaagattatagagccagaggaagagatagccatggaggacagccccactatggttagagtggacagccccactatggttaggggtgaaaaccaggtttcgccatgtcaagggagaaggtgcttccccaaagctcttggctatgtcaccggtgacatgaaagaacttgccaaccagcttaaagacaaacccgtggtgctccagttcattgactggattctccggggcatatcccaagtggtgttcgtcaacaaccccgtcagtggaatcctgattctggtaggacttcttgttcagaacccctggtgggctctcactggctggctgggaacagtggtctccactctgatggccctcttgctcagccaggacaggtcattaatagcatctgggctctatggctacaatgccaccctggtgggagtactcatggctgtcttttcggacaagggagactatttctggtggctgttactccctgtatgtgctatgtccatgacttgcccaattttctcaagtgcattgaattccatgctcagcaaatgggacctccccgtcttcaccctccctttcaacatggcgttgtcaatgtacctttcagccacaggacattacaatccgttctttccagccaaactggtcatacctataactacagctccaaatatctcctggtctgacctcagtgccctggagttgttgaaatctataccagtgggagttggtcagatctatggctgtgataatccatggacagggggcattttcctgggagccatcctactctcctccccactcatgtgcctgcatgctgccataggatcattgctgggcatagcagcgggactcagtctttcagccccatttgagaacatctactttggactctggggtttcaacagctctctggcctgcattgcaatgggaggaatgttcatggcgctcacctggcaaacccacctcctggctcttggctgtgccctgttcacggcctatcttggagtcggcatggcaaactttatggctgaggttggattgccagcttgtacctggcccttctgtttggccacgctattgttcctcatcatgaccacaaaaaattccaacatctacaagatgcccctcagtaaagttacttatcctgaagaaaaccgcatcttctacctgcaagccaagaaaagaatggtggaaagccctttgtgagaacaagccccatttgcagccatggtcacgagtcatttctgcctgactgctccagctaacttccagggtctcagcaaactgctgtttttcacgagtatcaactttcatactgacgcgtctgtaatctgttcttatgctcattttgtattttcctttcaactccaggaatatccttgagcatatgagagtcacatccaggtgatgtgctctggtatggaatttgaaaccccaatggggccttggcactaagactggaatgtatataaagtcaaagtgctccaacagaaggaggaagtgaaaacaaactattagtatttattgatattcttggtgtttagctggctcgatgatgttaacagtattaaaaattaaacccccataaacccaacctaagcctatggaatccacagtcacaaaatcgaagttaacccagaatctgtgataagcagcttggctttttttttaaatcaatgcaagtacaccattatagccagaatctgtatcacagaggtgcaagctgacagcagagctcagtccccacttcctgcaaacaatggcctgcaccctatcccttgtgtgtgtgacattctctcatgggacaatgttggggtttttcagactgacaggactgcaagagggagaaaggaattttgtcaatcaaaattattctgtattgcaacttttctcagagattgcaaaggattttttaggtagagattatttttccttatgaaaaatgatctgttttaaatgagataaaataggagaagttcctggcttaacctgttcttacatattaaagaaaagttacttactgtatttatgaaatactcagcttaggcatttttactttaacccctaaattgattttgtaaatgccacaaatgcatagaattgttaccaacctccaaagggctctttaaaatcatatttttttattcatttgaggatgtcttataaagactgaaggcaaaggtcagaatgcttacgggtgttatttttataagttgttgaattccttaatttagaaaagctcattattttttgcacactcacaatattctctctcagaaatcaatggcatttgaaccaccaaaaagaaataaagggctgagtgtggtgctcacgcctgtaatcccagcactttggggagcccaggcgggcagattgcttgaacccaggagttcaagaccagcctgggcagcatggtgaaaccctgtatctacaaaaaatacaaaaattagccaggcatggtggtgggtgcctgtagttccagctacttgggaggctgaggtgggaaaatgacttgagcccaggaggaggaggctgcagtgagctaagattgcaccactgcactccaacctgggtgacaagagtgaaactgaat

SEQ ID NO: 59333 - DNA, 4227 bp, Homo sapiens
gcatgtacacgcgcacccgcacccgcgcgcctgtatcccgtgctgtttccctggcagacacacaggcgctcacgagtctctccttgccagcctgcagggcggcgacccccaaaacccagctccgggtcccaacctaggcaagaagctgcttctctgccaacagctcctcttcggcctccgtcacagccacctggaccctaccctttcgcgactgctgctgctgctgcccggacgtggaagcagcaagaggcgcttggtcaagacacactgacggtacctacagaatactggacatacggattcagaatccataaggctttatcaccttgaatcaaggatttatttgatatcatcctcggtctttacttcctatcaagtaacattgttttgaaaaatagagttaacacatttgccataagggagtttttttttttttttttaaatacttcgcatactctccaatgcccaaaaatagcaaggtggtaaaaagagaattagatgatgatgttactgagtctgtcaaagaccttctttccaatgaagacgcagctgatgatgcttttaagacaagtgaactaattgttgatggccaggaagagaaagatacagatgttgaagaaggatctgaagtcgaagatgaaagaccagcttggaacagtaaactacaatacatcctggcccaagttggattttctgtaggtttaggaaatgtgtggcgatttccatacctatgtcagaagaatgggggcggtgcatatcttttaccatatttaatactacttatggtaataggtattcccctttttttcttggaactctctgtgggtcaaagaattcggcgaggcagcattggtgtatggaattacataagccctaaactgggcgggattggatttgcaagttgtgtagtgtgctattttgtagctctctactacaacgtcatcattggctggagtttgttttatttttctcagtcttttcagcaacccctgccttgggatcagtgtcctttggtgaaaaatgcttcacacacttttgtagaaccagaatgtgaacaaagttctgccaccacctattactggtacagggaagcactgaatatttcaagttccatttctgaaagtgggggcttaaactggaagatgaccatctgcttgttggctgcctgggtcatggtttgcttggctatgatcaaaggcattcagtcttctggaaaagttagtatgttagagcccttcctcattctgctaatcaccatttctggattcatccctctctcaaattctgttacagatttctgtgggcaaatcacacataacacttcattctaggtagttaaatattagtgaaaagtgacacttcaaaagtgtgcttacatttttaaaaagacaaataaaaacagtgttttatagtgaaatctaaggttaattataatctttccttatttcaacaagatctttaaaatttttgtgaatacttaaaagtcctttctttttgccctttattcaattagtcctaatgtttcagttctctaattaccaattagttaaattatggaaattggggaaagtggtaaaatgagtaattcattcattttgtttgtttgatatcatttgtttctctctgctgtaggtgttctaaggaatagctgcataagacattttgaaataatgtaatgtgaagtgtttcttaaagctctgaacatcattaagtagttaataataattccaacaaggaattcagagtaatgtaaaagactaaatatcattccttctaaggcaaattgaaaattagaatggttgtggtttaaaaagacattaagtgaattctaggtagcttgtttgttattatttttaaaggacgctctaggaaagtaattgctattcactattttgctttcgtattacttttttttttttttttcattatcacagccattgttctaaagctctccacatctcttggctggatcatagcaagaatttactgttggctcttctctctgccgtttaactgtccagctgtgctattttccttttcaaagtataactgatttcaggctaacttattaccactcatcatcatatactagcaggaatggcaatagtagtagtagtagcagcagcaatagtagaagtagtcataataacaataataataaatgatgataaagatgtttctgacaagaattagggtaagaacagtaattgaagccaattatttattacaaatgtattttgctttgggtactgtgataactactttttatactttatcccatttaattataaaaaccactcttgagaagtaatttttattttcagaaccattttacagatttaaaataaacaggtttgaggaattagtttaacttatccaaagtttcgtggctattaagttctagtatttggagtcaaatgcaagtctgtctaaatctagagcccatgttctttaactgcaacactataatgtctcaccccgtcctagtcccaccaattagtcaactcttttagggcagaagtctgtctaattcatctttgcttcctgttactttatatttaattaaaaattttagtgactttttaacttgtaaattgtagctgattttacatttatcttcctgaaggaaactctgtatcattttgtcttttgaatttgtgaatatacttgttaacacatctaaatatctttaagtctttggcaatgttattgtattatatgactaaataacttcgaattgttcaattgtgtatgtcttccactatgtcagagccacattcccgtcacattataaatgaaggagtggattcttaaataagacctaaccatatttatatgattcctaacataatatcatttggtagaaagaaaaccaactgtggtcatccagagaagctcaaaaactcttgtactcaggttctcttactaccacgttttgtttctgtttcttcttagtctgtgtcttagcatcacttaaagaactattcatccttttcttatcacagaatcttggggttgttcttctcatgtcatgtagtgtaaatttatatagaaaatgtaatacaatttatttagtacatacatttattattttaatgagaatgcctcaggaaaagactagtatttgggcaatatttgaagaaagaatttaacaggcactgatggggagaaagctagctgtaggtaatgtgagcaaagatgtggaagccaaaattgtcacaattcctcaatctgaaacaatgagttaaatataataacaatgactttatgaggaattaaaggttaagctttgtgtttacctactaaacagaaaatgcctccaaataaacagtgtcacaagtacagaagagagaaatattgtttaaggctagcacatggaaaaacaacttagaggatttagcagctaaaagaagaatgagtcagctggtgatgtgcttggtcaaaacacacagtcatacatgcatatacatataccccaaaatgctaagtggaaactgcatgaattaaaagaggggtatgatagggacattgtcctttgggctaggtaggcacatatcagttggaccacatctgcaatactggattttactgaaatcttgtattttcctttttattatgagaaatttcagctcagtgatcaaagtcttcaaatagttaaaccaaaagaagaatagggctgctttgtgtggccatagagagcaaaactatgatcaaatagtgggtattatggaggaggttgtgatggtggtaagccttcaaagaaagaaaggcctttcaagaatcaaacttgataataatgaaatcagttgcctcaatggtagagagctcagcatcactggaggtggtcacacagaggtagcatgtgccctagttacagaatctattaaggggatgactgtctcaaatatgtaggacagaaatgagaagccccaagcttgcttttaactctaaggtagtattttctactctgactactttcctgttgttactactactatgctaaatactatgcatacattatcttgtttattctttctatcagctagataatttgcatattttatccccattttactgcaaagttgacaagctcagggaaaataaatagttggccagaattaagcaaccaatacatgatagacagggctaaaactgggctacagaattttcaaaaagaatgatacattctgaaggtatgtttataataaacatttttcatatgtaaaa

SEQ ID NO: 59334 - DNA, 1168 bp, Homo sapiens
gcggagttcgtctctgcaagcttggtcgccctgggatggattcctcctcctcttcctccgcggcgggtttgggtgcagtggacccacagttgcagcatttcatcgaggtagagactcaaaagcagcgcttccagcagctggtgcaccagatgactgaactttgttgggagaagtgcatggacaagcctgggccaaagttggacagtcgggctgaggcctgttttgtgaactgcgttgagcgcttcattgatacaagccagttcatcttgaatcgactggaacagacccagaaatccaagccagttttctcagaaagcctttctgactgatctcagcattacctctttggaaaaggaaggtagttcaagaaatgaagagctgttgatgggatgattgaagaaacagctatgagaggattggctcccatcttttgttactcttgggacatcctgtcatctgagaatgaacaaagaccaattttttgtgtgtgaagcttaagggtcatatgtttgcttgtattttttaatgctaatcttgtgaaaataattgacaggcgaaagaaaactctatttagatgcatattactgtacatgggactatgcttttctcaaagccccattaactgcttcctataattttgatagtgggaccacatacgtaaaaatctctcatttgtgtggagtcatttctgatttcaggggagatccttgtgtttatcagaaagggcagaagtaggggaagaataatttggtatccttatctagtgtttgattgtcaatgctggagaaaaatatctgtaagagtgtttatacagtacacttcagttatcttgatctccctttcctatatgatgatttgcttaaatatccatattaagtaagtctcaaggtagggtaggcagcctgagagtctagaggcctttagttataaaggaatctagccagtgaacataattcttattactagactgccacaaggaagaaattaacttaccctgtatatcagggtacaaaaaattcagtgatgtgcctaaataagttataaagatttaggccaatcagaagctaacagcagtttcaggtagaggtgcatgcctaatgttagttagtgtagattccatttactgcattcttctgatcactgaaataaaagctatataagattcata

SEQ ID NO: 59335 - DNA, 4932 bp, Homo sapiens
cccggctttatatctatatatacacaggtatatgtgtatattttatataattgttctccgttcgttgatatcaaagacagttgaaggaaatgaattttgaaacttcacggtgtgccaccctacagtactgccctgacccttacatccagcgtttcgtagaaaccccagctcatttctcttggaaagaaagttattaccgatccaccatgtcccagagcacacagacaaatgaattcctcagtccagaggttttccagcatatctgggattttctggaacagcctatatgttcagttcagcccattgacttgaactttgtggatgaaccatcagaagatggtgcgacaaacaagattgagattagcatggactgtatccgcatgcaggactcggacctgagtgaccccatgtggccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcagtttcttagcgaggttgggctgttcatcatgtctggactatttcacgacccaggggctgaccaccatctatcagattgagcattactccatggatgatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtgagcctcaccatgtgagctcttcctatccctctcctaactgccagccccctaaaagcactcctgcttaatcttcaaagccttctccctagctcctccccttcctcttgtctgatttcttaggggaaggagaagtaagaggctacctcttacctaacatctgacctggcatctaattctgattctggctttaagccttcaaaactatagcttgcagaactgtagctgccatggctaggtagaagtgagcaaaaaagagttgggtgtctccttaagctgcagagatttctcattgacttttataaagcatgttcacccttatagtctaagactatatatataaatgtataaatatacagtatagatttttgggtggggggcattgagtattgtttaaaatgtaatttaaatgaaagaaaattgagttgcacttattgaccattttttaatttacttgttttggatggcttgtctatactccttcccttaaggggtatcatgtatggtgataggtatctagagcttaatgctacatgtgagtgacgatgatgtacagattctttcagttctttggattctaaatacatgccacatcaaacctttgagtagatccatttccattgcttattatgtaggtaagactgtagatatgtattcttttctcagtgttggtatattttatattactgacatttcttctagtgatgatggttcacgttggggtgatttaatccagttataagaagaagttcatgtccaaacgtcctctttagtttttggttgggaatgaggaaaattcttaaaaggcccatagcagccagttcaaaaacacccgacgtcatgtatttgagcatatcagtaacccccttaaatttaataccagataccttatcttacaatattgattgggaaaacatttgctgccattacagaggtattaaaactaaatttcactactagattgactaactcaaatacacatttgctactgttgtaagaattctgattgatttgattgggatgaatgccatctatctagttctaacagtgaagttttactgtctattaatattcagggtaaataggaatcattcagaaatgttgagtctgtactaaacagtaagatatctcaatgaaccataaattcaactttgtaaaaatcttttgaagcatagataatattgtttggtaaatgtttcttttgtttggtaaatgtttcttttaaagaccctcctattctataaaactctgcatgtagaggcttgtttacctttctctctctaaggtttacaataggagtggtgatttgaaaaatataaaattatgagattggttttcctgtggcataaattgcatcactgtatcattttcttttttaaccggtaagagtttcagtttgttggaaagtaactgtgagaacccagtttcccgtccatctcccttagggactacccatagacatgaaaggtccccacagagcaagagataagtctttcatggctgctgttgcttaaaccacttaaacgaagagttcccttgaaactttgggaaaacatgttaatgacaatattccagatctttcagaaatataacacatttttttgcatgcatgcaaatgagctctgaaatcttcccatgcattctggtcaagggctgtcattgcacataagcttccattttaattttaaagtgcaaaagggccagcgtggctctaaaaggtaatgtgtggattgcctctgaaaagtgtgtatatattttgtgtgaaattgcatactttgtattttgattattttttttttcttcttgggatagtgggatttccagaaccacacttgaaacctttttttatcgtttttgtattttcatgaaaataccatttagtaagaataccacatcaaataagaaataatgctacaattttaagaggggagggaagggaaagtttttttttattatttttttaaaattttgtatgttaaagagaatgagtccttgatttcaaagttttgttgtacttaaatggtaataagcactgtaaacttctgcaacaagcatgcagctttgcaaacccattaaggggaagaatgaaagctgttccttggtcctagtaagaagacaaactgcttcccttactttgctgagggtttgaataaacctaggacttccgagctatgtcagtactattcaggtaacactagggccttggaaattcctgtactgtgtctcatggatttggcactagccaaagcgaggcacccttactggcttacctcctcatggcagcctactctccttgagtgtatgagtagccagggtaaggggtaaaaggatagtaagcatagaaaccattagaaagtgggcttaatggagttcttgtggcctcagctcaatgcagttagctgaagaattgaaaagtttttgtttggagacgtttataaacagaaatggaaagcagagttttcattaaatccttttaccttttttttttcttggtaatcccctaaaataacagtatgtgggatattgaatgttaaagggatatttttttctattatttttataattgtacaaaattaagcaaatgttaaaagttttatatgctttattaatgttttcaaaaggtattatacatgtgatacattttttaagcttcagttgcttgtcttctggtactttctgttatgggcttttggggagccagaagccaatctacaatctctttttgtttgccaggacatgcaataaaatttaaaaaataaataaaaactaattaagaaaaaaaaaaaaaaaaaaaaaaaaaaaaa

SEQ ID NO: 59336 - DNA, 1033 bp, Homo sapiens
cgggcgatgcctccgctctgggccctgctggccctcggctgcctgcggttcggctcggctgtgaacctgcagccccaactggccagtgtgactttcgccaccaacaaccccacacttaccactgtggccttggaaaagcctctctgcatgtttgacagcaaagaggccctcactggcacccacgaggtctacctgtatgtcctggtcgactcagccatttccaggaatgcctcagtgcaagacagcaccaacaccccactgggctcaacgttcctacaaacagagggtgggaggacaggtccctacaaagctgtggcctttgacctgatcccctgcagtgacctgcccagcctggatgccattggggatgtgtccaaggcctcacagatcctgaatgcctacctggtcagggtgggtgccaacgggacctgcctgtgggatcccaacttccagggcctctgtaacgcacccctgtcggcagccacggagtacaggttcaagtatgtcctggtcaatatgtccacgggcttggtagaggaccagaccctgtggtcagaccccatccgcaccaaccagctcaccccatactcgacgatcgacacgtggccaggccggcggagcggaggcatgatcgtcatcacttccatcctgggctccctgcccttctttctacttgtgggttttgctggcgccattgccctcagcctcgtggacatggggagttctgatggggaaacgactcacgactcccaaatcactcaggaggctgttcccaagtcgctgggggcctcggagtcttcctacacgtccgtgaaccgggggccgccactggacagggctgaggtgtattccagcaagctccaagactgagcccagcaccacccctgggcagcagcatcctcctctctggccttgccccaggccctgcagcggtggttgtcacaccctgacttcagggaaggtgaaacagggcttgtccctccaactgcaggaaaacccttaataaaatcttctgatgagttctaaaaaaaaa

SEQ ID NO: 59337 - DNA, 1307 bp, Homo sapiens
cctgagtcccgggaggaaagtgctcgcccattcctgacctgtgacacgctcactgcgaaggcaggttattagaagagtcccatgaaaggtggctccacggtcccagcgacatgcaggggctcctcttctccactcttctgcttgctggcctggcacagttctgctgcagggtacagggcactggaccattagatacaacacctgaaggaaggcctggagaagtgtcagatgcacctcagcgtaaacagttttgtcactggccctgcaaatgccctcagcagaagccccgttgccctcctggagtgagcctggtgagagatggctgtggatgctgtaaaatctgtgccaagcaaccaggggaaatctgcaatgaagctgacctctgtgacccacacaaagggctgtattgtgactactcagtagacaggcctaggtacgagactggagtgtgtgcataccttgtagctgttgggtgcgagttcaaccaggtacattatcataatggccaagtgtttcagcccaaccccttgttcagctgcctctgtgtgagtggggccattggatgcacacctctgttcataccaaagctggctggcagtcactgctctggagctaaaggtggaaagaagtctgatcagtcaaactgtagcctggaaccattactacagcagctttcaacaagctacaaaacaatgccagcttatagaaatctcccacttatttggaaaaaaaaatgtcttgtgcaagcaacaaaatggactccctgctccagaacatgtgggatgggaatatctaacagggtgaccaatgaaaacagcaactgtgaaatgagaaaagagaaaagactgtgttacattcagccttgcgacagcaatatattaaagacaataaagattcccaaaggaaaaacatgccaacctactttccaactctccaaagctgaaaaatttgtcttttctggatgctcaagtactcagagttacaaacccactttttgtggaatatgcttggataagagatgctgtatccctaataagtctaaaatgattactattcaatttgattgcccaaatgaggggtcatttaaatggaagatgctgtggattacatcttgtgtgtgtcagagaaactgcagagaacctggagatatattttctgagctcaagattctgtaaaaccaagcaaatgggggaaaagttagtcaatcctgtcatataataaaaaaattagtgagtaaaaaaaaaaaaaaaaaaaaaaaaaaaaaaaaaaaaaaaaaaaaaaaaaaagaaaaaaaaaaaaaaaaaaaa

SEQ ID NO: 59338 - DNA, 1068 bp, Homo sapiens
atgaagatatctaggggcagagtgtgcttggagtcagagaacaaggacgctggtgtggctggtcgtaaacagttttgtcactggccctgcaaatgccctcagcagaagccccgttgccctcctggagtgagcctggtgagagatggctgtggatgctgtaaaatctgtgccaagcaaccaggggaaatctgcaatgaagctgacctctgtgacccacacaaagggctgtattgtgactactcagtagacaggcctaggtacgagactggagtgtgtgcatgtaagtctgttgggtgcgagttcaaccaggtacattatcataatggccaagtgtttcagcccaaccccttgttcagctgcctctgtgtgagtggggccattggatgcacacctctgttcataccaaagctggctggcagtcactgctctggagctaaaggtggaaagaagtctgatcagtcaaactgtagcctggaaccattactacagcagctttcaacaagctacaaaacaatgccagcttatagaaatctcccacttatttggaaaaaaaaatgtcttgtgcaagcaacaaaatggactccctgctccagaacatgtgggatgggaatatctaacagggtgaccaatgaaaacagcaactgtgaaatgagaaaagagaaaagactgtgttacattcagccttgcgacagcaatatattaaagacaataaagattcccaaaggaaaaacatgccaacctactttccaactctccaaagctgaaaaatttgtcttttctggatgctcaagtactcagagttacaaacccactttttgtggaatatgcttggataagagatgctgtatccctaataagtctaaaatgattactattcaatttgattgcccaaatgaggggtcatttaaatggaagatgctgtggattacatcttgtgtgtgtcagagaaactgcagagaacctggagatatattttctgagctcaagattctgtaaaaccaagcaaatgggggaaaagttagtcaatcctgtcatataataaaaaaattagtgagtataaaaaaaaaa

SEQ ID NO: 59339 - DNA, 1332 bp, Homo sapiens
agggtattaaaacggatccttaaaaatgaaagtgcaggctgaaagttggtagtgtgggaggtagagggtgtgtgttcttgtgcagaggagcgtggggtttgcagaggagacaggggagctttgtgtacccggagcaatgaacaagcggcgacttctctacccctcagggtggctccacggtcccagcgacatgcaggggctcctcttctccactcttctgcttgctggcctggcacagttctgctgcagggtacagggcactggaccattagatacaacacctgaaggaaggcctggagaagtgtcagatgcacctcagcgtaaacagttttgtcactggccctgcaaatgccctcagcagaagccccgttgccctcctggagtgagcctggtgagagatggctgtggatgctgtaaaatctgtgccaagcaaccaggggaaatctgcaatgaagctgacctctgtgacccacacaaagggctgtattgtgactactcagtagacaggcctaggtacgagactggagtgtgtgcataccttgtagctgttgggtgcgagttcaaccaggtacattatcataatggccaagtgtttcagcccaaccccttgttcagctgcctctgtgtgagtggggccattggatgcacacctctgttcataccaaagctggctggcagtcactgctctggagctaaaggtggaaagaagtctgatcagtcaaactgtagcctggaaccattactacagcagctttcaacaagctacaaaacaatgccagcttatagaaatctcccacttatttggaaaaaaaaatgtcttgtgcaagcaacaaaatggactccctgctccagaacatgtgggatgggaatatctaacagggtgaccaatgaaaacagcaactgtgaaatgagaaaagagaaaagactgtgttacattcagccttgcgacagcaatatattaaagacaataaagattcccaaaggaaaaacatgccaacctactttccaactctccaaagctgaaaaatttgtcttttctggatgctcaagtactcagagttacaaacccactttttgtggaatatgcttggataagagatgctgtatccctaataagtctaaaatgattactattcaatttgattgcccaaatgaggggtcatttaaatggaagatgctgtggattacatcttgtgtgtgtcagagaaactgcagagaacctggagatatattttctgagctcaagattctgtaaaaccaagcaaatgggggaaaagttagtcaatcctgtcatataataaaaaaattagtgagtataaaaaaaaaaaaaaa

SEQ ID NO: 59340 - DNA, 2210 bp, Homo sapiens
gtccagagccttgcctgcttgtgatcctggtggagaaggtggagtatggtgagctgcttgctaaggacagccaggcaacactgtgtttgtgaagatgtgctccaccttctcctctgtgcatcccagctcctcctgctgaaacagctgagcttgctttttggatttcttagactcctggcctctgagagacacctctaaggacaaactgaccttgcattgggaactttattatccagatcctcataggctttgtctactctggattgcttgttgcaacagttcttaggaagcaagattgtctcctgcaccagcatctgcctgtgtttgcttttacctactttgagcaagacccagtgaggccctagctctgttggtcctgaaaagcctgaaccctgaggctgtttctcctgcctccaaaatgcaattataggaaataagaagcacagaaacagtggaaacaaccaggaggagaaacaggaaaacctaaaattttcaatattcaaaaatacctgtcgtggtggttgatgcagaaaacactgagttcatcaaagagctttgtaattgttggaccagagaacccctttgctacaggaactgatatgttttgtctttctggcctagtcaagggaggataagtaagtatctggggcatggaaggaatgcactcttgggctgttttgcttgtatctgactcacccctgactctccagtgaagcagaaaggaagaaacctcacaccacccaggtgtggccagactttggccattattgtgaatccccaagagttaccacaggcccttcccaaatatatatttaatcttgtggttcaaataagcttttggctcacatctaagcacatcataaagaacgctgtagaagaggtgacatgatgaggcgggaagacgaggaagaggagggaacaatgatgaaggcaaaaggggacttagagatgaaggaggaggaagagattagtgagacaggagaactggttggcccttttgtgagtgctatgcccactccaatgccccacaacaagggcacccggttctctgaggcatgggaatatttccacctagctcctgctcgtgctgggcaccatcccaaccagtatgccacctgccgcctgtgtggcaggcaggtgagccgtggccctggggtcaacgtgggcaccactgcactgtggaagcatctgaaaagcatgcacagagaggagctggagaagagtggccatggtcaggctgggcagcgccaggatccaaggccccacgggccccagctccccacaggcattgagggtaactggggtaggctcctggagcaggtgggcaccatggctttgtgggccagccaaagggaaaaggaggtgcttaggagggaaagggcagtggaatggcgggagagggctgtggaaaaaagggagcgagccctggaggaggtggaaagggccatcctggagatgaagtggaaggtgagggctgagaaggaggcatgccagcgggagaaagagctgcctgcagcagtacatcccttccattttgtttaaattgggcttggagaatctattctgaaaacattgactctagacttgtagaaaagagccattttagtttcaactcaaatgtaaagcaaagtagtttggtgacattttgcttttatgtgaaatagtgcacagtatgagttaatctgagcaggtctgaattgaccaaatgcttatctacgaggttcctagagctctgctgacccttggccgaaactctaaaatgtacctattaaagataaatgcttctaccaaagtaaaactctgtgagttgtttcagggcagaatgtaccagccagtcagcgttgtttaacaaaataatcagatttttgcctagcactcggttttggtggagctgacgattttgagggctgaggctggttaggtagctggaatgtgcctatgtgaccagctcacttgcagacaccctgccggaagcagagcttaatcttcctaggactgaggtcttagcacatgtactggtggagtttccagaccaccagtatgaataaaagcttgttctgtgtgacccagcaagtggaaggacaaagaactgtgagcctcagatctttggacctttccaatgcgtctctttctcctgttattgctgcaatgtattttcttgcttatattaaagttgtttcatcagtaaaaaaaaaaaaaaaaaaaaaaaa

SEQ ID NO: 59341 - protein, 515 aa, Homo sapiens
MAPRGCAGHPPPPSPQACVCPGKMLAMGALAGFWILCLLTYGYLSWGQALEEEEEGALLAQAGEKLEPSTTSTSQPHLIFILADDQGFRDVGYHGSEIKTPTLDKLAAEGVKLENYYVQPICTPSRSQFITGKYQIHTGLQHSIIRPTQPNCLPLDNATLPQKLKEVGYSTHMVGKWHLGFNRKECMPTRRGFDTFFGSLLGSGDYYTHYKCDSPGMCGYDLYENDNAAWDYDNGIYSTQMYTQRVQQILASHNPTKPIFLYTAYQAVHSPLQAPGRYFEHYRSIININRRRYAAMLSCLDEAINNVTLALKTYGFYNNSIIIYSSDNGGQPTAGGSNWPLRGSKGTYWEGGIRAVGFVHSPLLKNKGTVCKELVHITDWYPTLISLAEGQIDEDIQLDGYDIWETISEGLRSPRVDILHNIDPYTPRQKMAPGQQAMGSGTLQSSQPSECSTGNCLQEILATATGSPLSLSATWDRTGGTMNGSPCQLAKVYGFSTSQPTHMRGWTYLTGIQES

SEQ ID NO: 59342 - protein, 994 aa, Homo sapiens
MRRRPPSRGGRGAARARETRRQPRHRSGRRMAEAISCTLNCSCQSFKPGKINHRQCDQCKHGWVAHALSKLRIPPMYPTSQVEIVQSNVVFDISSLMLYGTQAIPVRLKILLDRLFSVLKQDEVLQILHALDWTLQDYIRGYVLQDASGKVLDHWCIMTSEEEVATLQQFLRFGETKSIVELMAIQEKEEQSIIIPPSTANVDIRAFIESCSHRSSSLPTPVDKGNPSSIHPFENLISNMTFMLPFQFFNPLPPALIGSLPEQYMLEQGHDQSQDPKQEVHGPNPDSSFLTSSSTPFQVEKDQCLNCPDAITKKEDSTHLSDSSSYNIVTKFERTQLSPEAKVKPERNSLGTKKGRVFCTACEKTFYDKGTLKIHYNAVHLKIKHKCTIEGCNMVFSSLRTRNRHSANPNPRLHMPMNRNNRDKDLRNSLNLASSENYKCPGFTVTSPDCRPPPSYPGSGEDSKGQPAFPNIGQNGVLFPNLKTVQPVLPFYRSPATPAEVANTPGILPSLPLLSSSIPEQLISNEMPFDALPKKKSRKSSMPIKIEKEAVEIANEKRHNLSSDEDMPLQVVSEDEQEACSPQSHRVSEEQHVQSGGLGKPFPEGERPCHRESVIESSGAISQTPEQATHNSERETEHTPALIMVPREVEDGGHEHYFTPGMEPQVPFSDYMELQQRLLAGGLFSALSNRGMAFPCLEDSKELEHVGQHALARQIEENRFQCDICKKTFKNACSVKIHHKNMHVKEMHTCTVEGCNATFPSRRSRDRHSSNLNLHQKALSQEALESSEDHFRAAYLLKDVAKEAYQDVAFTQQASQTSVIFKGTSRMGSLVYPITQVHSASLESYNSGPLSEGTILDLSTTSSMKSESSSHSSWDSDGVSEEGTVLMEDSDGNCEGSSLVPGEDEYPICVLMEKADQSLASLPSGLPITCHLCQKTYSNKGTFRAHYKTVHLRQLHKCKVPGCNTMFSSVRSRNRHSQNPNLHKSLASSPSHLQ

SEQ ID NO: 59343 - protein, 677 aa, Homo sapiens
MLSSTDFTFASWELVVRVDHPNEEQQKDVTLRVSGDLHVGGVMLKLVEQINISQDWSDFALWWEQKHCWLLKTHWTLDKYGVQADAKLLFTPQHKMLRLRLPNLKMVRLRVSFSAVVFKAVSDICKILNIRRSEELSLLKPSGDYFKKKKKKDKNNKEPIIEDILNLESSPTASGSSVSPGLYSKTMTPIYDPINGTPASSTMTWFSDSPLTEQNCSILAFSQPPQSPEALADMYQPRSLVDKAKLNAGWLDSSRSLMEQGIQEDEQLLLRFKYYSFFDLNPKYDAVRINQLYEQARWAILLEEIDCTEEEMLIFAALQYHISKLSLSAETQDFAGESEVDEIEAALSNLEVTLEGGKADSLLEDITDIPKLADNLKLFRPKKLLPKAFKQYWFIFKDTSIAYFKNKELEQGEPLEKLNLRGCEVVPDVNVAGRKFGIKLLIPVADGMNEMYLRCDHENQYAQWMAACMLASKGKTMADSSYQPEVLNILSFLRMKNRNSASQVASSLENMDMNPECFVSPRCAKKHKSKQLAARILEAHQNVAQMPLVEAKLRFIQAWQSLPEFGLTYYLVRFKGSKKDDILGVSYNRLIKIDAATGIPVTTWRFTNIKQWNVNWETRQVVIEFDQNVFTAFTCLSADCKIVHEYIGGYIFLSTRSKDQNETLDEDLFHKLTGGQD

SEQ ID NO: 59344 - protein, 149 aa, Homo sapiens
MADQLTEEQVTEFKEAFSLFDKDGDGCITTRELGTVMRSLGQNPTEAELRDMMSEIDRDGNGTVDFPEFLGMMARKMKDTDNEEEIREAFRVFDKDGNGFVSAAELRHVMTRLGEKLSDEEVDEMIRAADTDGDGQVNYEEFVRVLVSK

SEQ ID NO: 59345 - protein, 460 aa, Homo sapiens
MNTSAPPAVSPNITVLAPGKGPWQVAFIGITTGLLSLATVTGNLLVLISFKVNTELKTVNNYFLLSLACADLIIGTFSMNLYTTYLLMGHWALGTLACDLWLALDYVASNASVMNLLLISFDRYFSVTRPLSYRAKRTPRRAALMIGLAWLVSFVLWAPAILFWQYLVGERTVLAGQCYIQFLSQPIITFGTAMAAFYLPVTVMCTLYWRIYRETENRARELAALQGSETPGKGGGSSSSSERSQPGAEGSPETPPGRCCRCCRAPRLLQAYSWKEEEEEDEGSMESLTSSEGEEPGSEVVIKMPMVDPEAQAPTKQPPRSSPNTVKRPTKKGRDRAGKGQKPRGKEQLAKRKTFSLVKEKKAARTLSAILLAFILTWTPYNIMVLVSTFCKDCVPETLWELGYWLCYVNSTINPMCYALCNKAFRDTFRLLLLCRWDKRRWRKIPKRPGSVHRTPSRQC

SEQ ID NO: 59346 - protein, 943 aa, Homo sapiens
MTQRSIAGPICNLKFVTLLVALSSELPFLGAGVQLQDNGYNGLLIAINPQVPENQNLISNIKEMITEASFYLFNATKRRVFFRNIKILIPATWKANNNSKIKQESYEKANVIVTDWYGAHGDDPYTLQYRGCGKEGKYIHFTPNFLLNDNLTAGYGSRGRVFVHEWAHLRWGVFDEYNNDKPFYINGQNQIKVTRCSSDITGIFVCEKGPCPQENCIISKLFKEGCTFIYNSTQNATASIMFMQSLSSVVEFCNASTHNQEAPNLQNQMCSLRSAWDVITDSADFHHSFPMNGTELPPPPTFSLVQAGDKVVCLVLDVSSKMAEADRLLQLQQAAEFYLMQIVEIHTFVGIASFDSKGEIRAQLHQINSNDDRKLLVSYLPTTVSAKTDISICSGLKKGFEVVEKLNGKAYGSVMILVTSGDDKLLGNCLPTVLSSGSTIHSIALGSSAAPNLEELSRLTGGLKFFVPDISNSNSMIDAFSRISSGTGDIFQQHIQLESTGENVKPHHQLKNTVTVDNTVGNDTMFLVTWQASGPPEIILFDPDGRKYYTNNFITNLTFRTASLWIPGTAKPGHWTYTLNNTHHSLQALKVTVTSRASNSAVPPATVEAFVERDSLHFPHPVMIYANVKQGFYPILNATVTATVEPETGDPVTLRLLDDGAGADVIKNDGIYSRYFFSFAANGRYSLKVHVNHSPSISTPAHSIPGSHAMYVPGYTANGNIQMNAPRKSVGRNEEERKWGFSRVSSGGSFSVLGVPAGPHPDVFPPCKIIDLEAVKVEEELTLSWTAPGEDFDQGQATSYEIRMSKSLQNIQDDFNNAILVNTSKRNPQQAGIREIFTFSPQISTNGPEHQPNGETHESHRIYVAIRAMDRNSLQSAVSNIAQAPLFIPPNSDPVPARDYLILKGVLTAMGLIGIICLIIVVTHHTLSRKKRADKKENGTKLL

SEQ ID NO: 59347 - protein, 1497 aa, Homo sapiens
MDVTKKNKRDGTEVTERIVTETVTTRLTSLPPKGGTSNGYAKTASLGGGSRLEKQSLTHGSSGYINSTGSTRGHASTSSYRRAHSPASTLPNSPGSTFERKTHVTRHAYEGSSSGNSSPEYPRKEFASSSTRGRSQTRESEIRVRLQSASPSTRWTELDDVKRLLKGSRSASVSPTRNSSNTLPIPKKGTVETKIVTASSQSVSGTYDATILDANLPSHVWSSTLPAGSSMGTYHNNMTTQSSSLLNTNAYSAGSVFGVPNNMASCSPTLHPGLSTSSSVFGMQNNLAPSLTTLSHGTTTTSTAYGVKKNMPQSPAAVNTGVSTSAACTTSVQSDDLLHKDCKFLILEKDNTPAKKEMELLIMTKDSGKVFTASPASIAATSFSEDTLKKEKQAAYNADSGLKAEANGDLKTVSTKGKTTTADIHSYSSSGGGGSGGGGGVGGAGGGPWGPAPAWCPCGSCCSWWKWLLGLLLTWLLLLGLLFGLIALAEEVRKLKARVDELERIRRSILPYGDSMDRIEKDRLQGMAPAAGADLDKIGLHSDSQEELWMFVRKKLMMEQENGNLRGSPGPKGDMGSPGPKGDRGFPGTPGIPGPLGHPGPQGPKGQKGSVGDPGMEGPMGQRGREGPMGPRGEAGPPGSGEKGERGAAGEPGPHGPPGVPGSVGPKGSSGSPGPQGPPGPVGLQGLRGEVGLPGVKGDKGPMGPPGPKGDQGEKGPRGLTGEPGMRGLPGAVGEPGAKGAMGPAGPDGHQGPRGEQGLTGMPGIRGPPGPSGDPGKPGLTGPQGPQGLPGTPGRPGIKGEPGAPGKIVTSEGSSMLTVPGPPGPPGAMGPPGPPGAPGPAGPAGLPGHQEVLNLQGPPGPPGPRGPPGPSIPGPPGPRGPPGEGLPGPPGPPGSFLSNSETFLFGPPGPPGPPGPKGDQGPPGPRGHQGEQGLPGFSTSGSSSFGLNLQGPPGPPGPQGPKGDKGDPGVPGALGIPSGPSEGGSSSTMYVSGPPGPPGPPGPPGSISSSGQEIQQYISEYMQSDSIRSYLSGVQGPPGPPGPPGPVTTITGETFDYSELASHVVSYLRTSGYGVSLFSSSISSEDILAVLQRDDVRQYLRQYLMGPRGPPGPPGASGDGSLLSLDYAELSSRILSYMSSSGISIGLPGPPGPPGLPGTSYEELLSLLRGSEFRGIVGPPGPPGPPGIPGNVWSSISVEDLSSYLHTAGLSFIPGPPGPPGPPGPRGPPGVSGALATYAAENSDSFRSELISYLTSPDVRSFIVGPPGPPGPQGPPGDSRLLSTDASHSRGSSSSSHSSSVRRGSSYSSSMSTGGGGAGSLGAGGAFGEAAGDRGPYGTDIGPGGGYGAAAEGGMYAGNGGLLGADFAGDLDYNELAVRVSESMQRQGLLQGMAYTVQGPPGQPGPQGPPGISKVFSAYSNVTADLMDFFQTYGAIQGPPGQKGEMGTPGPKGDRGPAGPPGHPGPPGPRGHKGEKGDKGDQVYAGRRRRRSIAVKP

SEQ ID NO: 59348 - protein, 520 aa, Homo sapiens
MSLLSLSWLGLRPVAASPWLLLLVVGASWLLARILAWTYAFYHNGRRLRCFPQPRKQNWFLGHLGLVTPTEEGLRVLTQLVATYPQGFVRWLGPITPIINLCHPDIVRSVINTSDAITDKDIVFYKTLKPWLGDGLLLSVGDKWRHHRRLLTPAFHFNILKPYIKIFSKSANIMHAKWQRLAMEGSTCLDVFEHISLMTLDSLQKCIFSFDSNCQEKPSEYITAIMELSALVVKRNNQFFRYKDFLYFLTPCGRRFHRACRLVHDFTDAVIQERRRTLTSQGVDDFLQAKAKSKTLDFIDVLLLSEDKNGKELSDEDIRAEADTFMFGGHDTTASGLSWVLYNLARHPEYQERCRQEVQELLKDREPKEIEWDDLAQLPFLTMCLKESLRLHPPIPTFARGCTQDVVLPDSRVIPKGNVCNINIFAIHHNPSVWPDPEVYDPFRFDPENAQKRSPMAFIPFSAGPRNCIGQKFAMAEMKVVLALTLLRFRILPDHREPRRTPEIVLRAEDGLWLRVEPLG

SEQ ID NO: 59349 - protein, 149 aa, Homo sapiens
MSTNICSFKDRCVSILCCKFCKQVLSSRGMKAVLLADTEIDLFSTDIPPTNAVDFTGRCYFTKICKCKLKDIACLKCGNIVGYHVIVPCSSCLLSCNNRHFWMFHSQAVYDINRLDSTGVNVLLRGNLPEIEESTDEDVLNISAEECIR

SEQ ID NO: 59350 - protein, 531 aa, Homo sapiens
MLPITDRLLHLLGLEKTAFRIYAVSTLLLFLLFFLFRLLLRFLRLCRSFYITCRRLRCFPQPPRRNWLLGHLGMYLPNEAGLQDEKKVLDNMHHVLLVWMGPVLPLLVLVHPDYIKPLLGASAATAPKDDLFYGFLKPWLGDGLLLSKGDKWSRHRRLLTPAFHFDILKPYMKIFNQSADIMHAKWRHLAEGSAVSLDMFEHISLMTLDSLQKCVFSYNSNCQEKMSDYISAIIELSALSVRRQYRLHHYLDFIYYRSADGRRFRQACDMVHHFTTEVIQERRRALRRQGAEAWLKAKQGKTLDFIDVLLLARDEDGKELSDEDIRAEADTFMFEGHDTTSSGISWMLFNLAKYPEYQEKCREEIQEVMKGRELEELEWDDLTQLPFTTMCIKESLRQYPPVTLVSRQCTEDIKLPDGRIIPKGIICLVSIYGTHHNPTVWPDSKVYNPYRFDPDNPQQRSPLAYVPFSAGPRNCIGQSFAMAELRVVVALTLLRFRLSVDRTRKVRRKPELILRTENGLWLKVEPLPPRA

SEQ ID NO: 59351 - protein, 633 aa, Homo sapiens
MESGPKMLAPVCQVENNNEQLLVNQQAIQILEKISQPVVVVAIVGLYRTGKSYLMNHLAGQNHGFPLGSTVQSETKGIWMWCVPHPSKPNHTLVLLDTEGLGDVEKGDPKNDSWIFALAVLLCSTFVYNSMSTINHQALEQLHYVTELTELIKAKSSPRPDGVEDSTEFVSFFPDFLWTVRDFTLELKLNGHPITEDEYLENALKLIQGNNPRVQTSNFPRECIRRFFPKRKCFVFDRPTNDKDLLANIEKVSEKQLDPKFQEQTNIFCSYIFTHARTKTLREGITVTGNRLGTLAVTYVEAINSGAVPCLEDAVITLAQRENSAAVQRASDYYSQQMAQRVKFPTDTLQELLDVHAACEREAIAIFMEHSFKDENQEFQKKFMETTMNKKGDFLLQNEESSVQYCQAKLNELSKGLMESISAGSFSVPGGHKLYMETKERIEQDYWQVPRKGVKAKEVFQRFLESQMVIEESILQSDKALTDREKAVAVDRAKKEAAEKEQELLKQKLQEQQQQMEAQVKSRKENIAQLKEKLQMEREHLLREQIMMLEHTQKVQNDWLHEGFKKKYEEMNAEISQFKRMIDTTKNDDTPWIARTLDNLADELTAILSAPAKLIGHGVKGVSSLFKKHKLPF

SEQ ID NO: 59352 - protein, 226 aa, Homo sapiens
MDWGTLQTILGGVNKHSTSIGKIWLTVLFIFRIMILVVAAKEVWGDEQADFVCNTLQPGCKNVCYDHYFPISHIRLWALQLIFVSTPALLVAMHVAYRRHEKKRKFIKGEIKSEFKDIEEIKTQKVRIEGSLWWTYTSSIFFRVIFEAAFMYVFYVMYDGFSMQRLVKCNAWPCPNTVDCFVSRPTEKTVFTVFMIAVSGICILLNVTELCYLLIRYCSGKSKKPV

SEQ ID NO: 59353 - protein, 273 aa, Homo sapiens
MNWSIFEGLLSGVNKYSTAFGRIWLSLVFIFRVLVYLVTAERVWSDDHKDFDCNTRQPGCSNVCFDEFFPVSHVRLWALQLILVTCPSLLVVMHVAYREVQEKRHREAHGENSGRLYLNPGKKRGGLWWTYVCSLVFKASVDIAFLYVFHSFYPKYILPPVVKCHADPCPNIVDCFISKPSEKNIFTLFMVATAAICILLNLVELIYLVSKRCHECLAARKAQAMCTGHHPHGTTSSCKQDDLLSGDLIFLGSDSHPPLLPDRPRDHVKKTIL

SEQ ID NO: 59354 - protein, 148 aa, Homo sapiens
MATPARAPESPPSADPALVAGPAEEAECPPPRQPQPAQNVLAAPRLRAPSSRGLGAAEFGGAAGNVEAPGETFAQRVSWGPAESPPGSFSSSSLGAPLPSRTLFPSLEGDFDSVTFASVLRASGRRACCGRAVPLPGQKIHLQIARQR

SEQ ID NO: 59355 - protein, 106 aa, Homo sapiens
MSARGEGAGQPSTSAQGQPAAPAPQKRGRGRPRKQQQEPTGEPSPKRPRGRPKGSKNKSPSKAAQKKAEATGEKRPRGRPRKWDNLLPRTSSKKKTSLGNSTKRSH

SEQ ID NO: 59356 - protein, 208 aa, Homo sapiens
MIIKHFFGTVLVLLASTTIFSLDLKLIIFQQRQVNQESLKLLNKLQTLSIQQCLPHRKNFLLPQKSLSPQQYQKGHTLAILHEMLQQIFSLFRANISLDGWEENHTEKFLIQLHQQLEYLEALMGLEAEKLSGTLGSDNLRLQVKMYFRRIHDYLENQDYSTCAWAIVQVEISRCLFFVFSLTEKLSKQGRPLNDMKQELTTEFRSPR

SEQ ID NO: 59357 - protein, 271 aa, Homo sapiens
MAKVPDMFEDLKNCYSENEEDSSSIDHLSLNQKSFYHVSYGPLHEGCMDQSVSLSISETSKTSKLTFKESMVVVATNGKVLKKRRLSLSQSITDDDLEAIANDSEEEIIKPRSAPFSFLSNVKYNFMRIIKYEFILNDALNQSIIRANDQYLTAAALHNLDEAVKFDMGAYKSSKDDAKITVILRISKTQLYVTAQDEDQPVLLKEMPEIPKTITGSETNLLFFWETHGTKNYFTSVAHPNLFIATKQDYWVCLAGGPPSITDFQILENQA

SEQ ID NO: 59358 - protein, 638 aa, Homo sapiens
MGKIENNERVILNVGGTRHETYRSTLKTLPGTRLALLASSEPPGDCLTTAGDKLQPSPPPLSPPPRAPPLSPGPGGCFEGGAGNCSSRGGRASDHPGGGREFFFDRHPGVFAYVLNYYRTGKLHCPADVCGPLFEEELAFWGIDETDVEPCCWMTYRQHRDAEEALDIFETPDLIGGDPGDDEDLAAKRLGIEDAAGLGGPDGKSGRWRRLQPRMWALFEDPYSSRAARFIAFASLFFILVSITTFCLETHEAFNIVKNKTEPVINGTSVVLQYEIETDPALTYVEGVCVVWFTFEFLVRIVFSPNKLEFIKNLLNIIDFVAILPFYLEVGLSGLSSKAAKDVLGFLRVVRFVRILRIFKLTRHFVGLRVLGHTLRASTNEFLLLIIFLALGVLIFATMIYYAERVGAQPNDPSASEHTQFKNIPIGFWWAVVTMTTLGYGDMYPQTWSGMLVGALCALAGVLTIAMPVPVIVNNFGMYYSLAMAKQKLPRKRKKHIPPAPQASSPTFCKTELNMACNSTQSDTCLGKDNRLLEHNRSVLSGDDSTGSEPPLSPPERLPIRRSSTRDKNRRGETCFLLTTGDYTCASDGGIRKGYEKSRSLNNIAGLAGNALRLSPVTSPYNSPCPLRRSRSPIPSIL

SEQ ID NO: 59359 - protein, 1271 aa, Homo sapiens
MEALRNPMPLGSSEEALGDLACSSLTGASRDLGTGAVASGTQEETSGPRGDPQQTPSLEKERHTPSRTGPGAAGRTLPRRSRSWERAPRSSRGAQAAACHTSHHSAGSRPGGHLGGQAVGTPNCVPVEGPGCTKEEDVLASSACVSTDGGSLHCHNPSGPSDVPARQPHPEQEGWPPGTGDFPSQVPKQVLDVSQELLQSGVVTLPGTRDRHGRAVVQVRTRSLLWTREHSSCAELTRLLLYFHSIPRKEVRDLGLVVLVDARRSPAAPAVSQALSGLQNNTSPIIHSILLLVDKESAFRPDKDAIIQCEVVSSLKAVHKFVDSCQLTADLDGSFPYSHGDWICFRQRLEHFAANCEEAIIFLQNSFCSLNTHRTPRTAQEVAELIDQHETMMKLVLEDPLLVSLRLEGGTVLARLRREELGTEDSRDTLEAATSLYDRVDEEVHRLVLTSNNRLQQLEHLRELASLLEGNDQQSCQKGLQLAKENPQRTEEMVQDFRRGLSAVVSQAECREGELARWTRSSELCETVSSWMGPLDPEACPSSPVAECLRSCHQEATSVAAEAFPGAGVAVLKPHALGKPWASQQDLWLQYPQTRLRLEEALSEAAPDPSLPPLAQSPPKHERAQEAMRRHQKPPSFPSTDSGGGAWEPAQPLSGLPGRALLCGQDGEPLGPGLCALWDPLSLLRGLPGAGATTAHLEDSSACSSEPTQTLASRPRKHPQKKMIKKTQSFEIPQPDSGPRDSCQPDHTSVFSKGLEVTSTVATEKKLPLWQHARSPPVTQSRSLSSPSGLHPAEEDGRQQVGSSRLRHIMAEMIATEREYIRCLGYVIDNYFPEMERMDLPQGLRGKHHVIFGNLEKLHDFHQQHFLRELERCQHCPLAVGRSFLRHEEQFGMYVIYSKNKPQSDALLSSHGNAFFKDKQRELGDKMDLASYLLRPVQRVAKYALLLQDLLKEASCGLAQGQELGELRAAEVVVCFQLRHGNDLLAMDAIRGCDVNLKEQGQLRCRDEFIVCCGRKKYLRHVFLFEDLILFSKTQKVEGSHDVYLYKQSFKTAEIGMTENVGDSGLRFEIWFRRRRKSQDTYILQASSAEVKSAWTDVIGRILWRQALKSRELRIQEMASMGIGNQPFMDVKPRDRTPDCAVISDRAPKCAVMSDRVPDSIVKGTESQMRGSTAVSSSDHAAPFKRPHSTISDSSTSSSSSQSSSILGSLGLLVSSSPAHPGLWSPAHSPWSSDIRACVEEDEPEPELETGTQAAVCEGAPAVLLSRTRQA

SEQ ID NO: 59360 - protein, 254 aa, Homo sapiens
MATAGNPWGWFLGYLILGVAGSLVSGSCSQIINGEDCSPHSQPWQAALVMENELFCSGVLVHPQWVLSAAHCFQNSYTIGLGLHSLEADQEPGSQMVEASLSVRHPEYNRPLLANDLMLIKLDESVSESDTIRSISIASQCPTAGNSCLVSGWGLLANGRMPTVLQCVNVSVVSEEVCSKLYDPLYHPSMFCAGGGHDQKDSCNGDSGGPLICNGYLQGLVSFGKAPCGQVGVPGVYTNLCKFTEWIEKTVQAS

SEQ ID NO: 59361 - protein, 564 aa, Homo sapiens
MASTSTTIRSHSSSRRGFSANSARLPGVSRSGFSSISVSRSRGSGGLGGACGGAGFGSRSLYGLGGSKRISIGGGSCAISGGYGSRARGSYGFGGAGSGFGFGGGAGIGFDLGGGAGLAGGFGGPGFPVCPPGGIQEVTVNQSLLTPLNLQIDPAIQRVRAEEREQIKTLNNKFASFIDKVRFLEQQNKVLDTKWTLLQEQGTKTVRQNLEPLFEQYINNLRRQLDNIVGERGRLDSELRNMQDLVEDLKNKYEDEINKRTAAENEFVTLKKDVDAAYMNKVELQAKADTLTDEINFLRALYDAELSQMQTHISDTSVVLSMDNNRNLDLDSIIAEVKAQYEEIAQRSRAEAESWYQTKYEELQVTAGRHGDDLRNTKQEIAEINRMIQRLRSEIDHVKKQCASLQAAIADAEQRGEMALKDAKNKLEGLEDALQKAKQDLARLLKEYQELMNVKLALDVEIATYRKLLEGEECRLNGEGIGQVNVSVVQSTISSGYGGASGVGSGLGLGGGSSYSYGSGLGIGGGFSSSSGRAIGGGLSSVGGGSSTIKYTTTSSSSRKSYKH

SEQ ID NO: 59362 - protein, 1724 aa, Homo sapiens
MPPAVRRSACSMGWLWIFGAALGQCLGYSSQQQRVPFLQPPGQSQLQASYVEFRPSQGCSPGYYRDHKGLYTGRCVPCNCNGHSNQCQDGSGICVNCQHNTAGEHCERCQEGYYGNAVHGSCRACPCPHTNSFATGCVVNGGDVRCSCKAGYTGTQCERCAPGYFGNPQKFGGSCQPCSCNSNGQLGSCHPLTGDCINQEPKDSSPAEECDDCDSCVMTLLNDLATMGEQLRLVKSQLQGLSASAGLLEQMRHMETQAKDLRNQLLNYRSAISNHGSKIEGLERELTDLNQEFETLQEKAQVNSRKAQTLNNNVNRATQSAKELDVKIKNVIRNVHILLKQISGTDGEGNNVPSGDFSREWAEAQRMMRELRNRNFGKHLREAEADKRESQLLLNRIRTWQKTHQGENNGLANSIRDSLNEYEAKLSDLRARLQEAAAQAKQANGLNQENERALGAIQRQVKEINSLQSDFTKYLTTADSSLLQTNIALQLMEKSQKEYEKLAASLNEARQELSDKVRELSRSAGKTSLVEEAEKHARSLQELAKQLEEIKRNASGDELVRCAVDAATAYENILNAIKAAEDAANRAASASESALQTVIKEDLPRKAKTLSSNSDKLLNEAKMTQKKLKQEVSPALNNLQQTLNIVTVQKEVIDTNLTTLRDGLHGIQRGDIDAMISSAKSMVRKANDITDEVLDGLNPIQTDVERIKDTYGRTQNEDFKKALTDADNSVNKLTNKLPDLWRKIESINQQLLPLGNISDNMDRIRELIQQARDAASKVAVPMRFNGKSGVEVRLPNDLEDLKGYTSLSLFLQRPNSRENGGTENMFVMYLGNKDASRDYIGMAVVDGQLTCVYNLGDREAELQVDQILTKSETKEAVMDRVKFQRIYQFARLNYTKGATSSKPETPGVYDMDGRNSNTLLNLDPENVVFYVGGYPPDFKLPSRLSFPPYKGCIELDDLNENVLSLYNFKKTFNLNTTEVEPCRRRKEESDKNYFEGTGYARVPTQPHAPIPTFGQTIQTTVDRGLLFFAENGDRFISLNIEDGKLMVRYKLNSELPKERGVGDAINNGRDHSIQIKIGKLQKRMWINVDVQNTIIDGEVFDFSTYYLGGIPIAIRERFNISTPAFRGCMKNLKKTSGVVRLNDTVGVTKKCSEDWKLVRSASFSRGGQLSFTDLGLPPTDHLQASFGFQTFQPSGILLDHQTWTRNLQVTLEDGYIELSTSDSGSPIFKSPQTYMDGLLHYVSVISDNSGLRLLIDDQLLRNSKRLKHISSSRQSLRLGGSNFEGCISNVFVQRLSLSPEVLDLTSNSLKRDVSLGGCSLNKPPFLMLLKGSTRFNKTKTFRINQLLQDTPVASPRSVKVWQDACSPLPKTQANHGALQFGDIPTSHLLFKLPQELLKPRSQFAVDMQTTSSRGLVFHTGTKNSFMALYLSKGRLVFALGTDGKKLRIKSKEKCNDGKWHTVVFGHDGEKGRLVVDGLRAREGSLPGNSTISIRAPVYLGSPPSGKPKSLPTNSFVGCLKNFQLDSKPLYTPSSSFGVSSCLGGPLEKGIYFSEEGGHVVLAHSVLLGPEFKLVFSIRPRSLTGILIHIGSQPGKHLCVYLEAGKVTASMDSGAGGTSTSVTPKQSLCDGQWHSVAVTIKQHILHLELDTDSSYTAGQIPFPPASTQEPLHLGGAPANLTTLRIPVWKSFFGCLRNIHVNHIPVPVTEALEVQGPVSLNGCPDQ

SEQ ID NO: 59363 - protein, 3333 aa, Homo sapiens
MAAAARPRGRALGPVLPPTPLLLLVLRVLPACGATARDPGAAAGLSLHPTYFNLAEAARIWATATCGERGPGEGRPQPELYCKLVGGPTAPGSGHTIQGQFCDYCNSEDPRKAHPVTNAIDGSERWWQSPPLSSGTQYNRVNLTLDLGQLFHVAYILIKFANSPRPDLWVLERSVDFGSTYSPWQYFAHSKVDCLKEFGREANMAVTRDDDVLCVTEYSRIVPLENGEVVVSLINGRPGAKNFTFSHTLREFTKATNIRLRFLRTNTLLGHLISKAQRDPTVTRRYYYSIKDISIGGQCVCNGHAEVCNINNPEKLFRCECQHHTCGETCDRCCTGYNQRRWRPAAWEQSHECEACNCHGHASNCYYDPDVERQQASLNTQGIYAGGGVCINCQHNTAGVNCEQCAKGYYRPYGVPVDAPDGCIPCSCDPEHADGCEQGSGRCHCKPNFHGDNCEKCAIGYYNFPFCLRIPIFPVSTPSSEDPVAGDIKGCDCNLEGVLPEICDAHGRCLCRPGVEGPRCDTCRSGFYSFPICQACWCSALGSYQMPCSSVTGQCECRPGVTGQRCDRCLSGAYDFPHCQGSSSACDPAGTINSNLGYCQCKLHVEGPTCSRCKLLYWNLDKENPSGCSECKCHKAGTVSGTGECRQGDGDCHCKSHVGGDSCDTCEDGYFALEKSNYFGCQGCQCDIGGALSSMCSGPSGVCQCREHVVGKVCQRPENNYYFPDLHHMKYEIEDGSTPNGRDLRFGFDPLAFPEFSWRGYAQMTSVQNDVRITLNVGKSSGSLFRVILRYVNPGTEAVSGHITIYPSWGAAQSKEIIFLPSKEPAFVTVPGNGFADPFSITPGIWVACIKAEGVLLDYLVLLPRDYYEASVLQLPVTEPCAYAGPPQENCLLYQHLPVTRFPCTLACEARHFLLDGEPRPVAVRQPTPAHPVMVDLSGREVELHLRLRIPQVGHYVVVVEYSTEAAQLFVVDVNVKSSGSVLAGQVNIYSCNYSVLCRSAVIDHMSRIAMYELLADADIQLKGHMARFLLHQVCIIPIEEFSAEYVRPQVHCIASYGRFVNQSATCVSLAHETPPTALILDVLSGRPFPHLPQQSSPSVDVLPGVTLKAPQNQVTLRGRVPHLGRYVFVIHFYQAAHPTFPAQVSVDGGWPRAGSFHASFCPHVLGCRDQVIAEGQIEFDISEPEVAATVKVPEGKSLVLVRVLVVPAENYDYQILHKKSMDKSLEFITNCGKNSFYLDPQTASRFCKNSARSLVAFYHKGALPCECHPTGATGPHCSPEGGQCPCQPNVIGRQCTRCATGHYGFPRCKPCSCGRRLCEEMTGQCRCPPRTVRPQCEVCETHSFSFHPMAGCEGCNCSRRGTIEAAMPECDRDSGQCRCKPRITGRQCDRCASGFYRFPECVPCNCNRDGTEPGVCDPGTGACLCKENVEGTECNVCREGSFHLDPANLKGCTSCFCFGVNNQCHSSHKRRTKFVDMLGWHLETADRVDIPVSFNPGSNSMVADLQELPATIHSASWVAPTSYLGDKVSSYGGYLTYQAKSFGLPGDMVLLEKKPDVQLTGQHMSIIYEETNTPRPDRLHHGRVHVVEGNFRHASSRAPVSREELMTVLSRLADVRIQGLYFTETQRLTLSEVGLEEASDTGSGRIALAVEICACPPAYAGDSCQGCSPGYYRDHKGLYTGRCVPCNCNGHSNQCQDGSGICVNCQHNTAGEHCERCQEGYYGNAVHGSCRACPCPHTNSFATGCVVNGGDVRCSCKAGYTGTQCERCAPGYFGNPQKFGGSCQPCSCNSNGQLGSCHPLTGDCINQEPKDSSPAEECDDCDSCVMTLLNDLATMGEQLRLVKSQLQGLSASAGLLEQMRHMETQAKDLRNQLLNYRSAISNHGSKIEGLERELTDLNQEFETLQEKAQVNSRKAQTLNNNVNRATQSAKELDVKIKNVIRNVHILLKQISGTDGEGNNVPSGDFSREWAEAQRMMRELRNRNFGKHLREAEADKRESQLLLNRIRTWQKTHQGENNGLANSIRDSLNEYEAKLSDLRARLQEAAAQAKQANGLNQENERALGAIQRQVKEINSLQSDFTKYLTTADSSLLQTNIALQLMEKSQKEYEKLAASLNEARQELSDKVRELSRSAGKTSLVEEAEKHARSLQELAKQLEEIKRNASGDELVRCAVDAATAYENILNAIKAAEDAANRAASASESALQTVIKEDLPRKAKTLSSNSDKLLNEAKMTQKKLKQEVSPALNNLQQTLNIVTVQKEVIDTNLTTLRDGLHGIQRGDIDAMISSAKSMVRKANDITDEVLDGLNPIQTDVERIKDTYGRTQNEDFKKALTDADNSVNKLTNKLPDLWRKIESINQQLLPLGNISDNMDRIRELIQQARDAASKVAVPMRFNGKSGVEVRLPNDLEDLKGYTSLSLFLQRPNSRENGGTENMFVMYLGNKDASRDYIGMAVVDGQLTCVYNLGDREAELQVDQILTKSETKEAVMDRVKFQRIYQFARLNYTKGATSSKPETPGVYDMDGRNSNTLLNLDPENVVFYVGGYPPDFKLPSRLSFPPYKGCIELDDLNENVLSLYNFKKTFNLNTTEVEPCRRRKEESDKNYFEGTGYARVPTQPHAPIPTFGQTIQTTVDRGLLFFAENGDRFISLNIEDGKLMVRYKLNSELPKERGVGDAINNGRDHSIQIKIGKLQKRMWINVDVQNTIIDGEVFDFSTYYLGGIPIAIRERFNISTPAFRGCMKNLKKTSGVVRLNDTVGVTKKCSEDWKLVRSASFSRGGQLSFTDLGLPPTDHLQASFGFQTFQPSGILLDHQTWTRNLQVTLEDGYIELSTSDSGSPIFKSPQTYMDGLLHYVSVISDNSGLRLLIDDQLLRNSKRLKHISSSRQSLRLGGSNFEGCISNVFVQRLSLSPEVLDLTSNSLKRDVSLGGCSLNKPPFLMLLKGSTRFNKTKTFRINQLLQDTPVASPRSVKVWQDACSPLPKTQANHGALQFGDIPTSHLLFKLPQELLKPRSQFAVDMQTTSSRGLVFHTGTKNSFMALYLSKGRLVFALGTDGKKLRIKSKEKCNDGKWHTVVFGHDGEKGRLVVDGLRAREGSLPGNSTISIRAPVYLGSPPSGKPKSLPTNSFVGCLKNFQLDSKPLYTPSSSFGVSSCLGGPLEKGIYFSEEGGHVVLAHSVLLGPEFKLVFSIRPRSLTGILIHIGSQPGKHLCVYLEAGKVTASMDSGAGGTSTSVTPKQSLCDGQWHSVAVTIKQHILHLELDTDSSYTAGQIPFPPASTQEPLHLGGAPANLTTLRIPVWKSFFGCLRNIHVNHIPVPVTEALEVQGPVSLNGCPDQ

SEQ ID NO: 59364 - protein, 1172 aa, Homo sapiens [sequence omitted]

SEQ ID NO: 59365 - protein, 1172 aa, Homo sapiens [sequence omitted]

SEQ ID NO: 59366 - protein, 1193 aa, Homo sapiens
MPALWLGCCLCFSLLLPAARATSRREVCDCNGKSRQCIFDRELHRQTGNGFRCLNCNDNTDGIHCEKCKNGFYRHRERDRCLPCNCNSKGSLSARCDNSGRCSCKPGVTGARCDRCLPGFHMLTDAGCTQDQRLLDSKCDCDPAGIAGPCDAGRCVCKPAVTGERCDRCRSGYYNLDGGNPEGCTQCFCYGHSASCRSSAEYSVHKITSTFHQDVDGWKAVQRNGSPAKLQWSQRHQDVFSSAQRLDPVYFVAPAKFLGNQQVSYGQSLSFDYRVDRGGRHPSAHDVILEGAGLRITAPLMPLGKTLPCGLTKTYTFRLNEHPSNNWSPQLSYFEYRRLLRNLTALRIRATYGEYSTGYIDNVTLISARPVSGAPAPWVEQCICPVGYKGQFCQDCASGYKRDSARLGPFGTCIPCNCQGGGACDPDTGDCYSGDENPDIECADCPIGFYNDPHDPRSCKPCPCHNGFSCSVMPETEEVVCNNCPPGVTGARCELCADGYFGDPFGEHGPVRPCQPCQCNNNVDPSASGNCDRLTGRCLKCIHNTAGIYCDQCKAGYFGDPLAPNPADKCRACNCNPMGSEPVGCRSDGTCVCKPGFGGPNCEHGAFSCPACYNQVKIQMDQFMQQLQRMEALISKAQGGDGVVPDTELEGRMQQAEQALQDILRDAQISEGASRSLGLQLAKVRSQENSYQSRLDDLKMTVERVRALGSQYQNRVRDTHRLITQMQLSLAESEASLGNTNIPASDHYVGPNGFKSLAQEATRLAESHVESASNMEQLTRETEDYSKQALSLVRKALHEGVGSGSGSPDGAVVQGLVEKLEKTKSLAQQLTREATQAEIEADRSYQHSLRLLDSVSRLQGVSDQSFQVEEAKRIKQKADSLSTLVTRHMDEFKRTQKNLGNWKEEAQQLLQNGKSGREKSDQLLSRANLAKSRAQEALSMGNATFYEVESILKNLREFDLQVDNRKAEAEEAMKRLSYISQKVSDASDKTQQAERALGSAAADAQRAKNGAGEALEISSEIEQEIGSLNLEANVTADGALAMEKGLASLKSEMREVEGELERKELEFDTNMDAVQMVITEAQKVDTRAKNAGVTIQDTLNTLDGLLHLMDQPLSVDEEGLVLLEQKLSRAKTQINSQLRPMMSELEERARQQRGHLHLLETSIDGILADVKNLENIRDNLPPGCYNTQALEQQ

SEQ ID NO: 59367 - protein, 1111 aa, Homo sapiens
MPALWLGCCLCFSLLLPAARATSRREVCDCNGKSRQCIFDRELHRQTGNGFRCLNCNDNTDGIHCEKCKNGFYRHRERDRCLPCNCNSKGSLSARCDNSGRCSCKPGVTGARCDRCLPGFHMLTDAGCTQDQRLLDSKCDCDPAGIAGPCDAGRCVCKPAVTGERCDRCRSGYYNLDGGNPEGCTQCFCYGHSASCRSSAEYSVHKITSTFHQDVDGWKAVQRNGSPAKLQWSQRHQDVFSSAQRLDPVYFVAPAKFLGNQQVSYGQSLSFDYRVDRGGRHPSAHDVILEGAGLRITAPLMPLGKTLPCGLTKTYTFRLNEHPSNNWSPQLSYFEYRRLLRNLTALRIRATYGEYSTGYIDNVTLISARPVSGAPAPWVEQCICPVGYKGQFCQDCASGYKRDSARLGPFGTCIPCNCQGGGACDPDTGDCYSGDENPDIECADCPIGFYNDPHDPRSCKPCPCHNGFSCSVMPETEEVVCNNCPPGVTGARCELCADGYFGDPFGEHGPVRPCQPCQCNNNVDPSASGNCDRLTGRCLKCIHNTAGIYCDQCKAGYFGDPLAPNPADKCRACNCNPMGSEPVGCRSDGTCVCKPGFGGPNCEHGAFSCPACYNQVKIQMDQFMQQLQRMEALISKAQGGDGVVPDTELEGRMQQAEQALQDILRDAQISEGASRSLGLQLAKVRSQENSYQSRLDDLKMTVERVRALGSQYQNRVRDTHRLITQMQLSLAESEASLGNTNIPASDHYVGPNGFKSLAQEATRLAESHVESASNMEQLTRETEDYSKQALSLVRKALHEGVGSGSGSPDGAVVQGLVEKLEKTKSLAQQLTREATQAEIEADRSYQHSLRLLDSVSRLQGVSDQSFQVEEAKRIKQKADSLSTLVTRHMDEFKRTQKNLGNWKEEAQQLLQNGKSGREKSDQLLSRANLAKSRAQEALSMGNATFYEVESILKNLREFDLQVDNRKAEAEEAMKRLSYISQKVSDASDKTQQAERALGSAAADAQRAKNGAGEALEISSEIEQEIGSLNLEANVTADGALAMEKGLASLKSEMREVEGELERKELEFDTNMDAVQMVITEAQKVDTRAKNAGVTIQDTLNTLDGLLHLMGM

SEQ ID NO: 59368 - protein, 526 aa, Homo sapiens
MPAVSGPGPLFCLLLLLLDPHSPETGCPPLRRFEYKLSFKGPRLALPGAGIPFWSHHGDAILGLEEVRLTPSMRNRSGAVWSRASVPFSAWEVEVQMRVTGLGRRGAQGMAVWYTRGRGHVGSVLGGLASWDGIGIFFDSPAEDTQDSPAIRVLASDGHIPSEQPGDGASQGLGSCHWDFRNRPHPFRARITYWGQRLRMSLNSGLTPSDPGEFCVDVGPLLLVPGGFFGVSAATGTLADDHDVLSFLTFSLSEPSPEVPPQPFLEMQQLRLARQLEGLWARLGLGTREDVTPKSDSEAQGEGERLFDLEETLGRHRRILQALRGLSKQLAQAERQWKKQLGPPGQARPDGGWALDASCQIPSTPGRGGHLSMSLNKDSAKVGALLHGQWTLLQALQEMRDAAVRMAAEAQVSYLPVGIEHHFLELDHILGLLQEELRGPAKAAAKAPRPPGQPPRASSCLQPGIFLFYLLIQTVGFFGYVHFRQELNKSLQECLSTGSLPLGPAPHTPRALGILRRQPLPASMPA

SEQ ID NO: 59369 - protein, 103 aa, Homo sapiens
MLLENTFDGEVDFCNLYAVVRRAVLWQICERTAYEEREATSHTSQLRSPETALQAHKPLSQAICQEPHEEHSTAPASEAHGFAYHMSCFLLIRGSQAQCDPTS

SEQ ID NO: 59370 - protein, 103 aa, Homo sapiens
MLLENTFDGEVDFCNLYAVIRRAVLWQICERTAHEEREATSHTSQLRSPETALQAHKPLSQAICQEPHEEHSTAPASEAHGFAYHMSCFLLIRGSQAQCDPTS

SEQ ID NO: 59371 - protein, 292 aa, Homo sapiens [sequence omitted]

SEQ ID NO: 59372 - protein, 82 aa, Homo sapiens
MKTTCVTFGAEDPGQRDSFGGPVRCPCPHSVRRPTYDLGSSDQPAQGTSHQFQIGTPLENGLSNSPGSHSQSPWNSGPRLSD

SEQ ID NO: 59373 - protein, 210 aa, Homo sapiens
MSRAGSHPKPAIPGRGGEKLALLLAMLGGRCCPAGGPESHTPCKPWPPIRRERPGLRSPKPREEAGPRADSKAASPALFMGPGSRGRRRPPSWARRRARGGRGSCPEPHVRAGPRFFIALAAPAARGLRVSSQGPGLWRGPAARKEGVARVGVAAGLRLRPWGRGRKTTPALSGHPARFPLQPGDSRERSRNHRALELTWQPRGAKAGGA

SEQ ID NO: 59374 - protein, 23 aa, Homo sapiens
MNLWIENAVERYFIKEEKVRIQL

SEQ ID NO: 59375 - protein, 292 aa, Homo sapiens [sequence omitted]

SEQ ID NO: 59376 - protein, 82 aa, Homo sapiens; identical to SEQ ID NO: 59372

SEQ ID NO: 59377 - protein, 40 aa, Homo sapiens
MWLLSQCIWGVNVLLRGNLPEIEESTDEDVLNISAEECIR

SEQ ID NO: 59378 - protein, 149 aa, Homo sapiens
MSTNICSFKDRCVSILCCKFCKQVLSSRGMKAVLLADTEIDLFSTDIPPTNAVDFTGRCYFTKICKCKLKDIACLKCGNIVGYHVIVPCSSCLLSCNNGHFWMFHSQAVYDINRLDSTGVNVLLWGNLPEIEESTDEDVLNISAEECIR

SEQ ID NO: 59379 - protein, 149 aa, Homo sapiens
MPTTTALRWTAAARVRRKGRGGWVPAALRSVSQDGVPGCTVMGGETRSPENAVDFTGRCYFTKICKCKLKDIACLKCGNIVGYHVIVPCSSCLLSCNNGHFWMFHSQAVYDINRLDSTGVNVLLWGNLPEIEESTDEDVLNISAEECIR

SEQ ID NO: 59380 - protein, 109 aa, Homo sapiens
MSTNICSFKDSAVDFTGRCYFTKICKCKLKDIACLKCGNIVGYHVIVPCSSCLLSCNNGHFWMFHSQAVYDINRLDSTGVNVLLWGNLPEIEESTDEDVLNISAEECIR

SEQ ID NO: 59381 - protein, 93 aa, Homo sapiens
MKRLIWLVITWYLVTFTFFSSGNIVVYHVIVPCSSCLLSCNNRHFWMFHSQAVYDINRLDSTGVNVLLRGNLPEIEESTDEDVLNISAEECIR

SEQ ID NO: 59382 - protein, 149 aa, Homo sapiens
MSTNICSFKDRCVSILCCKFCKQVLSSRGMKAVLLADTEIDLFSTDIPPTNAVDFTGRCYFTKICKCKLKDIACLKCGNIVGYHVIVPCSSCLPSCNNGHFWMFHSQAVYDINRLDSTGVNILLWGNLPEIEESTDEDVLNISAEECIR

SEQ ID NO: 59383 - protein, 149 aa, Homo sapiens
MPTTTALRWTAAARVRRKGRGGWVLAALRSVSQDGVPGCTVMGGETRSPENAVDFTGRCYFTKICKCKLKDIACLKCGNIVGYHVIVPCSSCLPSCNNGHFWMFHSQAVYDINRLDSTGVNILLWGNLPEIEESTDEDVLNISAEECIR

SEQ ID NO: 59384 - protein, 109 aa, Homo sapiens
MSTNICSFKDSAVDFTGRCYFTKICKCKLKDIACLKCGNIVGYHVIVPCSSCLPSCNNGHFWMFHSQAVYDINRLDSTGVNILLWGNLPEIEESTDEDVLNISAEECIR

SEQ ID NO: 59385 - protein, 615 aa, Homo sapiens
METTLASTATTPGLSAKSTILYSSSRSPDQTLSPASMTSSSISGEPTSLYSQAESTHTTAFPASTTTSGLSQESTTFHSKPGSTETTLSPGSITTSSFAQEFTTPHSQPGSALSTVSPASTTVPGLSEESTTFYSSPGSTETTAFSHSNTMSIHSQQSTPFPDSPGFTHTVLPATLTTTDIGQESTAFHSSSDATGTTPLPARSTASDLVGEPTTFYISPSPTYTTLFPASSSTSGLTEESTTFHTSPSFTSTIVSTESLETLAPGLCQEGQIWNGKQCVCPQGYVGYQCLSPLESFPVETPEKLNATLGMTVKVTYRNFTEKMNDASSQEYQNFSTLFKNRMDVVLKGDNLPQYRGVNIRRLLNGSIVVKNDVILEADYTLEYEELFENLAEIVKAKIMNETRTTLLDPDSCRKAILCYSEEDTFVDSSVTPGFDFQEQCTQKAAEGYTQFYYVDVLDGKLACVNKCTKGTKSQMNCNLGTCQLQRSGPRCLCPNTNTHWYWGETCEFNIAKSLVYGIVGAVMAVLLLALIILIILFSLSQRKRHREQYDVPQEWRKEGTPGIFQKTAIWEDQNLRESRFGLENAYNNFRPTLETVDSGTELHIQRPEMVASTV

SEQ ID NO: 59386 - protein, 615 aa, Homo sapiens; identical to SEQ ID NO: 59385

SEQ ID NO: 59387 - protein, 978 aa, Homo sapiens [sequence omitted]

SEQ ID NO: 59388 - protein, 1020 aa, Homo sapiens
MMSFGGADALLGAPFAPLHGGGSLHYALARKGGAGGTRSAAGSSSGFHSWTRTSVSSVSASPSRFRGAGAASSTDSLDTLSNGPEGCMVAVATSRSEKEQLQALNDRFAGYIDKVRQLEAHNRSLEGEAAALRQQQAGRSAMGELYEREVREMRGAVLRLGAARGQLRLEQEHLLEDIAHVRQRLDDEARQREEAEAAARALARFAQEAEAARVDLQKKAQALQEECGYLRRHHQEEVGELLGQIQGSGAAQAQMQAETRDALKCDVTSALREIRAQLEGHAVQSTLQSEEWFRVRLDRLSEAAKVNTDAMRSAQEEITEYRRQLQARTTELEALKSTKDSLERQRSELEDRHQADIASYQEAIQQLDAELRNTKWEMAAQLREYQDLLNVKMALDIEIAAYRKLLEGEECRIGFGPIPFSLPEGLPKIPSVSTHIKVKSEEKIKVVEKSEKETVIVEEQTEETQVTEEVTEEEEKEAKEEEGKEEEGGEEEEAEGGEEETKSPPAEEAASPEKEAKSPVKEEAKSPAEAKSPEKEEAKSPAEVKSPEKAKSPAKEEAKSPPEAKSPEKEEAKSPAEVKSPEKAKSPAKEEAKSPAEAKSPEKAKSPVKEEAKSPAEAKSPVKEEAKSPAEVKSPEKAKSPTKEEAKSPEKAKSPEKEEAKSPEKAKSPVKAEAKSPEKAKSPVKAEAKSPEKAKSPVKEEAKSPEKAKSPVKEEAKSPEKAKSPVKEEAKTPEKAKSPVKEEAKSPEKAKSPEKAKTLDVKSPEAKTPAKEEARSPADKFPEKAKSPVKEEVKSPEKAKSPLKEDAKAPEKEIPKKEEVKSPVKEEEKPQEVKVKEPPKKAEEEKAPATPKTEEKKDSKKEEAPKKEAPKPKVEEKKEPAVEKPKESKVEAKKEEAEDKKKVPTPEKEAPAKVEVKEDAKPKEKTEVAKKEPDDAKAKEPSKPAEKKEAAPEKKDTKEEKAKKPEEKPKTEAKAKEDDKTLSKEPSKPKAEKAEKSSSTDQKDSKPPEKATEDKAAKGK

SEQ ID NO: 59389 - protein, 234 aa, Homo sapiens
MLRVPEPRPGEAKAEGAAPPTPSKPLTSFLIQDILRDGAQRQGGRTSSQRQRDPEPEPEPEPEGGRSRAGAQNDQLSTGPRAAPEEAETLAETEPERHLGSYLLDSENTSGALPRLPQTPKQPQKRSRAAFSHTQVIELERKFSHQKYLSAPERAHLAKNLKLTETQVKIWFQNRRYKTKRKQLSSELGDLEKHSSLPALKEEAFSRASLVSVYNSYPYYPYLYCVGSWSPAFW

SEQ ID NO: 59390 - protein, 418 aa, Homo sapiens
MRLNSSAPGTPGTPAADPFQRAQAGLEEALLAPGFGNASGNASERVLAAPSSELDVNTDIYSKVLVTAVYLALFVVGTVGNTVTAFTLARKKSLQSLQSTVHYHLGSLALSDLLTLLLAMPVELYNFIWVHHPWAFGDAGCRGYYFLRDACTYATALNVASLSVERYLAICHPFKAKTLMSRSRTKKFISAIWLASALLTVPMLFTMGEQNRSADGQHAGGLVCTPTIHTATVKVVIQVNTFMSFIFPMVVISVLNTIIANKLTVMVRQAAEQGQVCTVGGEHSTFSMAIEPGRVQALRHGVRVLRAVVIAFVVCWLPYHVRRLMFCYISDEQWTPFLYDFYHYFYMVTNALFYVSSTINPILYNLVSANFRHIFLATLACLCPVWRRRRKRPAFSRKADSVSSNHTLSSNATRETLY

SEQ ID NO: 59391 - protein, 934 aa, Homo sapiens
MAASRLDFGEVETFLDRHPELFEDYLMRKGKQEMVEKWLQRHSQGQGALGPRPSLAGTSSLAHSTCRGGSSVGGGTGPNGSAHSQPLPGGGDCGGVPLSPSWAGGSRGDGNLQRRASQKELRKSFARSKAIHVNRTYDEQVTSRAQEPLSSVRRRALLRKASSLPPTTAHILSALLESRVNLPQYPPTAIDYKCHLKKHNERQFFLELVKDISNDLDLTSLSYKILIFVCLMVDADRCSLFLVEGAAAGKKTLVSKFFDVHAGTPLLPCSSTENSNEVQVPWGKGIIGYVGEHGETVNIPDAYQDRRFNDEIDKLTGYKTKSLLCMPIRSSDGEIIGVAQAINKIPEGAPFTEDDEKVMQMYLPFCGIAISNAQLFAASRKEYERSRALLEVVNDLFEEQTDLEKIVKKIMHRAQTLLKCERCSVLLLEDIESPVVKFTKSFELMSPKCSADAENSFKESMEKSSYSDWLINNSIAELVASTGLPVNISDAYQDPRFDAEADQISGFHIRSVLCVPIWNSNHQIIGVAQVLNRLDGKPFDDADQRLFEAFVIFCGLGINNTIMYDQVKKSWAKQSVALDVLSYHATCSKAEVDKFKAANIPLVSELAIDDIHFDDFSLDVDAMITAALRMFMELGMVQKFKIDYETLCRWLLTVRKNYRMVLYHNWRHAFNVCQLMFAMLTTAGFQDILTEVEILAVIVGCLCHDLDHRGTNNAFQAKSGSALAQLYGTSATLEHHHFNHAVMILQSEGHNIFANLSSKEYSDLMQLLKQSILATDLTLYFERRTEFFELVSKGEYDWNIKNHRDIFRSMLMTACDLGAVTKPWEISRQVAELVTSEFFEQGDRERLELKLTPSAIFDRNRKDELPRLQLEWIDSICMPLYQALVKVNVKLKPMLDSVATNRSKWEELHQKRLLASTASSSSPASVMVAKEDRN

SEQ ID NO: 59392 - protein, 450 aa, Homo sapiens
MATFSRQEFFQQLLQGCLLPTAQQGLDQIWLLLAICLACRLLWRLGLPSYLKHASTVAGGFFSLYHFFQLHMVWVVLLSLLCYLVLFLCRHSSHRGVFLSVTILIYLLMGEMHMVDTVTWHKMRGAQMIVAMKAVSLGFDLDRGEVGTVPSPVEFMGYLYFVGTIVFGPWISFHSYLQAVQGRPLSCRWLQKVARSLALALLCLVLSTCVGPYLFPYFIPLNGDRLLRKWLRAYESAVSFHFSNYFVGFLSEATATLAGAGFTEEKDHLEWDLTVSKPLNVELPRSMVEVVTSWNLPMSYWLNNYVFKNALRLGTFSAVLVTYAASALLHGFSFHLAAVLLSLAFITYVEHVLRKRLARILSACVLSKRCPPDCSHQHRLGLGVRALNLLFGALAIFHLAYLGSLFDVDVDDTTEEQGYGMAYTVHKWSELSWASHWVTFGCWIFYRLIG

SEQ ID NO: 59393 - protein, 456 aa, Homo sapiens
MATFSRQEFFQQLLQGCLLPTAQQGLDQIWLLLAICLACRLLWRLGLPSYLKHASTVAGGFFSLYHFFQLHMVWVVLLSLLCYLVLFLCRHSSHRGVFLSVTILIYLLMGEMHMVDTVTWHKMRGAQMIVAMKAVSLGFDLDRGEVGTVPSPVEFMGYLYFVGTIVFGPWISFHSYLQAVQGRPLSCRWLQKVARSLALALLCLVLSTCVGPYLFPYFIPLNGDRLLRNKKRKARWLRAYESAVSFHFSNYFVGFLSEATATLAGAGFTEEKDHLEWDLTVSKPLNVELPRSMVEVVTSWNLPMSYWLNNYVFKNALRLGTFSAVLVTYAASALLHGFSFHLAAVLLSLAFITYVEHVLRKRLARILSACVLSKRCPPDCSHQHRLGLGVRALNLLFGALAIFHLAYLGSLFDVDVDDTTEEQGYGMAYTVHKWSELSWASHWVTFGCWIFYRLIG

SEQ ID NO: 59394 - protein, 455 aa, Homo sapiens
MATFSRQEFFQQLLQGCLLPTAQQGLDQIWLLLAICLACRLLWRLGLPSYLKHASTVAGGFFSLYHFFQLHMVWVVLLSLLCYLVLFLCRHSSHRGVFLSVTILIYLLMGEMHMVDTVTWHKMRGAQMIVAMKAVSLGFDLDRGEVGTVPSPVEFMGYLYFVGTIVFGPWISFHSYLQAVQGRPLSCRWLQKVARSLALALLCLVLSTCVGPYLFPYFIPLNGDRLLRKGTMVRWLRAYESAVSFHFSNYFVGFLSEATATLAGAGFTEEKDHLEWDLTVSKPLNVELPRSMVEVVTSWNLPMSYWLNNYVFKNALRLGTFSAVLVTYAASALLHGFSFHLAAVLLSLAFITYVEHVLRKRLARILSACVLSKRCPPDCSHQHRLGLGVRALNLLFGALAIFHLAYLGSLFDVDVDDTTEEQGYGMAYTVHKWSELSWASHWVTFGCWIFYRLIG

SEQ ID NO: 59395 - protein, 461 aa, Homo sapiens
MATFSRQEFFQQLLQGCLLPTAQQGLDQIWLLLAICLACRLLWRLGLPSYLKHASTVAGGFFSLYHFFQLHMVWVVLLSLLCYLVLFLCRHSSHRGVFLSVTILIYLLMGEMHMVDTVTWHKMRGAQMIVAMKAVSLGFDLDRGEVGTVPSPVEFMGYLYFVGTIVFGPWISFHSYLQAVQGRPLSCRWLQKVARSLALALLCLVLSTCVGPYLFPYFIPLNGDRLLRNKKRKARGTMVRWLRAYESAVSFHFSNYFVGFLSEATATLAGAGFTEEKDHLEWDLTVSKPLNVELPRSMVEVVTSWNLPMSYWLNNYVFKNALRLGTFSAVLVTYAASALLHGFSFHLAAVLLSLAFITYVEHVLRKRLARILSACVLSKRCPPDCSHQHRLGLGVRALNLLFGALAIFHLAYLGSLFDVDVDDTTEEQGYGMAYTVHKWSELSWASHWVTFGCWIFYRLIG

SEQ ID NO: 59396 - protein, 379 aa, Homo sapiens
MVWVVLLSLLCYLVLFLCRHSSHRGVFLSVTILIYLLMGEMHMVDTVTWHKMRGAQMIVAMKAVSLGFDLDRGEVGTVPSPVEFMGYLYFVGTIVFGPWISFHSYLQAVQGRPLSCRWLQKVARSLALALLCLVLSTCVGPYLFPYFIPLNGDRLLRKWLRAYESAVSFHFSNYFVGFLSEATATLAGAGFTEEKDHLEWDLTVSKPLNVELPRSMVEVVTSWNLPMSYWLNNYVFKNALRLGTFSAVLVTYAASALLHGFSFHLAAVLLSLAFITYVEHVLRKRLARILSACVLSKRCPPDCSHQHRLGLGVRALNLLFGALAIFHLAYLGSLFDVDVDDTTEEQGYGMAYTVHKWSELSWASHWVTFGCWIFYRLIG

SEQ ID NO: 59397 - protein, 177 aa, Homo sapiens
MQRRLVQQWSVAVFLLSYAVPSCGRSVEGLSRRLKRAVSEHQLLHDKGKSIQDLRRRFFLHHLIAEIHTAEIRATSEVSPNSKPSPNTKNHPVRFGSDDEGRYLTQETNKVETYKEQPLKTPGKKKKGKPGKRKEQEKKKRRTRSAWLDSGVTGSGLEGDHLSDTSTTSLELDSRRH

SEQ ID NO: 59398 - protein, 177 aa, Homo sapiens; identical to SEQ ID NO: 59397

SEQ ID NO: 59399 - protein, 288 aa, Homo sapiens
MAALFQEASSCPVCSDYLEKPMSLECGCAVCFKCINSLQKEPHGEDLLCCCCSMVSQKNKIRPSWQLERLASHIKELEPKLKKILQMNPRMRKFQVDMTLDADTANNFLLISDDLRSVRSGCITQNRQDLAERFDVSICILGSPRFTCGRHYWEVDVGTSTEWDLGVCRESVHRKGRIHLTTERGFWTVSLRDGSRLSASTVPLTFLFVDRKLQRVGIFLDMGMQNVSFFDAEGGSHVYTFRSVSAEEPLHLFFAPPSPPNGDKSVLSICPVINPGTTDAPVHPGEAK

SEQ ID NO: 59400 - protein, 288 aa, Homo sapiens
MAALFQEASSCPVCSDYLEKPMSLECGCTVCLKCINSLQKEPHGEDLLCCCCSMVSQRNKIRPNRQLERLVSHIKELEPKLKKILQMNPRMRKFQVDMTLDADTANNFLLISDDLRSVRSGLITQNRQDLAERFDVSVCILGSPRFTCGRHYWEVDVGTSTEWDLGVCRESVHCKGKIQLTTELGFWTVSLRDGSRLSASTVPLTFLLVDRKLQRVGIFLDMGMQNVSFFDAESGSHVYTFRSVSAEEPLRPFLAPSIPPNGDQGVLSICPLMNSGTTDAPVRPGEAK

SEQ ID NO: 59401 - protein, 334 aa, Homo sapiens
MRGPSWSRPRPLLLLLLLLSPWPVWAQVSATASPSGSLGAPDCPEVCTCVPGGLASCSALSLPAVPPGLSLRLRALLLDHNRVRALPPGAFAGAGALQRLDLRENGLHSVHVRAFWGLGALQLLDLSANQLEALAPGTFAPLRALRNLSLAGNRLARLEPAALGALPLLRSLSLQDNELAALAPGLLGRLPALDALHLRGNPWGCGCALRPLCAWLRRHPLPASEAETVLCVWPGRLTLSPLTAFSDAAFSHCAQPLALRDLAVVYTLGPASFLVSLASCLALGSGLTACRARRRRLRTAALRPPRPPDPNPDPDPHGCASPADPGSPAAAAQA

SEQ ID NO: 59402 - protein, 359 aa, Homo sapiens
MPAHLLQDDISSSYTTTTTITAPPSRVLQNGGDKLETMPLYLEDDIRPDIKDDIYDPTYKDKEGPSPKVEYVWRNIILMSLLHLGALYGITLIPTCKFYTWLWGVFYYFVSALGITAGAHRLWSHRSYKARLPLRLFLIIANTMAFQNDVYEWARDHRAHHKFSETHADPHNSRRGFFFSHVGWLLVRKHPAVKEKGSTLDLSDLEAEKLVMFQRRYYKPGLLMMCFILPTLVPWYFWGETFQNSVFVATFLRYAVVLNATWLVNSAAHLFGYRPYDKNISPRENILVSLGAVGEGFHNYHHSFPYDYSASEYRWHINFTTFFIDCMAALGLAYDRKKVSKAAILARIKRTGDGNYKSG

SEQ ID NO: 59403 - protein, 375 aa, Homo sapiens
MDALQLANSAFAVDLFKQLCEKEPLGNVLFSPICLSTSLSLAQVGAKGDTANEIGQVLHFENVKDIPFGFQTVTSDVNKLSSFYSLKLIKRLYVDKSLNLSTEFISSTKRPYAKELETVDFKDKLEETKGQINNSIKDLTDGHFENILADNSVNDQTKILVVNAAYFVGKWMKKFPESETKECPFRLNKTDTKPVQMMNMEATFCMGNIDSINCKIIELPFQNKHLSMFILLPKDVEDESTGLEKIEKQLNSESLSQWTNPSTMANAKVKLSIPKFKVEKMIDPKACLENLGLKHIFSEDTSDFSGMSETKGVALSNVIHKVCLEITEDGGDSIEVPGARILQHKDELNADHPFIYIIRHNKTRNIIFFGKFCSP

SEQ ID NO: 59404 - protein, 402 aa, Homo sapiens [sequence omitted]

SEQ ID NO: 59405 - protein, 248 aa, Homo sapiens [sequence omitted]

SEQ ID NO: 59406 - protein, 389 aa, Homo sapiens
MEDSPTMVRVDSPTMVRGENQVSPCQGRRCFPKALGYVTGDMKELANQLKDKPVVLQFIDWILRGISQVVFVNNPVSGILILVGLLVQNPWWALTGWLGTVVSTLMALLLSQDRSLIASGLYGYNATLVGVLMAVFSDKGDYFWWLLLPVCAMSMTCPIFSSALNSMLSKWDLPVFTLPFNMALSMYLSATGHYNPFFPAKLVIPITTAPNISWSDLSALELLKSIPVGVGQIYGCDNPWTGGIFLGAILLSSPLMCLHAAIGSLLGIAAGLSLSAPFENIYFGLWGFNSSLACIAMGGMFMALTWQTHLLALGCALFTAYLGVGMANFMAEVGLPACTWPFCLATLLFLIMTTKNSNIYKMPLSKVTYPEENRIFYLQAKKRMVESPL

SEQ ID NO: 59407 - protein, 289 aa, Homo sapiens
MPKNSKVVKRELDDDVTESVKDLLSNEDAADDAFKTSELIVDGQEEKDTDVEEGSEVEDERPAWNSKLQYILAQVGFSVGLGNVWRFPYLCQKNGGGAYLLPYLILLMVIGIPLFFLELSVGQRIRRGSIGVWNYISPKLGGIGFASCVVCYFVALYYNVIIGWSLFYFSQSFQQPLPWDQCPLVKNASHTFVEPECEQSSATTYYWYREALNISSSISESGGLNWKMTICLLAAWVMVCLAMIKGIQSSGKVSMLEPFLILLITISGFIPLSNSVTDFCGQITHNTSF

SEQ ID NO: 59408 - protein, 97 aa, Homo sapiens
MDSSSSSSAAGLGAVDPQLQHFIEVETQKQRFQQLVHQMTELCWEKCMDKPGPKLDSRAEACFVNCVERFIDTSQFILNRLEQTQKSKPVFSESLSD

SEQ ID NO: 59409 - protein, 680 aa, Homo sapiens
MNFETSRCATLQYCPDPYIQRFVETPAHFSWKESYYRSTMSQSTQTNEFLSPEVFQHIWDFLEQPICSVQPIDLNFVDEPSEDGATNKIEISMDCIRMQDSDLSDPMWPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTQALPPPLSMPSTSHCTPPPPYPTDCSIVSFLARLGCSSCLDYFTTQGLTTIYQIEHYSMDDLASLKIPEQFRHAIWKGILDHRQLHEFSSPSHLLRTPSSASTVSVGSSETRGERVIDAVRFTLRQTISFPPRDEWNDFNFDMDARRNKQQRIKEEGE

SEQ ID NO: 59410 - protein, 287 aa, Homo sapiens
MPPLWALLALGCLRFGSAVNLQPQLASVTFATNNPTLTTVALEKPLCMFDSKEALTGTHEVYLYVLVDSAISRNASVQDSTNTPLGSTFLQTEGGRTGPYKAVAFDLIPCSDLPSLDAIGDVSKASQILNAYLVRVGANGTCLWDPNFQGLCNAPLSAATEYRFKYVLVNMSTGLVEDQTLWSDPIRTNQLTPYSTIDTWPGRRSGGMIVITSILGSLPFFLLVGFAGAIALSLVDMGSSDGETTHDSQITQEAVPKSLGASESSYTSVNRGPPLDRAEVYSSKLQD

SEQ ID NO: 59411 - protein, 354 aa, Homo sapiens
MQGLLFSTLLLAGLAQFCCRVQGTGPLDTTPEGRPGEVSDAPQRKQFCHWPCKCPQQKPRCPPGVSLVRDGCGCCKICAKQPGEICNEADLCDPHKGLYCDYSVDRPRYETGVCAYLVAVGCEFNQVHYHNGQVFQPNPLFSCLCVSGAIGCTPLFIPKLAGSHCSGAKGGKKSDQSNCSLEPLLQQLSTSYKTMPAYRNLPLIWKKKCLVQATKWTPCSRTCGMGISNRVTNENSNCEMRKEKRLCYIQPCDSNILKTIKIPKGKTCQPTFQLSKAEKFVFSGCSSTQSYKPTFCGICLDKRCCIPNKSKMITIQFDCPNEGSFKWKMLWITSCVCQRNCREPGDIFSELKIL

SEQ ID NO: 59412 - protein, 331 aa, Homo sapiens
MKISRGRVCLESENKDAGVAGRKQFCHWPCKCPQQKPRCPPGVSLVRDGCGCCKICAKQPGEICNEADLCDPHKGLYCDYSVDRPRYETGVCACKSVGCEFNQVHYHNGQVFQPNPLFSCLCVSGAIGCTPLFIPKLAGSHCSGAKGGKKSDQSNCSLEPLLQQLSTSYKTMPAYRNLPLIWKKKCLVQATKWTPCSRTCGMGISNRVTNENSNCEMRKEKRLCYIQPCDSNILKTIKIPKGKTCQPTFQLSKAEKFVFSGCSSTQSYKPTFCGICLDKRCCIPNKSKMITIQFDCPNEGSFKWKMLWITSCVCQRNCREPGDIFSELKIL

SEQ ID NO: 59413 - protein, 372 aa, Homo sapiens
MNKRRLLYPSGWLHGPSDMQGLLFSTLLLAGLAQFCCRVQGTGPLDTTPEGRPGEVSDAPQRKQFCHWPCKCPQQKPRCPPGVSLVRDGCGCCKICAKQPGEICNEADLCDPHKGLYCDYSVDRPRYETGVCAYLVAVGCEFNQVHYHNGQVFQPNPLFSCLCVSGAIGCTPLFIPKLAGSHCSGAKGGKKSDQSNCSLEPLLQQLSTSYKTMPAYRNLPLIWKKKCLVQATKWTPCSRTCGMGISNRVTNENSNCEMRKEKRLCYIQPCDSNILKTIKIPKGKTCQPTFQLSKAEKFVFSGCSSTQSYKPTFCGICLDKRCCIPNKSKMITIQFDCPNEGSFKWKMLWITSCVCQRNCREPGDIFSELKIL

SEQ ID NO: 59414 - protein, 218 aa, Homo sapiens
MMRREDEEEEGTMMKAKGDLEMKEEEEISETGELVGPFVSAMPTPMPHNKGTRFSEAWEYFHLAPARAGHHPNQYATCRLCGRQVSRGPGVNVGTTALWKHLKSMHREELEKSGHGQAGQRQDPRPHGPQLPTGIEGNWGRLLEQVGTMALWASQREKEVLRRERAVEWRERAVEKRERALEEVERAILEMKWKVRAEKEACQREKELPAAVHPFHFV

SEQ ID NO: 59415 - DNA, 20 bp, Homo sapiens
gatcacttgagccccggagg

SEQ ID NO: 59416 - DNA, 20 bp, Homo sapiens
gatcactttaggcctggtgt

SEQ ID NO: 59417 - DNA, 20 bp, Homo sapiens
gatcagttgctatacctgcc

SEQ ID NO: 59418 - DNA, 20 bp, Homo sapiens
gatccctcaagactggtcca

SEQ ID NO: 59419 - DNA, 20 bp, Homo sapiens
gatcctcctgccttagcccc

SEQ ID NO: 59420 - DNA, 20 bp, Homo sapiens
gatcctgtgtggccagtcat

SEQ ID NO: 59421 - DNA, 20 bp, Homo sapiens
gatctacatgtctagagaac

SEQ ID NO: 59422 - DNA, 20 bp, Homo sapiens
gatctctgtagaaagagtag

SEQ ID NO: 59423 - DNA, 20 bp, Homo sapiens
gatcttcagaaagaggaact

SEQ ID NO: 59424 - DNA, 20 bp, Homo sapiens
gatcttttgtatttaaggat

SEQ ID NO: 59425 - DNA, 20 bp, Homo sapiens
gatccacaacatacagcaag

SEQ ID NO: 59426 - DNA, 20 bp, Homo sapiens
gatccagggcaatgtgaatt

SEQ ID NO: 59427 - DNA, 20 bp, Homo sapiens
gatctaaaaggtgtcaaaat

SEQ ID NO: 59428 - DNA, 20 bp, Homo sapiens
gatccaatcttctaacgcca

SEQ ID NO: 59429 - DNA, 20 bp, Homo sapiens
gatcctggagacagtgagat

SEQ ID NO: 59430 - DNA, 20 bp, Homo sapiens
gatcagaaaagccacagtaa

SEQ ID NO: 59431 - DNA, 20 bp, Homo sapiens
gatccactaatgctatcaaa

SEQ ID NO: 59432 - DNA, 20 bp, Homo sapiens
gatccagtcaattcaatact

SEQ ID NO: 59433 - DNA, 20 bp, Homo sapiens
gatccacaaggcctgaggag

SEQ ID NO: 59434 - DNA, 20 bp, Homo sapiens
gatcccacattgcctccaac

SEQ ID NO: 59435 - DNA, 20 bp, Homo sapiens
gatcgagaataacagaagca

SEQ ID NO: 59436 - DNA, 20 bp, Homo sapiens
gatctcacaaccaaaccttc

SEQ ID NO: 59437 - DNA, 20 bp, Homo sapiens
gatccctcagtcttcaccgt

SEQ ID NO: 59438 - DNA, 20 bp, Homo sapiens
gatcacttgaggacaagaag

SEQ ID NO: 59439 - DNA, 20 bp, Homo sapiens
gatctccttcaatgccccat

SEQ ID NO: 59440 - DNA, 20 bp, Homo sapiens
gatccatgtctccactgctt

SEQ ID NO: 59441 - DNA, 20 bp, Homo sapiens
gatccctaagaggcacccaa

SEQ ID NO: 59442 - DNA, 20 bp, Homo sapiens
gatcttgcctgggtgcccta

SEQ ID NO: 59443 - DNA, 20 bp, Homo sapiens
gatcgggaagctgtgtgact

SEQ ID NO: 59444 - DNA, 20 bp, Homo sapiens
gatctacaaacagacaaata

SEQ ID NO: 59445 - DNA, 20 bp, Homo sapiens
gatctccaggcccagcctgg

SEQ ID NO: 59446 - DNA, 20 bp, Homo sapiens
gatcatgctatattttatat

SEQ ID NO: 59447 - DNA, 20 bp, Homo sapiens
gatctagatagcagagaagt

SEQ ID NO: 59448 - DNA, 20 bp, Homo sapiens
gatcatatgtcttggccaaa

SEQ ID NO: 59449 - DNA, 20 bp, Homo sapiens
gatctccgggcatgactgag

SEQ ID NO: 59450 - DNA, 20 bp, Homo sapiens
gatcctttggaaaggtgggc

SEQ ID NO: 59451 - DNA, 20 bp, Homo sapiens
gatcatggagctcagtgccc

SEQ ID NO: 59452 - DNA, 20 bp, Homo sapiens
gatctcccagagtctaagta

SEQ ID NO: 59453 - DNA, 20 bp, Homo sapiens
gatctcttggaatgacaaat

SEQ ID NO: 59454 - DNA, 20 bp, Homo sapiens
gatcttttttggaaaacaaa

SEQ ID NO: 59455 - DNA, 20 bp, Homo sapiens
gatccagtgcaatcccaggc

SEQ ID NO: 59456 - DNA, 20 bp, Homo sapiens
gatccttacacgtggagccc

SEQ ID NO: 59457 - DNA, 20 bp, Homo sapiens
gatcctttgctgagtgttct

SEQ ID NO: 59458 - DNA, 20 bp, Homo sapiens
gatcaagaacattttccacg

SEQ ID NO: 59459 - DNA, 20 bp, Homo sapiens
gatcattaaacttcgcagga

SEQ ID NO: 59460 - DNA, 20 bp, Homo sapiens
gatcatttgcagttaaggac

SEQ ID NO: 59461 - DNA, 20 bp, Homo sapiens
gatcctgaaagtagctgcct

SEQ ID NO: 59462 - DNA, 20 bp, Homo sapiens
gatccatacacactttgaaa

SEQ ID NO: 59463 - DNA, 20 bp, Homo sapiens
gatcaaaacccagaaggtcc

SEQ ID NO: 59464 - DNA, 20 bp, Homo sapiens
gatctataggaagattgaac

SEQ ID NO: 59465 - DNA, 20 bp, Homo sapiens
gatctgctcaatatttatct

SEQ ID NO: 59466 - DNA, 20 bp, Homo sapiens
gatccatgtcccaatatagt

SEQ ID NO: 59467 - DNA, 20 bp, Homo sapiens
gatctttgactcttttgcca

SEQ ID NO: 59468 - DNA, 20 bp, Homo sapiens
gatcctgagtgtcctgtggg

SEQ ID NO: 59469 - DNA, 20 bp, Homo sapiens
gatccacctttttgcagaaa

SEQ ID NO: 59470 - DNA, 20 bp, Homo sapiens
gatccctttgcagggaagct

SEQ ID NO: 59471 - DNA, 20 bp, Homo sapiens
gatcgggcaagtaaaccccc

SEQ ID NO: 59472 - DNA, 20 bp, Homo sapiens
gatcgttagcctcatatttt

SEQ ID NO: 59473 - DNA, 20 bp, Homo sapiens
gatcgttggtgggtttgagc

SEQ ID NO: 59474 - DNA, 20 bp, Homo sapiens
gatctccttgcctgggtggg

SEQ ID NO: 59475 - DNA, 20 bp, Homo sapiens
gatcttgcgcctcttgtcct

SEQ ID NO: 59476 - DNA, 20 bp, Homo sapiens
gatccatgattacctggaaa

SEQ ID NO: 59477 - DNA, 20 bp, Homo sapiens
gatcagaccataatgttaca

SEQ ID NO: 59478 - DNA, 20 bp, Homo sapiens
gatcctgccttgacgtatgt

SEQ ID NO: 59479 - DNA, 20 bp, Homo sapiens
gatcagatctgtaattcaca

SEQ ID NO: 59480 - DNA, 20 bp, Homo sapiens
gatctcactgctttaaaaca

SEQ ID NO: 59481 - DNA, 20 bp, Homo sapiens
gatcacttgacttgagccca

SEQ ID NO: 59482 - DNA, 20 bp, Homo sapiens
gatcaacagtttcttagcca

SEQ ID NO: 59483 - DNA, 20 bp, Homo sapiens
gatcaaggacaccatcgcag

SEQ ID NO: 59484 - DNA, 20 bp, Homo sapiens
gatcacagatgttgtgaagg

SEQ ID NO: 59485 - DNA, 20 bp, Homo sapiens
gatcactgaggataagctgg

SEQ ID NO: 59486 - DNA, 20 bp, Homo sapiens
gatccacttccggtaatgca

SEQ ID NO: 59487 - DNA, 20 bp, Homo sapiens
gatcctccccttctttctgc

SEQ ID NO: 59488 - DNA, 20 bp, Homo sapiens
gatcctcctatgttgttgaa

SEQ ID NO: 59489 - DNA, 20 bp, Homo sapiens
gatctcatatctccggtgct

SEQ ID NO: 59490 - DNA, 20 bp, Homo sapiens
gatctgtagagagtgtccac

SEQ ID NO: 59491 - DNA, 20 bp, Homo sapiens
gatcttggcaggctctgaca

SEQ ID NO: 59492 - DNA, 20 bp, Homo sapiens
gatcaaggacaccatcgtgg

SEQ ID NO: 59493 - DNA, 20 bp, Homo sapiens
gatcaccgaactgaccatgc

SEQ ID NO: 59494 - DNA, 20 bp, Homo sapiens
gatcacgcttttgttcctga

SEQ ID NO: 59495 - DNA, 20 bp, Homo sapiens
gatccacactgagagagtgg

SEQ ID NO: 59496 - DNA, 20 bp, Homo sapiens
gatcccacccctctttcatc

SEQ ID NO: 59497 - DNA, 20 bp, Homo sapiens
gatcttgctgggtcggcaca

SEQ ID NO: 59498 - DNA, 20 bp, Homo sapiens
gatccagaaataaagtctaa

SEQ ID NO: 59499 - DNA, 20 bp, Homo sapiens
gatccccagcccctcctccc

SEQ ID NO: 59500 - DNA, 20 bp, Homo sapiens
gatctaggggaaagggacaa

SEQ ID NO: 59501 - DNA, 20 bp, Homo sapiens
gatctgcaacgggtacttgc

SEQ ID NO: 59502 - DNA, 20 bp, Homo sapiens
gatccgaccggaagagaaga

SEQ ID NO: 59503 - DNA, 20 bp, Homo sapiens
gatcgagagcctgaatgaag

SEQ ID NO: 59504 - DNA, 20 bp, Homo sapiens
gatctctctcctctctgacc

SEQ ID NO: 59505 - DNA, 20 bp, Homo sapiens
gatctcagcaatctcctgct

SEQ ID NO: 59506 - DNA, 20 bp, Homo sapiens
gatctcgtctgtgagagtgt

SEQ ID NO: 59507 - DNA, 20 bp, Homo sapiens
gatcattcttcactcaggac

SEQ ID NO: 59508 - DNA, 20 bp, Homo sapiens
gatccctgtgtggaaatcat

SEQ ID NO: 59509 - DNA, 20 bp, Homo sapiens
gatcctcaattttttcccat

SEQ ID NO: 59510 - DNA, 20 bp, Homo sapiens
gatccagagtgtgaagacag

SEQ ID NO: 59511 - DNA, 20 bp, Homo sapiens
gatcactgactccctgaagc

SEQ ID NO: 59512 - DNA, 20 bp, Homo sapiens
gatcagagttcctcctactt

SEQ ID NO: 59513 - DNA, 20 bp, Homo sapiens
gatcagcaagaagcttgcag

SEQ ID NO: 59514 - DNA, 20 bp, Homo sapiens
gatcaggaatggggtcaggt

SEQ ID NO: 59515 - DNA, 20 bp, Homo sapiens
gatcattctcacacccagtg

SEQ ID NO: 59516 - DNA, 20 bp, Homo sapiens
gatctgggtcttggctcggg

SEQ ID NO: 59517 - DNA, 20 bp, Homo sapiens
gatctgtatcccaagaacct

SEQ ID NO: 59518 - DNA, 20 bp, Homo sapiens
gatcaaacacgtcactcata

SEQ ID NO: 59519 - DNA, 20 bp, Homo sapiens
gatctagaattggtggcttt

SEQ ID NO: 59520 - DNA, 20 bp, Homo sapiens
gatcctgcaggctctgcggg

SEQ ID NO: 59521 - DNA, 20 bp, Homo sapiens
gatctggccatcaagcttcc

SEQ ID NO: 59522 - DNA, 20 bp, Homo sapiens
gatctctttgaaatattcaa

SEQ ID NO: 59523 - DNA, 20 bp, Homo sapiens
gatcctgaagagactgaaaa

SEQ ID NO: 59524 - DNA, 20 bp, Homo sapiens
gatcttctcggctcagcagc

SEQ ID NO: 59525 - DNA, 20 bp, Homo sapiens
gatcccttgagcccagaggt

SEQ ID NO: 59526 - DNA, 20 bp, Homo sapiens
gatctagaagaaagggcaat

SEQ ID NO: 59527 - DNA, 20 bp, Homo sapiens
gatcacaacgctgcccagga

SEQ ID NO: 59528 - DNA, 20 bp, Homo sapiens
gatccatgcatttcctggtt

SEQ ID NO: 59529 - DNA, 20 bp, Homo sapiens
gatctcaaaggaaacaaaca

SEQ ID NO: 59530 - DNA, 20 bp, Homo sapiens
gatctttgccaccttcgtga

SEQ ID NO: 59531 - DNA, 20 bp, Homo sapiens
gatcatcctaatcatcttat

SEQ ID NO: 59532 - DNA, 20 bp, Homo sapiens
gatctgctttcaagagaagt

SEQ ID NO: 59533 - DNA, 20 bp, Homo sapiens
gatcaaagtggtggagaagt

SEQ ID NO: 59534 - DNA, 20 bp, Homo sapiens
gatcagagtaacacaatttt

SEQ ID NO: 59535 - DNA, 20 bp, Homo sapiens
gatcccaaaaaaggaagagg

SEQ ID NO: 59536 - DNA, 20 bp, Homo sapiens
gatccttgagctccgggact

SEQ ID NO: 59537 - DNA, 20 bp, Homo sapiens
gatctccttctcaggggcct

SEQ ID NO: 59538 - DNA, 20 bp, Homo sapiens
gatcaaaaactgccttcccc

SEQ ID NO: 59539 - DNA, 20 bp, Homo sapiens
gatcgagttggagaggaagt

SEQ ID NO: 59540 - DNA, 20 bp, Homo sapiens
gatccagcccagagacactg

SEQ ID NO: 59541 - DNA, 20 bp, Homo sapiens
gatctcgtatcactagcttg

SEQ ID NO: 59542 - DNA, 20 bp, Homo sapiens
gatcacgaaaggcagctgta

SEQ ID NO: 59543 - DNA, 20 bp, Homo sapiens
gatcatgtcttcatttttta

SEQ ID NO: 59544 - DNA, 20 bp, Homo sapiens
gatctggaaaagactcggag

SEQ ID NO: 59545 - DNA, 20 bp, Homo sapiens
gatctggggaaaacgcagct

SEQ ID NO: 59546 - DNA, 20 bp, Homo sapiens
gatcaatcccagttctcccc

SEQ ID NO: 59547 - DNA, 20 bp, Homo sapiens
gatcgacgattcaatgatga

SEQ ID NO: 59548 - DNA, 20 bp, Homo sapiens
gatccagggcctccccgcct

SEQ ID NO: 59549 - DNA, 20 bp, Homo sapiens
gatcaaggaccggcccatct

SEQ ID NO: 59550 - DNA, 20 bp, Homo sapiens
gatctgagaaatgggcgcac

SEQ ID NO: 59551 - DNA, 20 bp, Homo sapiens
gatcagagttcactttcttt

SEQ ID NO: 59552 - DNA, 20 bp, Homo sapiens
gatccctcaaaacattttaa

SEQ ID NO: 59553 - DNA, 20 bp, Homo sapiens
gatcaaataacttagggcca

SEQ ID NO: 59554 - DNA, 20 bp, Homo sapiens
gatcagatggtgaaggaaga

SEQ ID NO: 59555 - DNA, 20 bp, Homo sapiens
gatcccaaagtctaggagtg

SEQ ID NO: 59556 - DNA, 20 bp, Homo sapiens
gatcgcagaaatccacacag

SEQ ID NO: 59557 - DNA, 20 bp, Homo sapiens
gatcaatttccaaatgcttt

SEQ ID NO: 59558 - DNA, 20 bp, Homo sapiens
gatcccgacccccacggctg

SEQ ID NO: 59559 - DNA, 20 bp, Homo sapiens
gatcggggttcgggtctggc

SEQ ID NO: 59560 - DNA, 20 bp, Homo sapiens
gatcacccctaaatttctag

SEQ ID NO: 59561 - DNA, 20 bp, Homo sapiens
gatccaggaggccctcatct

SEQ ID NO: 59562 - DNA, 20 bp, Homo sapiens
gatccatggcaggaagtcaa

SEQ ID NO: 59563 - DNA, 20 bp, Homo sapiens
gatcctgctcccttctgggc

SEQ ID NO: 59564 - DNA, 20 bp, Homo sapiens
gatctcttgggcccaggact

SEQ ID NO: 59565 - DNA, 20 bp, Homo sapiens
gatcagatctgagtttatca

SEQ ID NO: 59566 - DNA, 20 bp, Homo sapiens
gatcattttctgcttcaaaa

SEQ ID NO: 59567 - DNA, 20 bp, Homo sapiens
gatccatgttggtgtctgcc

SEQ ID NO: 59568 - DNA, 20 bp, Homo sapiens
gatctctttattggaagttt

SEQ ID NO: 59569 - DNA, 20 bp, Homo sapiens
gatccatgaagttctataac

SEQ ID NO: 59570 - DNA, 20 bp, Homo sapiens
gatcttaatataaattcact

SEQ ID NO: 59571 - DNA, 20 bp, Homo sapiens
gatcatcatggacagaccct

SEQ ID NO: 59572 - DNA, 20 bp, Homo sapiens
gatctgcacaccctcagcga

SEQ ID NO: 59573 - DNA, 20 bp, Homo sapiens
gatcattgctgggcatagca

SEQ ID NO: 59574 - DNA, 20 bp, Homo sapiens
gatcagtcttgggggctgcc

SEQ ID NO: 59575 - DNA, 20 bp, Homo sapiens
gatcattgccagaatcttct

SEQ ID NO: 59576 - DNA, 20 bp, Homo sapiens
gatcctgccctacacactgg

SEQ ID NO: 59577 - DNA, 20 bp, Homo sapiens
gatctgagtgatgagacgtg

SEQ ID NO: 59578 - DNA, 20 bp, Homo sapiens
gatcaaatagtgggtattat

SEQ ID NO: 59579 - DNA, 20 bp, Homo sapiens
gatcgtgttgccatcgagcc

SEQ ID NO: 59580 - DNA, 20 bp, Homo sapiens
gatctccaaggagagccctc

SEQ ID NO: 59581 - DNA, 20 bp, Homo sapiens
gatcccatggactggagccc

SEQ ID NO: 59582 - DNA, 20 bp, Homo sapiens
gatctgcggtgatgttgagc

SEQ ID NO: 59583 - DNA, 20 bp, Homo sapiens
gatcgccgtggctattcctc

SEQ ID NO: 59584 - DNA, 20 bp, Homo sapiens
gatcaataagctttaaatta

SEQ ID NO: 59585 - DNA, 20 bp, Homo sapiens
gatcatttgagcaaatctct

SEQ ID NO: 59586 - DNA, 20 bp, Homo sapiens
gatcagtcagaaaggctttc

SEQ ID NO: 59587 - DNA, 20 bp, Homo sapiens
gatccctcctgcacactcag

SEQ ID NO: 59588 - DNA, 20 bp, Homo sapiens
gatccgtctgtgcacatgcc

SEQ ID NO: 59589 - DNA, 20 bp, Homo sapiens
gatcctgcaaatgggattgc

SEQ ID NO: 59590 - DNA, 20 bp, Homo sapiens
gatctgtgccggcttcctgc

SEQ ID NO: 59591 - DNA, 20 bp, Homo sapiens
gatcttcctgctgagtcctt

SEQ ID NO: 59592 - DNA, 20 bp, Homo sapiens
gatctggaatattgtcatta

SEQ ID NO: 59593 - DNA, 20 bp, Homo sapiens
gatcattgggatgagcatct

SEQ ID NO: 59594 - DNA, 20 bp, Homo sapiens
gatctaatttgaaaaactac

SEQ ID NO: 59595 - DNA, 20 bp, Homo sapiens
gatcgtcatcacttccatcc

SEQ ID NO: 59596 - DNA, 20 bp, Homo sapiens
gatcaatatttttatatcat

SEQ ID NO: 59597 - DNA, 20 bp, Homo sapiens
gatcagtcaaactgtagcct

SEQ ID NO: 59598 - DNA, 20 bp, Homo sapiens
gatcagaaagcatcagattc

SEQ ID NO: 59599 - DNA, 20 bp, Homo sapiens
gatcccaacactgaaggggt

SEQ ID NO: 59600 - DNA, 20 bp, Homo sapiens
gatctttggacctttccaat

SEQ ID NO: 59601 - DNA, 8097 bp, Homo sapiens
atttcctataaatatcacaaatatttccaacaaaagagcatagatgtcttttatacaattcttttgagaatgattctgcagatttctgcattttctcctcattaatttgacctgggatggttttcactgaggaaaaaaatctttaagcaaacatgttaaatgtttacctatataaaaattattacttcaggtgactccgataatataacgcatgtgtggaatgaggatgatggacagaccttatctccaagcagtctggctgcacagctcctaattctggaaaactttgaagatgccctcttaaatatatcagcaaatagtccttatattccttacttggcatgtgtgagaaatgtgactgacagtttggccagaggttcaccagaaaatctaagactcctgcagtccacaatacgatttaaaaaatcttttcttcgcaatggttcctatgaagattactttcctccagttcctgaagtcctaaaatcaaaactgtctcaacttcgaaacttgaccgaacttctttgtgaatctgaaactttcagtttgatagagaagtcatgccagctctctgatatgagctttgggagcctgtgtgaagaaagtgagtttgatctgcaactcctcgaagcggcagagctgggcaccgaaatagcagccagcttactgtaccatgacaatgtcatatctaaaaaagtgagagatttgctgactggagatccaagcaaaattaatttaaatatggatcagtttctagaacaggcactgcaaatgaattacttggaaaatatcactcagttaataccgatcatagaagccatgctgcatgtcaataacagtgcagatgcttctgaaaagccaggtcagttactagaaatgtttaaaaatgttgaagagctgaaagaagatttaaggagaacaacaggaatgtccaacaggactattgacaagttgctggccattcccatccctgataatagagctgagattatttctcaggtgttctggctgcattcctgtgatactaatatcaccactcccaaactagaagatgcaatgaaagaattctgcaacctgtctctttcagagagatcccggcagtcttacctcatcggactcacccttctgcactacttaaacatttacaacttcacatacaaggtgtttttcccgaggaaagatcaaaagccagtagaaaagatgatggagctcttcataagactaaaagagattctcaatcagatggcttctggcacacatccgctgctagacaaaatgagatccctgaagcaaatgcatctgcccagaagtgttccattaacacaggcaatgtacagaagcaaccgaatgaacacaccacaaggatcatttagcaccatctcccaagcattatgttctcaaggaattaccactgaatatttaactgccatgctgccctcttcccagaggccaaaaggcaaccacaccaaggattttttgacttataaattaactaaagagcaaattgcttcaaaatatggaattcccataaattccacaccattttgcttctccctttataaagacatcattaacatgcccgctggacctgtgatttgggctttcttgaaacctatgttgttgggaagaattttgtatgcaccatataacccagtcacaaaggcaataatggaaaagtccaatgtaactctgagacagctggcggaattaagagaaaaatctcaagagtggatggataagtcgccacttttcatgaattccttccatctgttaaaccaggcaattccaatgctccagaatactctaaggaacccttttgtgcaagtttttgtaaagttctccgtgggactcgatgctgttgaactattgaaacagatagatgaactcgatattctaagactgaaattagagaacaacattgacatcatcgatcagcttaacacactatcttccctgacagtaaatatttcctcttgtgtattatatgaccgtattcaggcagcaaaaaccatagatgaaatggagagagaggctaaaaggctctacaaaagcaacgaactctttggaagtgttatttttaagcttccttctaacagaagctggcacagaggctatgactctggaaatgtctttcttcctcctgtcataaaatataccatccggatgagtctcaagaccgcacagaccacaagaagcctaagaaccaagatttgggctccagggccacacaattctccatcacacaaccagatctatggcagggcttttatttatttacaggatagtattgaaagagcaatcattgaattgcaaactggaaggaactcccaggaaatagcagtccaggttcaagcaattccttatccctgcttcatgaaagacaacttcctaaccagtgtctcttattctcttccaattgtgcttatggttgcctgggttgtatttatagctgcctttgtaaaaaagcttgtctatgagaaagacctccggcttcatgagtacatgaagatgatgggtgtgaactcctgcagccatttctttgcctggcttatagagagtgttggatttttactggttaccatcgtgatcctcatcattatactcaagtttggcaatattcttcctaaaacaaatgggttcattttgttcctgtatttttcggactacagcttctcggttattgccatgagctatcttatcagtgtcttcttcaacaacaccaacattgcagctctgatcggaagcctcatctacatcattgccttctttccatttattgttctggttacagtggagaatgagttgagctatgtattgaaagtgttcatgagcctgctgtccccaacagcattcagctatgcaagccaatacattgcacgatacgaagaacagggcattggtcttcagtgggaaaatatgtacacctccccggttcaggatgacaccacctcatttggctggctgtgctgtctaatcctagctgactctttcatttatttccttattgcttggtatgtcaggaatgtcttcccagggacatacggtatggcagctccctggtattttccaattcttccttcctattggaaggagcgatttgggtgtgcagaggtgaagcctgagaagagcaatggcctcatgtttactaacatcatgatgcagaacaccaacccatctgccagtcctgaatacatgttttcctctaacatcgagcctgaacctaaagatctcacagtcggggttgccctgcatggggtcacaaagatctatggctcaaaagttgctgttgataacctcaatctgaacttttatgaagggcatattacttcattgctggggcccaatggagctgggaaaactactaccatttccatgttaactgggctgtttggggcctcagcaggcaccatttttgtatatggaaaagatatcaaaacagacctacacacggtacggaagaacatgggagtctgtatgcagcacgacgtcttgttcagttacctcactactaaggagcaccttctcctatatggttccatcaaagttcctcactggactaaaaagcagctccacgaggaagtaaaaaggactttaaaagatactggactatatagccatcgtcataagagagttggaacactgtcaggaggcatgaagaggaagttatctatatccatagctctcattggtggatcaagggtagtaattttggatgaaccatctactggagttgacccatgttctcgccgaagtatatgggatgttatatccaagaacaaaactgccagaacaatcattctgtcaacgcaccacttggacgaggctgaagtgctgagtgaccgcatcgccttcctggagcagggtgggcttaggtgctgtgggtccccattttacctcaaggaagcctttggcgatgggtatcacctcacgcttaccaagaagaagagtccaaatttaaatgcaaatgcagtatgtgacaccatggccgtgacagcaatgatccaatcacatctccccgaagcctacctcaaggaggatattgggggagagcttgtttatgtacttcctccattcagcaccaaagtctcaggggcctacctgtcactcctacgggcactcgacaatggcatgggtgacctcaacatcgggtgctacggcatttcagataccaccgtggaggaggtctttctgaacttgaccaaagagtcacaaaaaaatagtgctatgagtcttgagcacttaacacaaaagaaaattgggaattccaatgccaatggcatctcaactcctgacgatttatctgtgagcagcagcaatttcacagacagagatgacaaaatcctgacaagaggagagaggctggatggctttggactgttgctgaagaagatcatggctatactcatcaagaggttccaccacacccgcaggaactggaaaggtctcattgctcaggttatcctccccatcgtctttgttaccactgccatgggccttggcacactgagaaattccagcaacagttatccagagattcagatctccccctctctttatggtacctccgaacagacagccttctatgctaattatcacccgagcacggaagcacttgtctcagcaatgtgggacttccctggaattgacaacatgtgtctgaacaccagtgatctacagtgtttaaacaaagacagtctggaaaaatggaacaccagtggagaacccatcactaattttggtgtttgctcctgctcagaaaatgtccaggaatgtcctaaatttaactattccccaccgcacagaagaacttactcatcccaggtaatttataacctcactgggcaacgagtggaaaattatcttatatcaactgcaaatgagtttgtccaaaaaagatatggaggttggagttttgggctgcctttgacaaaagaccttcgttttgatataacaggagtccctgccaatagaacacttgccaaggtatggtatgatccagaaggctatcactcccttccagcttacctcaacagcctgaataatttccttctgcgagttaacatgtcaaaatacgatgctgcccgacatggcatcatcatgtatagccatccttatccaggagtgcaagaccaagaacaagccacaatcagcagtttaatcgatattttagtggcactgtctatcttgatgggctactctgtcaccaccgccagctttgtcacctatgttgtaagggaacatcaaaccaaagccaaacagttgcagcacatttcaggcattggcgtgacatgctactgggtaacaaacttcatttatgacatggttttctacttggtgcctgtagcgttttcaattggtatcattgcgattttcaaattacctgcattctacagtgaaaacaacctaggcgctgtatctctcctacttctcctgtttgggtatgcaacattttcctggatgtacttgctggctgggctcttccatgaaacaggaatggccttcatcacttacgtctgtgtcaacttgttttttggcattaattccattgtttccctgtcagtggtatactttctttccaaggaaaagcctaatgatccgactttagaacttatttctgaaaccctcaagcgcattttcctgattttcccacaattctgttttggctacggtttgattgaactttctcaacaacagtcggtcctagacttcttaaaagcatatggagtggaatacccaaatgaaacctttgagatgaataaactaggtgcaatgtttgtggctttggtttctcagggcaccatgtttttttccttgcgactcttaatcaacgaatccctgataaagaaactcaggcttttcttcagaaaatttaattcttcacatgtaagggagacaatagatgaggatgaagatgtgcgggctgagagattaagagttgagagtggtgcagctgaatttgacttggtccaactttattgtctcacaaagacctaccaacttatccacaaaaagattatagctgtaaacaacatcagcattgggatacctgctggagagtgttttgggcttcttggagtgaatggagcaggaaagaccactatattcaagatgctgacaggagacatcattccttcaagtggaaacattctgatcagaaataagaccggatctctgggtcacgttgattctcacagctcattagttggctactgtcctcaggaagatgccttagatgacctggtaactgtggaagaacatttgtatttctatgccagggtacatggaattccagaaaaggatattaaagaaactgttcataaactccttaggagacttcacctgatgcccttcaaggacagagctacctctatgtgcagttatggcacaaaaagaaaattatccactgcactggccttgatagggaaaccttccattctactgctggatgagccgagctctggcatggatccgaagtcgaaacggcacctctggaagatcatttcagaagaagtacagaacaaatgttccgtcatcctcacatctcacagcatggaagaatgtgaagctctctgtaccaggttggccattatggtgaatggaaagtttcaatgtattggatctttgcagcacataaagagcaggtttggacgaggatttactgtcaaagttcacttgaagaataacaaagtgaccatggagaccctcacaaagttcatgcagctgcactttccaaaaacatacttaaaagatcagcacctcagcatgctagagtatcatgtaccagtcacagcaggaggagtcgcaaacatttttgatctgctggaaaccaacaagactgctttaaatattacaaatttcttagtgagtcagaccactctggaagaggttttcatcaactttgccaaagaccagaagtcctatgaaactgctgataccagcagccaaggttccactataagtgttgactcacaagatgaccagatggagtcttaacacttccagcaaactcaatctcagcgtgtgaccaatggcttcattttgaagaaaagccacagaagatacacttccgcaagatatcttcattttaaagtaaagtaatatactgtatggaaagttacaactgtgttagactaacaagtaattataaaaggaaatttttccttctaaggtcagtgagtgttgttgctactgaaatgaattcctgtatactcaacactgtgagcatgctaatgtatatgctggtgattcttatgcaaaggtgaagccacctcaagatgaatatcttaatttattactttcaataaaaagacagtttaaaaggcatggattttggtagttgaaatataagagtggagaagaaaagtcagatggtttgtggcaggtgccaccgggcaagcagacaacataatttatttccagaaaacaacagaatgaacatcatcatgaatacatgaatcggctgtgatgtgtgaactgctaagggccaaatgaacgtttgcagagcagtgggcacaatgtttacaatgtatgtgtatgtcactttcggtacctgtgaatgcatggggacgtgctgaacccgaaaaaaagtgcctttccataaggactgcaatagagagggcaatttaccctggtggtacacggaacctagattcactcctgccatgccttgccaatagtaagctgcagggtggaacaagaaatcacttgctctggggggaagggaggggggaatgggtgtgtcagctgggtagatacaaaccctgaaaagagaatccatgtgctactggcaggcaacattttttaaagctctttcagaaaccctcatatttggggtttcttttcaggaaacattcctgtggagggaaaacgaatatgaagataattttcagctaattatctgggtgacccagaatcgtgtatatggctataggatagacttcttaataatggcaagtgacgtggccctggggaaaggtgctttatgtaccgtgtgtgcgtgtatgtgtgtgtatctatacaagtttgtcagctttggcatgactgtttgtctcgaaaaccaataaactcaaagtttagaaaaactcaaaaaaaaaaaaa

SEQ ID NO: 59602 - DNA, 9112 bp, Homo sapiens
gaagagttgattgagaagtgcctcttggttaaggattaaccacagggaaaaatccagcagaaacagaagaactgtgggtttcttaccccagccctcaaggaagctatgccgtgaaaggggtactgatacactgacatacagcaagttggacggggcatcagttcttcatttgtggagtggagaaaagaagaggaaatctctcatttggggcatttgaaggatggcttccctgtttcatcagcttcagatcctggtctggaaaaattggctaggtgtaaaaaggcagccgctttggacacttgtcttgatcttatggccagtcattattttcataattttggctattactcggaccaaatttcctccaactgcaaaaccaacttgttacctcgcacctcgaaaccttcctagtactggattctttccattcctgcagaccctactctgtgacacagactctaaatgcaaagacacaccctatggcccacaagatctgcttcgtaggaaaggaattgatgatgcactatttaaagacagtgagattctgagaaagtcatccaacctggataaggacagcagtttatcattccagagcacccaagttccagaaagaaggcatgcatcactagccacagtatttcccagtccaagttctgatttggaaatccccggaacatatactttcaatggcagtcaagtgctcgcacgaattcttggcttggaaaagctgttaaagcaaaattcaacttcagaagatatacgaagagaactatgtgacagctattcaggatacattgtggatgatgccttctcttggacctttctaggaagaaatgtttttaacaaattttgcctttctaacatgacccttttagagtcttctctccaagaactaaacaaacagttctcccagctatccagtgaccccaacaatcagaagatagtgtttcaggaaatagtcagaatgctgtctttcttctcacaagtgcaagagcagaaagctgtgtggcagcttctgtctagttttccaaatgtgtttcagaatgacacatcactaagcaatctatttgatgttcttcgaaaggcaaacagtgtgctgctggttgtgcagaaggtttatccacgttttgcaactaacgaaggtttcagaaccctccagaagtctgttaaacatctgctgtacactctggactccccagctcaaggtgactccgataatataacgcatgtgtggaatgaggatgatggacagaccttatctccaagcagtctggctgcacagctcctaattctggaaaactttgaagatgccctcttaaatatatcagcaaatagtccttatattccttacttggcatgtgtgagaaatgtgactgacagtttggccagaggttcaccagaaaatctaagactcctgcagtccacaatacgatttaaaaaatcttttcttcgcaatggttcctatgaagattactttcctccagttcctgaagtcctaaaatcaaaactgtctcaacttcgaaacttgaccgaacttctttgtgaatctgaaactttcagtttgatagagaagtcatgccagctctctgatatgagctttgggagcctgtgtgaagaaagtgagtttgatctgcaactcctcgaagcggcagagctgggcaccgaaatagcagccagcttactgtaccatgacaatgtcatatctaaaaaagtgagagatttgctgactggagatccaagcaaaattaatttaaatatggatcagtttctagaacaggcactgcaaatgaattacttggaaaatatcactcagttaataccgatcatagaagccatgctgcatgtcaataacagtgcagatgcttctgaaaagccaggtcagttactagaaatgtttaaaaatgttgaagagctgaaagaagatttaaggagaacaacaggaatgtccaacaggactattgacaagttgctggccattcccatccctgataatagagctgagattatttctcaggtgttctggctgcattcctgtgatactaatatcaccactcccaaactagaagatgcaatgaaagaattctgcaacctgtctctttcagagagatcccggcagtcttacctcatcggactcacccttctgcactacttaaacatttacaacttcacatacaaggtgtttttcccgaggaaagatcaaaagccagtagaaaagatgatggagctcttcataagactaaaagagattctcaatcagatggcttctggcacacatccgctgctagacaaaatgagatccctgaagcaaatgcatctgcccagaagtgttccattaacacaggcaatgtacagaagcaaccgaatgaacacaccacaaggatcatttagcaccatctcccaagcattatgttctcaaggaattaccactgaatatttaactgccatgctgccctcttcccagaggccaaaaggcaaccacaccaaggattttttgacttataaattaactaaagagcaaattgcttcaaaatatggaattcccataaattccacaccattttgcttctccctttataaagacatcattaacatgcccgctggacctgtgatttgggctttcttgaaacctatgttgttgggaagaattttgtatgcaccatataacccagtcacaaaggcaataatggaaaagtccaatgtaactctgagacagctggcggaattaagagaaaaatctcaagagtggatggataagtcgccacttttcatgaattccttccatctgttaaaccaggcaattccaatgctccagaatactctaaggaacccttttgtgcaagtttttgtaaagttctccgtgggactcgatgctgttgaactattgaaacagatagatgaactcgatattctaagactgaaattagagaacaacattgacatcatcgatcagcttaacacactatcttccctgacagtaaatatttcctcttgtgtattatatgaccgtattcaggcagcaaaaaccatagatgaaatggagagagaggctaaaaggctctacaaaagcaacgaactctttggaagtgttatttttaagcttccttctaacagaagctggcacagaggctatgactctggaaatgtctttcttcctcctgtcataaaatataccatccggatgagtctcaagaccgcacagaccacaagaagcctaagaaccaagatttgggctccagggccacacaattctccatcacacaaccagatctatggcagggcttttatttatttacaggatagtattgaaagagcaatcattgaattgcaaactggaaggaactcccaggaaatagcagtccaggttcaagcaattccttatccctgcttcatgaaagacaacttcctaaccagtgtctcttattctcttccaattgtgcttatggttgcctgggttgtatttatagctgcctttgtaaaaaagcttgtctatgagaaagacctccggcttcatgagtacatgaagatgatgggtgtgaactcctgcagccatttctttgcctggcttatagagagtgttggatttttactggttaccatcgtgatcctcatcattatactcaagtttggcaatattcttcctaaaacaaatgggttcattttgttcctgtatttttcggactacagcttctcggttattgccatgagctatcttatcagtgtcttcttcaacaacaccaacattgcagctctgatcggaagcctcatctacatcattgccttctttccatttattgttctggttacagtggagaatgagttgagctatgtattgaaagtgttcatgagcctgctgtccccaacagcattcagctatgcaagccaatacattgcacgatacgaagaacagggcattggtcttcagtgggaaaatatgtacacctccccggttcaggatgacaccacctcatttggctggctgtgctgtctaatcctagctgactctttcatttatttccttattgcttggtatgtcaggaatgtcttcccagggacatacggtatggcagctccctggtattttccaattcttccttcctattggaaggagcgatttgggtgtgcagaggtgaagcctgagaagagcaatggcctcatgtttactaacatcatgatgcagaacaccaacccatctgccagtcctgaatacatgttttcctctaacatcgagcctgaacctaaagatctcacagtcggggttgccctgcatggggtcacaaagatctatggctcaaaagttgctgttgataacctcaatctgaacttttatgaagggcatattacttcattgctggggcccaatggagctgggaaaactactaccatttccatgttaactgggctgtttggggcctcagcaggcaccatttttgtatatggaaaagatatcaaaacagacctacacacggtacggaagaacatgggagtctgtatgcagcacgacgtcttgttcagttacctcactactaaggagcaccttctcctatatggttccatcaaagttcctcactggactaaaaagcagctccacgaggaagtaaaaaggactttaaaagatactggactatatagccatcgtcataagagagttggaacactgtcaggaggcatgaagaggaagttatctatatccatagctctcattggtggatcaagggtagtaattttggatgaaccatctactggagttgacccatgttctcgccgaagtatatgggatgttatatccaagaacaaaactgccagaacaatcattctgtcaacgcaccacttggacgaggctgaagtgctgagtgaccgcatcgccttcctggagcagggtgggcttaggtgctgtgggtccccattttacctcaaggaagcctttggcgatgggtatcacctcacgcttaccaagaagaagagtccaaatttaaatgcaaatgcagtatgtgacaccatggccgtgacagcaatgatccaatcacatctccccgaagcctacctcaaggaggatattgggggagagcttgtttatgtacttcctccattcagcaccaaagtctcaggggcctacctgtcactcctacgggcactcgacaatggcatgggtgacctcaacatcgggtgctacggcatttcagataccaccgtggaggaggtctttctgaacttgaccaaagagtcacaaaaaaatagtgctatgagtcttgagcacttaacacaaaagaaaattgggaattccaatgccaatggcatctcaactcctgacgatttatctgtgagcagcagcaatttcacagacagagatgacaaaatcctgacaagaggagagaggctggatggctttggactgttgctgaagaagatcatggctatactcatcaagaggttccaccacacccgcaggaactggaaaggtctcattgctcaggttatcctccccatcgtctttgttaccactgccatgggccttggcacactgagaaattccagcaacagttatccagagattcagatctccccctctctttatggtacctccgaacagacagccttctatgctaattatcacccgagcacggaagcacttgtctcagcaatgtgggacttccctggaattgacaacatgtgtctgaacaccagtgatctacagtgtttaaacaaagacagtctggaaaaatggaacaccagtggagaacccatcactaattttggtgtttgctcctgctcagaaaatgtccaggaatgtcctaaatttaactattccccaccgcacagaagaacttactcatcccaggtaatttataacctcactgggcaacgagtggaaaattatcttatatcaactgcaaatgagtttgtccaaaaaagatatggaggttggagttttgggctgcctttgacaaaagaccttcgttttgatataacaggagtccctgccaatagaacacttgccaaggtatggtatgatccagaaggctatcactcccttccagcttacctcaacagcctgaataatttccttctgcgagttaacatgtcaaaatacgatgctgcccgacatggcatcatcatgtatagccatccttatccaggagtgcaagaccaagaacaagccacaatcagcagtttaatcgatattttagtggcactgtctatcttgatgggctactctgtcaccaccgccagctttgtcacctatgttgtaagggaacatcaaaccaaagccaaacagttgcagcacatttcaggcattggcgtgacatgctactgggtaacaaacttcatttatgacatggttttctacttggtgcctgtagcgttttcaattggtatcattgcgattttcaaattacctgcattctacagtgaaaacaacctaggcgctgtatctctcctacttctcctgtttgggtatgcaacattttcctggatgtacttgctggctgggctcttccatgaaacaggaatggccttcatcacttacgtctgtgtcaacttgttttttggcattaattccattgtttccctgtcagtggtatactttctttccaaggaaaagcctaatgatccgactttagaacttatttctgaaaccctcaagcgcattttcctgattttcccacaattctgttttggctacggtttgattgaactttctcaacaacagtcggtcctagacttcttaaaagcatatggagtggaatacccaaatgaaacctttgagatgaataaactaggtgcaatgtttgtggctttggtttctcagggcaccatgtttttttccttgcgactcttaatcaacgaatccctgataaagaaactcaggcttttcttcagaaaatttaattcttcacatgtaagggagacaatagatgaggatgaagatgtgcgggctgagagattaagagttgagagtggtgcagctgaatttgacttggtccaactttattgtctcacaaagacctaccaacttatccacaaaaagattatagctgtaaacaacatcagcattgggatacctgctggagagtgttttgggcttcttggagtgaatggagcaggaaagaccactatattcaagatgctgacaggagacatcattccttcaagtggaaacattctgatcagaaataagaccggatctctgggtcacgttgattctcacagctcattagttggctactgtcctcaggaagatgccttagatgacctggtaactgtggaagaacatttgtatttctatgccagggtacatggaattccagaaaaggatattaaagaaactgttcataaactccttaggagacttcacctgatgcccttcaaggacagagctacctctatgtgcagttatggcacaaaaagaaaattatccactgcactggccttgatagggaaaccttccattctactgctggatgagccgagctctggcatggatccgaagtcgaaacggcacctctggaagatcatttcagaagaagtacagaacaaatgttccgtcatcctcacatctcacagcatggaagaatgtgaagctctctgtaccaggttggccattatggtgaatggaaagtttcaatgtattggatctttgcagcacataaagagcaggtttggacgaggatttactgtcaaagttcacttgaagaataacaaagtgaccatggagaccctcacaaagttcatgcagctgcactttccaaaaacatacttaaaagatcagcacctcagcatgctagagtatcatgtaccagtcacagcaggaggagtcgcaaacatttttgatctgctggaaaccaacaagactgctttaaatattacaaatttcttagtgagtcagaccactctggaagaggttttcatcaactttgccaaagaccagaagtcctatgaaactgctgataccagcagccaaggttccactataagtgttgactcacaagatgaccagatggagtcttaacacttccagcaaactcaatctcagcgtgtgaccaatggcttcattttgaagaaaagccacagaagatacacttccgcaagatatcttcattttaaagtaaagtaatatactgtatggaaagttacaactgtgttagactaacaagtaattataaaaggaaatttttccttctaaggtcagtgagtgttgttgctactgaaatgaattcctgtatactcaacactgtgagcatgctaatgtatatgctggtgattcttatgcaaaggtgaagccacctcaagatgaatatcttaatttattactttcaataaaaagacagtttaaaaggcatggattttggtagttgaaatataagagtggagaagaaaagtcagatggtttgtggcaggtgccaccgggcaagcagacaacataatttatttccagaaaacaacagaatgaacatcatcatgaatacatgaatcggctgtgatgtgtgaactgctaagggccaaatgaacgtttgcagagcagtgggcacaatgtttacaatgtatgtgtatgtcactttcggtacctgtgaatgcatggggacgtgctgaacccgaaaaaaagtgcctttccataaggactgcaatagagagggcaatttaccctggtggtacacggaacctagattcactcctgccatgccttgccaatagtaagctgcagggtggaacaagaaatcacttgctctggggggaagggaggggggaatgggtgtgtcagctgggtagatacaaaccctgaaaagagaatccatgtgctactggcaggcaacattttttaaagctctttcagaaaccctcatatttggggtttcttttcaggaaacattcctgtggagggaaaacgaatatgaagataattttcagctaattatctgggtgacccagaatcgtgtatatggctataggatagacttcttaataatggcaagtgacgtggccctggggaaaggtgctttatgtaccgtgtgtgcgtgtatgtgtgtgtatctatacaagtttgtcagctttggcatgactgtttgtctcgaaaaccaataaactcaaagtttagaaaaactcaaaaaaaaaaaaa

SEQ ID NO: 59603 - DNA, 2660 bp, Homo sapiens
accccattgattaccccattgccaggcgtgggcacgggagttggtttgggagctgccagtctcctgggaggatcgcagtcagcagagcagggctgaggcctgggggtaggagcagagcctgcgcatctggaggcagcatgtccaagaaagggagtggaggtgcagcgaaggacccaggggcagagcccacgctgggatggaccccttcgaggacacgctgcggcggctgcgtgaggccttcaactgagggcgcacgcggccggccgagttccgggctgcgcagctccagggcctgggccacttccttcaagaaaacaagcagcttctgcgcgacgtgctggcccaggacctgcataagccagctttcgaggcagacatatctgagctcatcctttgccagaacgaggttgactacgctctcaagaacctgcaggcctggatgaaggatgaaccacggtccacgaacctgttcatgaagctggactcggtcttcatctggaaggaaccctttggcctggtcctcatcatcgcaccctggaactacccactgaacctgaccctggtgctcctggtgggcgccctcgccgcagggagttgcgtggtgctgaagccgtcagaaatcagccagggcacagagaaggtcctggctgaggtgctgccccagtacctggaccagagctgctttgccgtggtgctgggcggaccccaggagacagggcagctgctagagcacaagttggactacatcttcttcacagggagccctcgtgtgggcaagattgtcatgactgctgccaccaagcacctgacgcctgtcaccctggagctggggggcaagaacccctgctacgtggacgacaactgcgacccccagaccgtggccaaccgcgtggcctggttctgctacttcaatgccggccagacctgcgtggcccctgactacgtcctgtgcagccccgagatgcaggagaggctgctgcccgccctgcagagcaccatcacccgtttctatggcgacgacccccagagctccccaaacctgggccgcatcatcaaccagaaacagttccagcggctgcgggcattgctgggctgcggccgcgtggccattgggggccagagcaacgagagcgatcgctacatcgcccccacggtgctggtggacgtgcaggagacggagcctgtgatgcaggaggagatcttcgggcccatcctgcccatcgtgaacgtgcagagcgtggacgaggccatcaagttcatcaaccggcaggagaagcccctggccctgtacgccttctccaacagcagccaggttgtgaaccagatgctggagcggaccagcagcggcagctttggaggcaatgagggcttcacctacatatctctgctgtccgtgccattcgggggagtcggccacagtgggatgggccggtaccacggcaagttcaccttcgacaccttctcccaccaccgcacctgcctgctcgccccctccggcctggagaaattaaaggagatccactacccaccctataccgactggaaccagcagctgttacgctggggcatgggctcccagagctgcaccctcctgtgagcgtcccacccgcctccaacgggtcacacagagaaacctgagtctagccatgaggggcttatgctcccaactcacattgttcctccagaccgcaggttcccccagcctcaggttgctggagctgtcacatgactgcatcctgcctgccagggctgcaaagcaaggtcttgcttctatctgggggacgctgctcgagagaggccaagaggccgcagaacatgccaggtgtcctcactcaccccaccctccccaattccagccctttgccctctcggtcagggttggccaggcccagtcacaggggcagtgtcaccctggaaaatacagtgccctgccttcttaggggcatcagccctgaacggttgagagcgtggagccctccaggcctttgctctcccctctaggcacacgcgcacttccatctctgccccatcccaactgcaccagcactgcctcccccagggatcctctcacatcccacactggtctctgcaccacccctctggttcacaccgcaccctgcactcacccacagcagctccatccactgggaaaactggggtttgcatcactccactgcacagtgttagtgggacctgggggcaagtcccttgacttctctgagcctcagtttccttatgtgaaagttgctggaaccaaaatggagtcacttatgccaaactctaataaaatggagtcggggggccacatagaagccctcacacacacatgcccgtaacaggatttatcacaagacacgcctgcatgtagaccagacacagggcgtatggaaagcacgtcctcaagactgtagtattccagatgagctgcagatgcttacctaccacggccgtctccaccagaaaaccatcgccaactcctgcgatcagcttgtgacttacaaaccttgtttaaaagctgcttacatggacttctgtcctttaaaagcttccccttggctgtggccctctgtgtatgcctgggatccttccaagcactcatagcccagataggaatcctctgctcctcccaaataaattcatctgttctggaaaaaaaaaaa

SEQ ID NO: 59604 - DNA, 2504 bp, Homo sapiens
gtgaagaaggatgtggttgcttccccttccaccataactgatggaccccttcgaggacacgctgcggcggctgcgtgaggccttcaactgagggcgcacgcggccggccgagttccgggctgcgcagctccagggcctgggccacttccttcaagaaaacaagcagcttctgcgcgacgtgctggcccaggacctgcataagccagctttcgaggcagacatatctgagctcatcctttgccagaacgaggttgactacgctctcaagaacctgcaggcctggatgaaggatgaaccacggtccacgaacctgttcatgaagctggactcggtcttcatctggaaggaaccctttggcctggtcctcatcatcgcaccctggaactacccactgaacctgaccctggtgctcctggtgggcgccctcgccgcagggagttgcgtggtgctgaagccgtcagaaatcagccagggcacagagaaggtcctggctgaggtgctgccccagtacctggaccagagctgctttgccgtggtgctgggcggaccccaggagacagggcagctgctagagcacaagttggactacatcttcttcacagggagccctcgtgtgggcaagattgtcatgactgctgccaccaagcacctgacgcctgtcaccctggagctggggggcaagaacccctgctacgtggacgacaactgcgacccccagaccgtggccaaccgcgtggcctggttctgctacttcaatgccggccagacctgcgtggcccctgactacgtcctgtgcagccccgagatgcaggagaggctgctgcccgccctgcagagcaccatcacccgtttctatggcgacgacccccagagctccccaaacctgggccgcatcatcaaccagaaacagttccagcggctgcgggcattgctgggctgcggccgcgtggccattgggggccagagcaacgagagcgatcgctacatcgcccccacggtgctggtggacgtgcaggagacggagcctgtgatgcaggaggagatcttcgggcccatcctgcccatcgtgaacgtgcagagcgtggacgaggccatcaagttcatcaaccggcaggagaagcccctggccctgtacgccttctccaacagcagccaggttgtgaaccagatgctggagcggaccagcagcggcagctttggaggcaatgagggcttcacctacatatctctgctgtccgtgccattcgggggagtcggccacagtgggatgggccggtaccacggcaagttcaccttcgacaccttctcccaccaccgcacctgcctgctcgccccctccggcctggagaaattaaaggagatccactacccaccctataccgactggaaccagcagctgttacgctggggcatgggctcccagagctgcaccctcctgtgagcgtcccacccgcctccaacgggtcacacagagaaacctgagtctagccatgaggggcttatgctcccaactcacattgttcctccagaccgcaggttcccccagcctcaggttgctggagctgtcacatgactgcatcctgcctgccagggctgcaaagcaaggtcttgcttctatctgggggacgctgctcgagagaggccaagaggccgcagaacatgccaggtgtcctcactcaccccaccctccccaattccagccctttgccctctcggtcagggttggccaggcccagtcacaggggcagtgtcaccctggaaaatacagtgccctgccttcttaggggcatcagccctgaacggttgagagcgtggagccctccaggcctttgctctcccctctaggcacacgcgcacttccatctctgccccatcccaactgcaccagcactgcctcccccagggatcctctcacatcccacactggtctctgcaccacccctctggttcacaccgcaccctgcactcacccacagcagctccatccactgggaaaactggggtttgcatcactccactgcacagtgttagtgggacctgggggcaagtcccttgacttctctgagcctcagtttccttatgtgaaagttgctggaaccaaaatggagtcacttatgccaaactctaataaaatggagtcggggggccacatagaagccctcacacacacatgcccgtaacaggatttatcacaagacacgcctgcatgtagaccagacacagggcgtatggaaagcacgtcctcaagactgtagtattccagatgagctgcagatgcttacctaccacggccgtctccaccagaaaaccatcgccaactcctgcgatcagcttgtgacttacaaaccttgtttaaaagctgcttacatggacttctgtcctttaaaagcttccccttggctgtggccctctgtgtatgcctgggatccttccaagcactcatagcccagataggaatcctctgctcctcccaaataaattcatctgttctggaaaaaaaaaaa

SEQ ID NO: 59605 - DNA, 2335 bp, Homo sapiens
cggctcccctcgcctaagctgctggggggcgccatgggccgctaccgcatccgcgtggccaccggggcctggctcttctccgggtcgtacaaccgcgtgcagctttggctggtcgggacgcgcggggaggcggagctggagctgcagctgcggccggcgcggggcgaggaggaggagtttgatcatgacgttgcagaggacttggggctcctgcagttcgtgaggctgcgcaagcaccactggctggtggacgacgcgtggttctgcgaccgcatcacggtgcagggccctggagcctgcgcggaggtggccttcccgtgctaccgctgggtgcagggcgaggacatcctgagcctgcccgagggcaccgcccgcctgccaggagacaatgctttggacatgttccagaagcatcgagagaaggaactgaaagacagacagcagatctactgctgggccacctggaaggaagggttacccctgaccatcgctgcagaccgtaaggatgatctacctccaaatatgagattccatgaggagaagaggctggactttgaatggacactgaaggcaggggctctggagatggccctcaaacgtgtttacaccctcctgagctcctggaactgcctagaagactttgatcagatcttctggggccagaagagtgccctggctgagaaggttcgccagtgctggcaggatgatgagttgttcagctaccagttcctcaatggtgccaaccccatgctgttgagacgctcgacctctctgccctccaggctagtgctgccctcagggatggaagagcttcgggctcaactggagaaagaacttcagaatggttccctgtttgaagctgacttcatccttctggatggaattccagccaacgtgatccgaggagagaagcaatacctggctgcccccctcgttatgctgaagatggagcccaatgggaagctgcagcccatggtcatccagattcagcctcccaaccccagctctccaaccccaacactgttcctgccctcagaccccccacttgcctggctcctggcaaagtcctgggtccgaaattcagatttccaactgcacgagatccagtatcacttgctgaacacgcacctggtggctgaggtcatcgctgtcgccaccatgcggtgcctcccaggactgcaccccatcttcaagttcctgatcccccatatccgctacaccatggaaatcaacacccgggcccggacccaactcatctcagatggaggaatttttgataaggcagtgagcacaggtggagggggccatgtacagttgctccgtcgggcggcagctcagctgacctactgctccctctgtcctcctgacgacctggctgaccggggcctgctgggactcccaggtgctctctatgcccatgatgctttacggctctgggagatcattgccaggtatgtggaggggatcgtccacctcttctaccaaagggatgacatagtgaagggggaccctgagctgcaggcctggtgtcgggagatcacggaggtggggctgtgccaggcccaggaccgaggtttccctgtctccttccagtcccagagtcaactctgccatttcctcaccatgtgcgtcttcacgtgcactgcccagcatgccgccatcaaccagggccagctggactggtatgcctgggtccctaatgctccatgcacaatgcggatgcccccacccaccaccaaggaagatgtgacgatggccacagtgatggggtcactacctgatgtccggcaggcctgtcttcaaatggccatctcatggcatctgagtcgccgccagccagacatggtgcctctggggcaccacaaagaaaaatatttctcaggccccaagcccaaagctgtgctaaaccaattccgaacagatttggaaaagctggaaaaggagattacagcccggaatgagcaacttgactggccctatgaatatctgaagcccagctgcatagagaacagtgtcaccatctgagccctagagtgactctacctgcaagatttcacatcagctttaggactgacatttctatcttgaatttcatgctttcctaaagtctctgctgctaaggctctatttcctcccccagttaaaccccctacattagtatcccactagcccaggggagcagtaaactttctctgcaaagactagatccttttttacgctttgcagaccgcatagtcactgtctcaactactcagctctcctgctgcagcatgaaggcagccacagacaacatggaaatgagtgtgactatgttccaataaaactttatggacac

SEQ ID NO: 59606 - DNA, 2469 bp, Homo sapiens
cccagacacctgctcactcaccaccagctgggctccgctgggcctgcccggcacccaccccggccaccaagggcagcagcttttccagaatttggctggcaggcctagtcaccccacctcgccacctcaccactgcacctcggaggccagccctgtccactccactctgtgcctggcttctcttgcctgccttgggccttcgtgtggccctccacggtgtctgggactgagtgcccctcttgcctcctgaagagcagccatggccacctacaaagtcagggtggccacaggcaccgacctcttgtcgggaacacgggactccatctcactgaccattgtggggacacaaggagagagccataagcagctgctgaaccactttgggagagactttgcaactggggcggtgggccagtacaccgtgcagtgccctcaggacctgggtgagctcatcatcatccgcctgcacaaagagcggtacgccttcttccccaaggacccttggtactgcaactatgtgcagatctgtgcccccaacggccgtatctaccacttccccgcctaccagtggatggatggctacgagaccctggcactccgggaggccacaggaaagacaacagcagatgactcgctccccgtcctcctggagcacagaaaagaggagatcagagccaagcaggacttctaccactggcgagtctttcttcctggcctgcccagctatgtgcacattcccagttaccgccctccggtgcggaggcatcgcaaccccaaccggcctgagtggaatggctatattccgggattcccaattctcatcaactttaaggccaccaagttcctgaacttaaatctccgctactccttcctcaagacggcctccttcttcgtccgcctggggcccatggcactggctttcaaagtccgcggcctgttggactgcaaacattcgtggaagaggctgaaggacattaggaaaattttccctggcaagaaatctgtcgtctccgagtacgtggccgagcactgggcagaggacaccttctttgggtaccagtacctcaacggcgtcaaccccggcctgatccgccgctgcacgcggatcccagacaagttccccgtcacagacgacatggtggctccgttcctgggcgagggaacgtgcttgcaagcggagctggagaaggggaacatttacctggccgactaccgcatcatggagggcatccccaccgtggagctcagcggccggaagcagcaccactgcgcccccctctgcctgctgcactttggacccgagggcaagatgatgcccatcgccatccagctcagccagacccctgggccagattgccccatcttcctgcccagtgattctgagtgggactggctgctagccaagacgtgggtacgctatgcggagttctacagccacgaggccatcgcccacctgctggagacacacctcattgctgaggccttctgcctggccttgctgaggaacctgcccatgtgccaccccctctacaagctcctcatcccccatacccgatacaccgtccagatcaacagcattggccgggccgttctcctcaatgagggggggctctctgccaagggcatgtccctgggcgtggaaggctttgctggggtgatggtacgggctctgtcggagctcacctatgacagcctctacctccccaatgactttgtggagcgtggggtccaggacctgcctggatattactaccgcgatgacagcttggcggtgtggaatgcactggagaagtatgtgacggagatcatcacctattattacccgagtgacgcagccgtggagggtgatccggaattgcagtcttgggtgcaggaaatatttaaagagtgcctcctggggcgggagagctcaggcttccctaggtgcttgcgaaccgtgcctgagctgatccgatatgtcactatagtcatctacacctgctctgccaagcacgctgctgtcaacacaggccagatggagttcaccgcctggatgcccaacttcccagcgtccatgcggaatccaccgattcagactaaggggctgaccactctggagaccttcatggacacgttgccggatgtgaagaccacgtgcatcacgctgctggtgctctggaccctcagccgagagcctgacgacaggcggcccctgggacacttcccggacattcacttcgtggaggaggccccgcggaggagcatagaggcgttccgccagcgcctgaaccagatctcacacgacatccgccagcgcaacaagtgccttcccatcccctactactacctggacccggtgctgattgagaacagcatttctatttaggagcgcgcttcccgtctctcctctccccattctgtgccctactattttcaacaaaacaaaacaaacaagcaaaaaacacaaaaacctcagagaccaaaacacca

SEQ ID NO: 59607 - DNA, 3362 bp, Homo sapiens
gcaggtgccctgtgctcatctctgcctgggaatggggaggaacagatcttgggggacattggggagtgggcggacaagcactccagggcatcagtccgggccgctgaccaggcggagggcagtgtcccaattatacaggcgttacctccttttctccatctcagcatctgatccctccctccgcagtggaacccaggctcctgatatccatctgggtgagccagccagagggaccggctgtgtcagaggcaagcaaacaagtattagagtgcaagactgtgggcggagagaggaagcccgagccgccagcagggagcttcggagagagaaagcccaggaacatcccagagagagctgggcccatcctcagccctacccagccccgcagcccctagccctccgcccagaaacccagccctgtccggcgtgccgctcttctcctccaggccggctgctgttgcggccagcgttgccggggcatcccttcttcgttcccatcatggcagtgtaccgcctgtgtgtgaccactggtccctacctgagggccggcacactggacaacatctctgtcacactggtgggcacgtgtggtgaaagccccaagcagcggctagatcgaatgggcagggacttcgcccctggatcggtacagaagtacaaggtgcgttgcacagcggagctgggtgagctcttgctgctgcgtgtacacaaggagcgctacgctttcttccgcaaggactcttggtactgtagccgcatctgtgtcaccgaaccggatggtagtgtatcccacttcccctgctatcagtggattgaaggctactgcaccgtggagctgaggccaggaacagcaagaactatttgtcaggactctcttcccctcctcctggatcacaggacacgggagctccgggcccgacaagaatgctaccgctggaagatctatgcccctggcttcccccgcatggtagacgtcaacagctttcaggagatggagtcagacaagaaatttgccttgacaaagacgacaacttgtgtagaccagggtgacagcagtgggaatcggtacctgcccggcttccccatgaaaattgacatcccatccctgatgtacatggagcccaatgttcgatactcagccaccaagacgatctcgctgctcttcaatgccatccctgcgtccttgggaatgaagcttcgagggctgttggatcgcaagggctcctggaagaagctggatgacatgcagaacatcttctggtgccataagaccttcacgacaaagtatgtcacagagcactggtgtgaagatcacttctttgggtaccagtacctgaatggtgtcaatcccgtcatgctccactgcatctctagcttgcccagcaagctgcctgtcaccaatgacatggtggcccccttgctgggacaggacacatgcctgcagacagagctagagagggggaacatcttcctagcggactactggatcctggcggaggcccccacccactgcctaaacggccgccagcagtacgtggccgccccactgtgcctgctgtggctcagcccccagggggcgctggtgcccttggccatccagctcagccagacccccgggcctgacagccccatcttcctgcccactgactccgaatgggactggctgctggccaagacgtgggtgcgcaactctgagttcctggtgcacgaaaacaacacgcactttctgtgcacgcatttgctgtgcgaggccttcgccatggccacgctgcgccagctgccgctctgccaccccatctacaagctcctactcccccacactcgatacacgctgcaggtgaacaccatcgcgagggccacgctgctcaaccccgagggcctcgtggaccaggtcacgtccatcgggaggcaaggcctcatctacctcatgagcacgggcctggcccacttcacctacaccaatttctgccttccggacagcctgcgggcccgcggcgtcctggctatccccaactaccactaccgagacgacggcctgaagatctgggcggccattgagagctttgtctcagaaatcgtgggctactattatcccagtgacgcatctgtgcagcaggattcggagctgcaggcctggactggcgagatttttgctcaggcgttcctgggccgggaaagctcaggtttcccaagccggctgtgcaccccaggagagatggtgaagttcctcactgcaatcatcttcaattgctctgcccagcacgctgctgtcaacagtgggcagcatgactttggggcctggatgcccaatgctccatcatccatgaggcagcccccaccccagaccaaggggaccaccaccctgaagacttacctagacaccctccctgaagtgaacatcagctgtaacaacctcctcctcttctggttggttagccaagaacccaaggaccagaggcccctgggcacctacccagatgagcacttcacagaggaggccccgaggcggagcatcgccgccttccagagccgcctggcccagatctcaagggacatccaggagcggaaccagggtctggcactgccctacacctacctggaccctcccctcattgagaacagcgtctccatctaaccacccccaaataccaccaaagaagaaagaaaggtccaagcatgaggaggaccagttcctcaggtcctccagacccttccatcctccctgttctcagttcacctgaaccttctcttctgcacatggagacttttgcagccaagatggctctggcatcatacaaactgggccctgagctgtgagagaccagcacagcagcgtccaggttaaaagccgctgaccaaagtccaatgcacaatagcccctccgaaaggaaggaaccgcttcacttcttgccccacttggggcagcctcttgttccagcctcttggaatgcccagcttgggtttctgagcttttctccctcatcctccccaatccccaaactccttctcctaccatgcctttctacgttctctttcttccaagcctagagccaccagcccagcttccttctctggaaaagcctggaaactgggcacagaaggactgtgtgcctgggtctaacatgtggtcccctttgtccctagcacctttaaggggaggggaagaattggagggcagcttgcctggacccctaacggctgttctcaggaacaggttcccaggcctggggtgtttgtggagatctgtctttctccaaagatttcatccaactcccctttcatcccactccctttcatcccatttttttctttctgtccttgagcccagtgagttcaataaaaaccaaaatatttggctctca

SEQ ID NO: 59608 - DNA, 1270 bp, Homo sapiens
agacgttcgcacacctgggtgccagcgccccagaggtcccgggacagcccgaggcgccgcgcccgccgccccgagctccccaagccttcgagagcggcgcacactcccggtctccactcgctcttccaacacccgctcgttttggcggcagctcgtgtcccagagaccgagttgccccagagaccgagacgccgccgctgcgaaggaccaatgagagccccgctgctaccgccggcgccggtggtgctgtcgctcttgatactcggctcaggccattatgctgctggattggacctcaatgacacctactctgggaagcgtgaaccattttctggggaccacagtgctgatggatttgaggttacctcaagaagtgagatgtcttcagggagtgagatttcccctgtgagtgaaatgccttctagtagtgaaccgtcctcgggagccgactatgactactcagaagagtatgataacgaaccacaaatacctggctatattgtcgatgattcagtcagagttgaacaggtagttaagcccccccaaaacaagacggaaagtgaaaatacttcagataaacccaaaagaaagaaaaagggaggcaaaaatggaaaaaatagaagaaacagaaagaagaaaaatccatgtaatgcagaatttcaaaatttctgcattcacggagaatgcaaatatatagagcacctggaagcagtaacatgcaaatgtcagcaagaatatttcggtgaacggtgtggggaaaagtccatgaaaactcacagcatgattgacagtagtttatcaaaaattgcattagcagccatagctgcctttatgtctgctgtgatcctcacagctgttgctgttattacagtccagcttagaagacaatacgtcaggaaatatgaaggagaagctgaggaacgaaagaaacttcgacaagagaatggaaatgtacatgctatagcataactgaagataaaattacaggatatcacattggagtcactgccaagtcatagccataaatgatgagtcggtcctctttccagtggatcataagacaatggaccctttttgttatgatggttttaaactttcaattgtcactttttatgctatttctgtatataaaggtgcacgaaggtaaaaagtattttttcaagttgtaaataatttatttaatatttaatggaagtgtatttattttacagctcattaaacttttttaaccaaacagaaaaaaaaaaaaaaaaaaaaaaaaaaaaaaaaa

SEQ ID NO: 59609 - DNA, 1524 bp, Homo sapiens
atgtgtacaaagacaatcccagtcctctggggatgtttcctcctgtggaatctctatgtctcatcctctcagaccatttaccctggaatcaaggcaaggattactcagagggcacttgactatggtgttcaagctggaatgaagatgattgagcaaatgctaaaagaaaagaaactcccagatttaagcggttctgagtctcttgaatttctaaaagttgattatgtaaactacaatttttcaaatataaaaatcagtgccttttcatttccaaatacctcattggcttttgtgcctggagtgggaatcaaagcgctaaccaaccatggcactgccaacatcagcacagactgggggttcgagtctccacttttccaagacacaggaggggctgatctgtttctctccggagtctactttaccggtatcattatcctaacccgaaatgactttggtcatcctaccctgaagctccaagattgctacgcccaactgagccatgcccacgtctcattttccggagaactcagtgttctgtataactcctttgctgagcccatggagaaacccattttaaagaacttaaatgaaatgctctgtcccattattgcaagtgaagtcaaagcgctaaatgccaacctcagcacactggaggttttaaccaagattgacaactacactctgctggattactccctaatcagttctccagaaattactgagaactaccttgacctgaacttgaagggtgtattctacccactggaaaacctcaccgacccccccttctcaccagttccttttgtgctcccagaacgcagcaactccatgctctacattggaatcgccgagtatttctttaaatctgcgtcctttgctcatttcacagctggggttttcaatgtcactctctccaccgaagagatttccaaccattttgttcaaaactctcaaggccttggcaacgtgctctcccggattgcagagatctacatcttgtcccagcccttcatggtgaggatcatggccacagagcctcccataatcaatctacaaccaggcaatttcaccctggacatccctgcctccatcatgatgctcacccaacccaagaactccacagttgaaaccatcgtttccatggacttcgttgctagtaccagtgttggcctggttattttgggacaaagactggtctgctccttgtctctgaacagattccgccttgctttgccagagtccaatcgcagcaacattgaggtcttgaggtttgaaaatattctatcgtccattcttcactttggagtcctcccactggccaatgcaaaattgcagcaaggatttcctctgtccaatccacacaaattcttattcgtcaattcagatattgaagttcttgagggtttccttttgatttccaccgacctgaagtatgaaacatcctcaaagcagcagccaagtttccacgtatgggaaggtctgaacctgataagcagacagtggagggggaagtcagccccttga

SEQ ID NO: 59610 - DNA, 1580 bp, Homo sapiens
gggacacggcgcgggatggacgcgcaggactgccaggcggccgcatcgcccgagccgcccgggcccccagcccgtagctgcgtggccgcctggtgggacatggtcgaccgcaacctgcgtcaaagccccatttcttgtggatttaaagaaaccagagttaaagattcctcacacagtgaacttctacctgagagttgaacctggggtgatgctagggatctggcacacagtccccagctgccggggggaagatgccaaggggaaggactgttgctggtatgaagcagcccttcgtgatgggaacccaattattgtttatcttcatggcagtgcagaacacagggcagcttcgcacagactgaagctggtaaaggtgctgagtgatggtggctttcatgtcttgtctgttgactacagaggatttggggactctacaggtaagcccacagaggagggactgactacggatgccatttgtgtctatgagtggaccaaggcaagaagtggcatcactcccgtgtgtctctggggccactctctgggtacaggagttgcaacaaatgctgcaaaagtgctagaagaaaaaggatgcccagttgatgctattgtcttggaagctccatttaccaacatgtgggttgcaagtatcaattatcccttgttaaagatttaccggaacattccaggatttttacgtacacttatggatgccctgagaaaagacaaaataatctttcctaatgatgaaaatgttaaattcctttcttctcctcttctcatcttacatggagaggatgacaggacagtgcctttggagtatgggaaaaagctctatgaaattgcacgcaatgcatacaggaacaaagagagggtcaagatggttatctttcctcctggcttccaacacaacctgctttgtaaaagccccacactgttaataaccgtgagagatttcctgagcaagcagtggtcatgagtctgggaggagtggaaatcttcaatgaagacttggcccaaacaccacctgtgatgtatattgttctaatgtaaaattgtactgggctggtcggatgagctgaggccattgacttctctacaaatcacttgccattttaacaacagaaagtacgaatgttaggcagtatggaatgttcttatttagcttatcataatctactttgtaaaacatgctgaaacctcactgtggagaaccagaatttggtaaaatctagatcctatctaaaaatatgtagttattaaacattctgtggatatttgtgaataaggtagttgctatggtccgaatatctgggcctgcccccccaaattatgctgaaacctaatcaccagtgtgatggtaataggaggtgggactgagctctgatgaatgagattagtgcccttataaattatgaccaaaagagctcttcactcctcctaccatttgaggatacagtgagaagccttcatctatgaaccacaaagtagccctcatcagacactgaatcagccagtgccttgctcttggacttcccagcccccagaactgtgagaaataaatttctgttgtttataagcta

SEQ ID NO: 59611 - DNA, 2523 bp, Homo sapiens
agcctgaaggactgcttgcctgtgaggagggtcactcttgactggctgcatcaggaccatgtgtgaccagcagcagatccagtgccgcctgccgctccaacagtgctgcgtcaagggtccctccttctgctcctctcaatccccctttgcccagagccaagtggtggttcaagccccttgtgagatgcaaattgtggactgccctgcatcatgcccagttcaagtttgccaggtgtcagaccaggctccatgccagtctcagaccacacaggtgaagtgccagtctaagaccaagcaggtgaagggccaggctcaatgtcagtctaagaccacccaggtgaagggccaggctgcatcccaatctcaaacttcctctgttcaaagccaggctccatgccaatctgaggtgtcctacgtgcagtgcgaagcgtcacaacctgttcagacttgcttcgtagaatgtgctccagtttgttatacagaaacttgttatgtagaatgcccagtccagaactatgtaccctgtccagctcctcagcctgtccagatgtatagagggcgtcctgcagtgtgccagcctcagggaagattctccacccagtgccagtatcaaggctcctatagcagttgtggcccccagtttcagtcaagggctacctgcaacaactacaccccccagttccagttgaggccttcctacagcagctgtttccctcagtatcggtcccggacttcatttagtccctgtgtgccccagtgccagacccagggctcctatgggagcttcactgaacagcaccgctctcggagcaccagcagatgccttcctcctcctcggcggctgcagcttttcccccgcagctgttccccaccaagacgttttgagccctgctccagcagctacctgccactaagaccctctgaaggtttccctaactactgcaccccaccccgccgctctgaacccatatataacagtcgctgtcctcgccgccccatttcaagctgctctcagagacgtggccccaagtgccgaatcgagatttcctccccgtgctgccccaggcaggttcccccacagaggtgtcctgttgagattcctcccatcagacgccgctcccagagctgtggcccgcagccctcctggggcgcctcctgccctgagctgaggccacacgtagagccacgtccactcccaagcttctgtccaccacggcgtcttgaccagtgtccagagtcaccactgcagcgatgtccacctcctgctccacgtccacgtctgcgcccagaaccatgcataagtctagaaccacgcccgcgtcctctaccacgacaactttcagaaccttgtttgtatccagaaccacttccagcactacgtccaacaccgcggccagttccccttcctcgcccagggcagtgtgagattccagagccacgtccatgcctgcagccctgtgagcacccagagccttgtccacgaccagagccaattcccctgccggcgccctgcccaagcccggagccctgcagggagacttggcgcagccccagcccatgctggggcccaaatccagttccatacccaggagacctaggctgtcatgagtctagtccacaccgcctagacaccgaagctccctactgtggcccatccagttacaaccaggggcaagagagtggtgctggctgtgggcctggtgatgtgtttccagagcggaggggtcaggatggccatggagaccaaggcaatgcctttgctggagtgaaaggggaagcaaagagtgcttatttttaaaggaaaggtgactgagataaccctctctcctgctctgaaaatgttgttcctcctattccacaatttccagtacgctcttgtttgaatctctccaaagatattcagagactccctattacgaaggtgatgtccaaactcctttgcctatcatccaaagatccacacctgggtctcagatgcctctccagcctcacgtgtcactcctcgcccgtacgcatcctcggctctagccagaccagtctggccactgggcacagcttgggtgttccccaggccatactttagatgtccctgcctccaagcctctgctcactcttccccactctgcctggaccacttctctcctcctccccagcttctgaaatccaccccatctttcagtgcctctcccttggagccttctttgcttgttcccactcacaagaacctgtgccgacttcctagaactcactgcatcccccgcactacttggtaactgcctggtgacatctcttgaattgttatttcactttgcaggcatgtcttccttatctgcccaactaggttgtaaactcccaactgagtggagtcggagaatctctaaatctcagtgtctatcctggggctggctgttgcttagcaaggcttgtgggttggcagcttgaaccatgttctgtcctgatgctcaactgcaggaactgaggtgagaggaggccatgtgacaataaagatcattatgtactcac

SEQ ID NO: 59612 - DNA, 3188 bp, Homo sapiens
acacacacagcgagcgggcgggcagaaggcggttctgctggtctcctcttcctgctgcagccagcccagcgtgcgggccatgggccctgccggcgggtgaggcagccgcgtggcaggcatgttcggaggcccggggcctggggtcctgggagcccagggcatggcgggacccctgcggggccgggtggaagagctgaagctgccgtggtggcgggagagctcaccgctggtgctgcggcacagcgaggcggctcggctggcggccgacgccctcctggagcggggtgaggctgcctacctgcgggtcatctccgaggagcgggagctgcccttcctgagcgccctggatgtggactacatgaccagccatgtgcgcgggggccctgagctcagcgaggctcaggggcaggaggcctccgggccagaccgcctcagcctgctctctgaagtcacctcagggacttacttccccatggcctctgacatagaccccccagacctggacctgggctggcccgaggtgccacaggccacaggcttcagccccacccaggctgtggtccacttccagagggacaaggccaagaacatcaaggacctgctgcgcttccttttcagccaggcccacacggtggtggctgtggtgatggacatattcactgacatggagcttctgtgtgacctcatggaggcctcaagccggcgtggtgtccctgtgtacctgctccttgcccaggagcacctgaggcacttcctggagatgtgctacaagatggacctcaatggggagcacctgccgaacatgcgtgtgcggagcacgtgtggggacacatactgcagcaaggctggccgccgcttcacggggcaggccctggagaagttcgtcctcattgactgtgagcaagtggtggcgggcagttacagcttcacctggctttgcagccaggcccacactagcatggtgctgcagctgaggggccgcatcgtggaagactttgaccgggagttccgctgtctgtacgctgagtcgcagcctgtggagggcttctgtggcggtgaggacccgctgtctccccgggcactgcgtcctccccctgtggccctagccttcaggcctgatgtcccaagccccacgtcgtccctgccctccagcaccagcctcagcagcatcaagcagtcaccgcttatgggtcgctcctcctacctcgctctaccaggaggtggtgattgcagtgatacgggtgtggtgtcctcgtccctgggtcctgcccgccgtgaggccagtggccagccctccctacatcgccaactgtcagaccctaaccacggctcccctcctgggctctatagggccaatctcggcaagctaggggcatacccatggtcccagtcctcccctgccctcaaccataatagtaccagccccttaaccttggcagtggggtcacctctgcttcctcgctcccggcccctcctccagttccatcggggtgccccagctctgtcccggttcccagagaatgggctcccaggaagccaagagcccagccccctgcggggtcgatgggtacctggcacaaccctggagacagtggaggagaaggagaagaaggcatctccaagtcagagccgtggccagctggatctccttgtccccttccccagagcccgagaagtgggagaccctgactctggggttacccccaactcaggcccccttcggcctggcgagcaggccccagaggacaggaggttgtccccaagccaggccgacagccagctggatctcctgtcccgagccctgggtactgggggtgcccctgagttgggttccctcagacctggtgatcgggccctggaggacaggaggctgtccctaaaccaaagccgtggccaatcagacctcctgatgcagtaccccaaggcccagggttccagagtgccccttgaaaccaactcctcagccagacctgccagacgggcaccagatgagcggcggcagaccctggggcacagccagctggacctcatcacaaagttcggcccattccgtggtgaggggcctgggcccaatggtctcccgatatcaagccctgctcgcacggctggagctgggtctggggatgagaaacggctaaccctgggccacagcaagctggacctcatcaccaagtatcatcagttgcacggggccaggcagggaactgagcctgggggtcccaagggtggccatctcaatggtggtaacagtgacctggtcagggatgagaaacggctgaccctgggtcacagcaaactggacctcatcactaagtacaacaagtccaagttcaagcagctccgaagccgctttgagtcctagccaaaggactggcatcgggggtgcactggcaagggcaggcccctcctctgtccaccgagactctggacttgctcaggtcccagactggggaagggaggtgtctagaaacccaggtcagacacactctctgggctcaagattcttgtgtatacacacacacacacacacacacacacaccctaactagtatcttcttgaatctaggctgtgtttccagccctgtgctgggcctgtagagctgacaggtgggtcacactcagacctggggacagaggtgaaatgcacaagctgctggagaaggggtcagagccatatcaagttaaaggttaaccagttacagagggtgttagaaaacaaagggcagagagtcctggagaaggtggagtagtcagaaaactttcttagaggagatggaggtggcctttgagccaggccctgaaggatggggaggttttggacagagggaggagagagttagaaaaatttttggtagagagaatcaggtgaaagagatgccctaaagaggactgagtgggtctgaggtgaatgagtgaggaagagcagagtatgtggatacccggaaacacacacacacacacatcatcattatcatcatcatcattgtcgtcgtcatcatcttgctgagtcatcatcatcatcatcatcattgtcgtcgtcatcatcttgctgagtgtctcttgaagtacaggctgtgacaggttgtgggccattttcctgaactcaccacttacccgggatagtaaacatgatacacatcaataaaggcagactttattgtgaaaaaaaaaaaaaaaaaaaaaaaaaa

SEQ ID NO: 59613 - DNA, 1999 bp, Homo sapiens
ggcagccagaagcacctgtgctcccaggataagggtgagcactcaggatgactgtggagaaggaggcccctgatgcgcacttcactgtggacaaacagaacatctccctctggccccgagagcctcctcccaagtccggtccatctctggtcccggggaaaacacccacagtccgtgctgcattaatctgcctgacgctggtcctggtcgcctccgtcctgctgcaggccgtcctttatccccggtttatgggcaccatatcagatgtaaagaccaatgtccagttgctgaaaggtcgtgtggacaacatcagcaccctggattctgaaattaaaaagaatagtgacggcatggaggcagctggcgttcagatccagatggtgaatgagagcctgggttatgtgcgttctcagttcctgaagttaaaaaccagtgtggagaaggccaacgcacagatccagatcttaacaagaagttgggaagaagtcagtaccttaaatgcccaaatcccagagttaaaaagtgatttggagaaagccagtgctttaaatacaaagatccgggcactccagggcagcttggagaatatgagcaagttgctcaaacgacaaaatgatattctacaggtggtttctcaaggctggaagtacttcaaggggaacttctattacttttctctcattccaaagacctggtatagtgccgagcagttctgtgtgtccaggaattcacacctgacctcggtgacctcagagagtgagcaggagtttctgtataaaacagcggggggactcatctactggattggcctgactaaagcagggatggaaggggactggtcctgggtggatgacacgccattcaacaaggtccaaagtgcgaggttctggattccaggtgagcccaacaatgctgggaacaatgaacactgtggcaatataaaggctccctcacttcaggcctggaatgatgccccatgtgacaaaacgtttcttttcatttgtaagcgaccctatgtcccatcagaaccgtgacaggacaggctcccaagctcactctttgagctccaacgcttgttaaacatgaggaaatgcctctttcttccccagactccaggatgactttgcacgttaatttttcttgcttcaaaattgtcccacagtggcattctggagtccgtctgtcttggctggaaattctctgacgtcttggaggcagctggaatggaaaggagaattcaggttaaagtgggaggggtgggtagagaggatttagaagttccaattgccctgctaaggaggatcaagacccgtaatccggcacaacaccctggggttttccactctttcagagaaacctcagcttcatcacatcaaagttactccagagcaaccaagcaattctcctgatattgtcatccagggcttttcttggccaaaccccctagaatttccatgtctctgcttagctgtgctggcagctagcagctggctgtgtttgcagtgcaaatagctctgttcttggaaatcctgctcatggtatgtccccagtggtttcttcatccacatcatctaaagcctgaacccgttcttctctggttcaagtcagtggctgacacggacttgtatctccttcagagctcggctggcacccagcctcccttctccttccactcccttagtacactggagtgccgagccctgccttccacccagcgtccatccagcccctgtcctcacctctccggcacctcctcctccttctgcatttcctatcttcctgtgtcttgtgcatgggaagcagccttcagtgccttcatgaattcaccttccagcttcctcagaataaaatgctgcctgggtcaaggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 59614 - DNA, 6017 bp, Homo sapiens
gggcggggctcgggccggtccgcccgcgcgcaggtgagtgagccagggcggagcgcagctgcgccgggcttgggcgcctggggccgccgctccccaccgtcgttttccccaccgaggccgaggcgtcccggagtcatggccggcctgaactgcggggtctctatcgcactgctaggggttctgctgctgggtgcggcgcgcctgccgcgcggggcagaagcttttgagattgctctgccacgagaaagcaacattacagttctcataaagctggggaccccgactctgctggcaaaaccctgttacatcgtcatttctaaaagacatataaccatgttgtccatcaagtctggagaaagaatagtctttacctttagctgccagagtcctgagaatcactttgtcatagagatccagaaaaatattgactgtatgtcaggcccatgtccttttggggaggttcagcttcagccctcgacatcgttgttgcctaccctcaacagaactttcatctgggatgtcaaagctcataagagcatcggtttagagctgcagttttccatccctcgcctgaggcagatcggtccgggtgagagctgcccagacggagtcactcactccatcagcggccgaatcgatgccaccgtggtcaggatcggaaccttctgcagcaatggcactgtgtcccggatcaagatgcaagaaggagtgaaaatggccttacacctcccatggttccaccccagaaatgtctccggcttcagcattgcaaaccgctcatctataaaacgtctgtgcatcatcgagtctgtgtttgagggtgaaggctcagcaaccctgatgtctgccaactacccagaaggcttccctgaggatgagctcatgacgtggcagtttgtcgttcctgcacacctgcgggccagcgtctccttcctcaacttcaacctctccaactgtgagaggaaggaggagcgggttgaatactacatcccgggctccaccaccaaccccgaggtgttcaagctggaggacaagcagcctgggaacatggcggggaacttcaacctctctctgcaaggctgtgaccaagatgcccaaagtccagggatcctccggctgcagttccaagttttggtccaacatccacaaaatgaaagcaataaaatctacgtggttgacttgagtaatgagcgagccatgtcactcaccatcgagccacggcccgtcaaacagagccgcaagtttgtccctggctgtttcgtgtgtctagaatctcggacctgcagtagcaacctcaccctgacatctggctccaaacacaaaatctccttcctttgtgatgatctgacacgtctgtggatgaatgtggaaaaaaccataagctgcacagaccaccggtactgccaaaggaaatcctactcactccaggtgcccagtgacatcctccacctgcctgtggagctgcatgacttctcctggaagctgctggtgcccaaggacaggctcagcctggtgctggtgccagcccagaagctgcagcagcatacacacgagaagccctgcaacaccagcttcagctacctcgtggccagtgccatacccagccaggacctgtacttcggctccttctgcccgggaggctctatcaagcagatccaggtgaagcagaacatctcggtgacccttcgcacctttgcccccagcttccaacaagaggcctccaggcagggtctgacggtgtcctttataccttatttcaaagaggaaggcgttttcacggtgacccctgacacaaaaagcaaggtctacctgaggacccccaactgggaccggggcctgccatccctcacctctgtgtcctggaacatcagcgtgcccagagaccaggtggcctgcctgactttctttaaggagcggagcggcgtggtctgccagacagggcgcgcattcatgatcatccaggagcagcggacccgggctgaggagatcttcagcctggacgaggatgtgctccccaagccaagcttccaccatcacagcttctgggtcaacatctctaactgcagccccacgagcggcaagcagctagacctgctcttctcggtgacacttaccccaaggactgtggacttgactgtcatcctcatcgcagcggtgggaggtggagtcttactgctgtctgccctcgggctcatcatttgctgtgtgaaaaagaagaaaaagaagacaaacaagggccccgctgtgggtatctacaatgacaacatcaatactgagatgccgaggcagccaaaaaagtttcagaaagggcgaaaggacaatgactcccatgtgtatgcagtcatcgaggacaccatggtatatgggcatctgctacaggattccagcggctccttcctgcagccagaggtggacacctaccggccgttccagggcaccatgggggtctgtcctccctccccacccaccatatgctccagggccccaactgcaaagttggccactgaggagccacctcctcgctcccctcctgagtctgagagtgaaccgtacaccttctcccatcccaacaatggggatgtaagcagcaaggacacagacattcccttactgaacactcaggagcccatggagccagcagaataacttgatccattccagacgctttgctgagtttcataaagcagggcactgagacacccgtccgtgttcctaaccagaaatcctaaagaagaggaattatacagaaggaacagcaggaggttttcctggacaccgccaacttcacattgctcagtggactcattctaagggcaagacattgaaaatgatgaattccaatctggatacagtcatgacagctcatgtgctcctcaacttaggctgtgcggttagccagcctgtaatgagaggagagaggcctgagtcacctagcatagggttgcagcaagccctggattcagagtgttaaacagaggcttgccctcttcaggacaacagttccaattccaaggagcctacctgaggtccctactctcactggggtccccaggatgaaaacgacaatgtgcctttttattattatttatttggtggtcctgtgttatttaagagatcaaatgtataaccacctagctcttttcacctgacttagtaataactcatactaactggtttggatgcctgggttgtgacttctactgaccgctagataaacgtgtgcctgtcccccaggtggtgggaataatttacaatctgtccaaccagaaaagaatgtgtgtgtttgagcagcattgacacatatctgctttgataagagacttcctgattctctaggtcggttcgtggttatcccattgtggaaattcatcttgaatcccattgtcctatagtcctagcaataagagaaatttcctcaagtttccatgtgcggttctcctagctgcagcaatactttgacatttaaagagaaatttagagaatattctcatcctctaaaaatgtttaaatatataccaaacagtggccccctgcattagttttctgttgccactgcaacctattacttggtagcttaaaaacaacacattagcttatagtcctggggatcagaattccaaaatggatgtccctgaatgaaaatcaaggtgtcagcagagctgtgctccttctgaaggctctagggagaagccggttccttgccatttcaagcttctagaggctggctgcattcccaggctccagtggctggtcaagcttttctcacatggcatcactgtgacactggccctcccacttccctctttgacttacaaagcccaccaggaagatccaggataatctctccatctaaagttccttcatcatcctggaagagccttttgccatgcaagacaacatagccacaggtggggattaggaccagaacatctttggggtgctgttattctgcctaccacaccttcctgccactgactcccacaggagaggctacaaaatgatctggcgcacagggatgttttgtttagcttgcggactctaacacttaaaaaaaaacccagatcagaagatctggccatgctggggctcacattctcacctagcaacaactggctggagctgggcaccagctctgcctttagaaggggtgtccacttcaccaggtcaccacagcccacactacgccctatcacttcccacaatgaggctgagtgtttgtttctactgatcaatgcccctgcaggttgcatttattgtaatgaaaaagaaagactgggattaatctctaatcaggtgagtagaccatgagaccaatgtgtgctcacattaccctttttcttttttttctttttctttttctttttttttttaatgtgagacaggatctcattctgttgcctaggctggagtgcagtggcgcaatctcggctcactgcaacctctgcctcctgggctcaagcaattctcccacctcagcctcccaaatagctgggatcactggcacaaaccaccatgcccagctaattttgtattttttgtagagacagggtttcaccatgttgcccaggctggtctcaacctcctgggctcaagcaatcctcctgcctcggcctcccaaagtgctgggattacagatgtgagccaccgcatccagccccacaccctcatttataccaattacctgcccagtaactgtggacttttgcttcctcacccctgctctgatctggaaggagagggattatgttatagcttgtcagcacagtcccaagttcaatatttctgcggcaaaaacttccttcaaaaaataaatgtacttcattgtattcaatgaattcaccttggaaatgcaccgcctcaacttgttcacatggcataaatgaaaggaattttatagtctcctaaatggcgtgtactgcaagacctcttgaacactttccagaggataggatatttaagtcatgcccttggcgttgcctatggcacctttcccttctgaaagtctggttcctgcccagtgacccttggccttgtgagccgagatgctgaccctgcataaagggccaaaggagggctgcggcttccttccctcactgaagagcccttatttgaattcactgtgtggagccctagccctccattctcgacattccccaacctcccagccccttccaagcaggactaggtgccctgcattccacccaaggtgggattggccttccttaggctggctacttgtcaccatcaccgacatcactgttgcctgcaaggacaccacgtggccattttccttcaactgagggctcaaaactcctggacaagttgctggctcctgagaccagtatttcctggagctgtgcctcagtgaaggggcccagcctgaggaaccctggctcttttctttaaagcccaggccccacttacgtaaaacatttcagggtcactggaaacagtgaagtgccatttgttgaagcctactgcatgccagcccactgctcatccacgtggtctgccatgcctacgaggaaggccagcgcatgcaggactggtctctaatgctgtggtcattgcacagaagggaaaggtctcaaggaagagtcaactggaacaagcacaagcccaccggacatggccttggtaaaggttagcagactggtgtgtgtggatctgcagtgcttcactggaaataatttattcattgcagatactttttaggtggcattttattcatttcctgtgctttaaataaacaaatgtaccaaaaaacaagtatcaagctgtttaagtgcttcggctacttgtcccctggttcagtagaggccccggtttcccagttgttgactgtgacaggctcagcatgggctcagcagatgctgtcttaatttgtggatgatacagaaagccaggctttgggatacaagttctttcctcttcatttgatgccgtgcactgtgtgaagcagatgtttttgtccggaaataaaaataatagtcttggagtctcgccaaaaaaaaaaa

SEQ ID NO: 59615 - DNA, 3063 bp, Homo sapiens
cgccggcggggaagatgaccgcgggcgccggcgtgctccttctgctgctctcgctctccggcgcgctccgggcccataatgaggatcttacaactagagagacctgcaaggctgggttctctgaagatgattacacggcattaatctcccaaaatattctagaaggggaaaagctacttcaagtcaagttcagcagctgtgtggggaccaaggggacacaatatgagaccaacagcatggacttcaaagttggggcagatgggacagtcttcgccacccgggagctgcaggtcccctccgagcaggtggcgttcacggtgactgcatgggacagccagacagcagagaaatgggacgccgtggtgcggttgctggtggcccagacctcgtccccgcactctggacacaagccgcagaaaggaaagaaggtcgtggctctggacccctctccgcctccgaaggacaccctgctgccgtggccccagcaccagaacgccaacgggctgaggcggcgcaaacgggactgggtcatcccgcccatcaacgtgcccgagaactcgcgcgggcccttcccgcagcagctcgtgaggatccggtccgacaaagacaatgacatccccatccggtacagcatcacgggagtgggcgccgaccagccccccatggaggtcttcagcattgactccatgtccggccggatgtacgtcacaaggcccatggaccgggaggagcacgcctcttaccacctccgagcccacgctgtggacatgaatggcaacaaggtggagaaccccatcgacctgtacatctacgtcatcgacatgaatgacaaccgccctgagttcatcaaccaggtctacaacggctccgtggacgagggctccaagccaggcacctacgtgatgaccgtcacggccaacgatgctgacgacagcaccacggccaacgggatggtgcggtaccggatcgtgacccagaccccacagagcccgtcccagaatatgttcaccatcaacagcgagactggagatatcgtcacagtggcggctggcctggaccgagagaaagttcagcagtacacagtcatcgttcaggccacagatatggaaggaaatctcaactatggcctctcaaacacagccacagccatcatcacggtgacagatgtgaatgacaacccgccagaatttaccgccagcacgtttgcaggggaggtccccgaaaaccgcgtggagaccgtggtcgcaaacctcacggtgatggaccgagatcagccccactctccaaactggaatgccgtttaccgcatcatcagtggggatccatccgggcacttcagcgtccgcacagaccccgtaaccaacgagggcatggtcaccgtggtgaaggcagtcgactacgagctcaacagagctttcatgctgacagtgatggtgtccaaccaggcgcccctggccagcggaatccagatgtccttccagtccacggcaggggtgaccatctccatcatggacatcaacgaggctccctacttcccctcaaaccacaagctgatccgcctggaggagggcgtgccccccggcaccgtgctgaccacgttttcagctgtggaccctgaccggttcatgcagcaggctgtgagatactcaaagctgtcagacccagcgagctggctgcacatcaatgccaccaacggccagatcaccacggcggcagtgctggaccgtgagtccctctacaccaaaaacaacgtctacgaggccaccttcctggcagctgacaatgggatacccccggccagcggcaccgggaccctccagatctatctcattgacatcaacgacaacgcccctgagctgctgcccaaggaggcgcagatctgcgagaagcccaacctgaacgccatcaacatcacggcggccgacgctgacgtcgaccccaacatcggcccctacgtcttcgagctgccctttgtcccggcggccgtgcggaagaactggaccatcacccgcctgaacggtgactatgcccaactcagcttgcgcatcctgtacctggaggccgggatgtatgacgtccccatcatcgtcacagactctggaaaccctcccctgtccaacacgtccatcatcaaagtcaaggtgtgcccatgtgatgacaacggggactgcaccaccattggcgcagtggcagcggctggtctgggcaccggtgccatcgtggccatcctcatctgcatcctcatcctgctgaccatggtcctgctgtttgtcatgtggatgaagcggcgagagaaggagcgccacacgaagcagctgctcattgaccccgaggacgacgtccgcgacaacatcctcaagtatgacgaggaaggcggtggcgaggaggaccaggactacgacctcagccagctgcagcagccggaagccatggggcacgtgccaagcaaagcccctggcgtgcgtcgcgtggatgagcggccggtgggcgctgagccccagtacccgatcaggcccatggtgccgcacccaggcgacatcggtgacttcatcaatgagggactccgcgctgctgacaacgaccccacggcacccccctatgactccctgctggtcttcgactacgaggggagcggctccaccgcaggctccgtcagctccctgaactcatccagttccggggaccaagactacgattacctcaacgactgggggcccagattcaagaagctggcggacatgtatggaggtggtgaagaggattgactgacctcgcatcttcggaccgaagtgagagccgtgctcggacgccggaggagcaggactgagcagaggcggccggtcttcccgactccctgcggctgtgtccttagtgctgttaggaggccccccaatccccacgttgagctgtctagcatgagcacccacccccacagcgccctgcacccggccgctgcccagcaccgcgctggctggcactgaaggacagcaagaggcactctgtcttcacttgaatttcctagaacagaagcactgtttttaaaaaaaaaaaaaaaaaaagaag

SEQ ID NO: 59616 - DNA, 2549 bp, Homo sapiens
atcagtcaggaggccgtgcagtccgagatgggctcgtctcgggcaccctggatggggcgtgtgggtgggcacgggatgatggcactgctgctggctggtctcctcctgccagggaccttggctaagagcattggcaccttctcagacccctgtaaggaccccacgcgtatcacctcccctaacgacccctgcctcactgggaagggtgactccagcggcttcagtagctacagtggctccagcagttctggcagctccatttccagtgccagaagctctggtggtggctccagtggtagctccagcggatccagcattgcccagggtggttctgcaggatcttttaagccaggaacggggtattcccaggtcagctactcctccggatctggctctagtctacaaggtgcatccggttcctcccagctggggagcagcagctctcactcgggaagcagcggctctcactcgggaagcagcagctctcattcgagcagcagcagcagctttcagttcagcagcagcagcttccaagtagggaatggctctgctctgccaaccaatgacaactcttaccgcggaatactaaacccttcccagcctggacaaagctcttcctcttcccagacctttggggtatccagcagtggccaaagcgtcagctccaaccagcgtccctgtagttcggacatccccgactctccctgcagtggagggcccatcgtctcgcactccggcccctacatccccagctcccactctgtgtcagggggtcagaggcctgtggtggtggtggtggaccagcacggttctggtgcccctggagtggttcaaggtcccccctgtagcaatggtggccttccaggcaagccctgtcccccaatcacctctgtagacaaatcctatggtggctacgaggtggtgggtggctcctctgacagttatctggttccaggcatgacctacagtaagggtaaaatctaccctgtgggctacttcaccaaagagaaccctgtgaaaggctctccaggggtcccttcctttgcagctgggccccccatctctgagggcaaatacttctccagcaaccccatcatccccagccagtcggcagcttcctcggccattgcattccagccagtggggactggtggggtccagctctgtggaggcggctccacgggctccaagggaccctgctctccctccagttctcgagtccccagcagttctagcatttccagcagctccggtttaccctaccatccctgcggcagtgcttcccagagcccctgctccccaccaggcaccggctccttcagcagcagctccagttcccaatccagtggcaaaatcatccttcagccttgtggcagcaagtccagctcttctggtcacccttgcatgtctgtctcctccttgacactgactgggggccccgatggctctccccatcctgatccctccgctggtgccaagccctgtggctccagcagtgctggaaagatcccctgccgctccatccgggatatcctagcccaagtgaagcctctggggccccagctagctgaccctgaagttttcctaccccaaggagagttactcaacagtccataagaagtcaactgttgtgtgtgtgcatgccttgggcacaaacaagcacatacactatatcccatatgggagaagtccagtgcccaggcatagggttagctcagtttccctccttcccaaaagagtggttctgctttctccactaccccaaggttgcagactctctcttatcaccccttcctccttcctcttctcaaaatggtagattcaaagctcctctcttgattctctcctactgtttaaattcccattccaccacagtgcccctcagccagatcaccaccccttacaattccctctactgtgtggaaatggtccattgagtaacacccccatcagcttctcaactgggaaacccctgaaatgctctcagagcacctctgacgcctgaagaagttataccttcctcttcccctttaccaaataaagcaaagtcaaaccatcatctggaaacagtggccacttttcactgacctttcttcgacatctagtcaacccacccaatatgccactgggctctcgctcccaattccaccccaccctccattacagagctcaccacgccctcctagatcaccgtccccaacacacccattgcctctcaaggcccttatctcagccccttcctgtggccacttccctcagtgctcagatgattccctgggtgagggagacactggggcaccctcagaggttgaagcaggctccctgctgtccctggatcctggacagatggctcagtaaactgtggggactaggtgcagactttttgccttcttggagtcctgggtctcctctgagagtctgggtggtgctcttcctacgcctctagaggtctctgtgttcctcattttccttcaaaagcgggctgtgtttctcttctaccttccagctgctcccacagaggaggaagacaataaatatttgttgaactg

SEQ ID NO: 59617 - DNA, 538 bp, Homo sapiens
ccgtgtctccacacgtctgcctccatcactgccatcgcgatcctgcagctatgtcctaccctgtgaccagtcagccccagtgcgccaccaccagctgctaccagacccagctcagtgactggcacacaggtctcacggactgctgcaacgacatgcctgtctgtctgtgcggcacttttgctcctctgtgccttgcctgccgcatctccgacgactttggcgagtgctgctgcgcgccctacctgcccggaggcctgcactccatccgcaccggcatgcgggagcgctaccacatccagggctccgtcgggcacgactgggcggccctcaccttttgtctgccctgcgccctctgccagatggcgcgggaactgaagatccgagagtaaggaagttccctgtcttccccgtccttttccaccagtctcgcctctggccttctctggccactcctgggagggactgcctcaccacccctgtcccgctgccagaaatacacccacaataaaaacctgaaaaccaaaaaaaaaaaaaaaaa

SEQ ID NO: 59618 - DNA, 5000 bp, Homo sapiens
aacatttttgaaagatcactcagctttaacacaccttggctgggtctggataaaaaaaaagtgagcactgcaaatttctagaagaaaacatcaggagaagaaagagagagggggatttattcaaagttgtttccaattccttcaaaacctcaaaccaggtggctatggtatggatgtaaccaagaaaaacaaacgagatggaactgaagtcactgagagaattgtcactgaaacagtaaccacaagacttacatccttaccaccaaaaggcgggaccagcaatggctatgctaaaacagcctctcttggtggagggagccggctggagaaacaaagcctgactcatggcagcagcggctacataaactcaactggaagcacacgaggccatgcctccacctctagttacaggagggctcactcacctgcctccactctgcccaactccccaggctcaacctttgaaaggaaaactcacgttacccgccatgcgtatgaagggagctccagtggcaactcttctccggagtaccctcggaaggaatttgcatcttcttcaaccagaggacggagtcaaacacgagagagtgaaattcgagttcgactgcagagtgcgtccccatccacccgatggacagaattggatgatgttaagcgtttgctcaaggggagtcgatcggcaagtgtgagccccacccggaattcctccaacacactccccatccccaagaaaggcactgtggagaccaaaattgtgacagcgagctcccagtcggtgtcaggcacctacgatgcaacgatcctggatgccaaccttccctcccatgtgtggtcctccaccctgcccgcggggtcctccatggggacctatcacaacaacatgacaacccagagctcatccctcctcaacaccaatgcctactctgcgggatcagtcttcggagttccaaacaacatggcgtcctgctcacccactttgcaccctggactcagcacatcctcctcagtgtttggcatgcagaacaatctggcccccagcttgaccaccctgtcccatggcaccaccaccacttccacagcatatggggtgaagaaaaacatgccccagagtcctgcggctgtgaacactggcgtttccacctccgccgcctgcaccacaagtgtgcagagcgatgaccttttgcacaaggactgcaagttcctgatcctagagaaagacaacacacctgctaagaaggagatggagctgctcatcatgaccaaggacagcgggaaggtctttacagcctcccctgccagcatcgctgcaacttctttttcagaagacaccctaaaaaaagaaaagcaagctgcctacaatgctgactcaggcctaaaagccgaagctaatggagacctgaagactgtgtccacaaagggcaagaccaccactgcagatatccacagctacagcagcagtggtggtggtggcagtggaggaggtggcggtgttggtggcgctggcggcggcccttggggaccagcgccagcctggtgcccctgcggctcctgctgcagctggtggaagtggctgctgggcctgctgctcacctggctgctactcctggggctgctcttcggcctcattgctctggcggaggaggtgaggaagctgaaggcgcgtgtggatgagctggagaggatcaggaggagcatactgccctatggggacagcatggatagaatagaaaaggaccgcctccagggcatggcacccgcggcgggagcagacctggacaaaattgggctgcacagtgacagccaggaggagctctggatgttcgtgaggaagaagctaatgatggaacaggaaaatggaaatctccgaggaagccctggccctaaaggtgacatgggaagtccaggccctaaaggagatcgagggttccctgggactccaggtatccctgggcccttgggccacccaggtccacaaggaccaaagggtcaaaaaggcagcgtgggagatcctggcatggaaggccccatgggccagagagggcgagaaggccccatgggacctcgtggtgaggcagggcctcctggatctggagagaaaggggaaagaggggctgctggtgaaccaggtcctcatggcccacctggtgtcccaggttctgtgggtcccaaaggttccagcggctctcctggcccacagggccctccaggtcctgtaggtctccaagggctccgaggtgaagtaggacttcctggtgtcaaaggtgacaaaggaccaatgggaccaccaggacccaaaggtgaccagggtgagaaaggacctcgaggcctcacaggcgagcctggcatgagaggtttgcctggtgctgttggtgagcccggggctaaaggagcaatgggtcctgctggcccagacggacaccaaggcccaagaggtgaacaaggtcttactgggatgcctggaatccgtggcccaccaggaccttctggagacccaggaaagccaggtctcacaggaccccagggacctcagggacttcccggtacccctggccgaccaggaataaaaggtgaaccaggagctccaggcaagatcgtgacttcggaggggtcatcgatgctcactgtcccaggccccccaggacctcctggagccatgggacccccaggacctccaggtgccccaggccctgccggcccagctggtctcccaggacatcaagaagttcttaatttacaaggtcccccaggcccacccggcccacgtgggccaccagggccttccattccaggcccaccaggaccccgaggcccaccaggggagggtttgccaggcccaccaggcccaccaggatcgttcctgtccaactcagaaaccttcctcttcggccccccaggcccacctggccccccaggtcccaagggagaccaaggtcccccaggccccagaggacaccaaggcgagcaaggcctcccaggtttctcaacctcagggtccagttctttcggactcaaccttcagggaccaccaggcccacctggcccccagggaccaaaaggtgacaaaggtgatccgggtgttccaggggctcttggcattcctagtggtccttctgaagggggatcatcaagtaccatgtacgtgtcaggcccgccagggccccctgggccccctgggcctccgggctctatcagcagctctggccaggagattcagcagtacatctctgagtacatgcagagtgacagtattagatcttacctatccggagttcagggtcccccaggcccacctggtcccccaggacctgtcaccaccatcacaggcgagactttcgactactcagagctggcaagccacgttgtgagctacttacggacttcggggtacggtgtcagcttgttctcgtcctccatctcttctgaagacatcctggctgtgctgcagcgggatgacgtgcgtcagtacctacgtcagtacttgatgggccctcggggtccgccagggccaccaggagccagtggagatgggtccctcctgtctttggactatgcagagctgagtagtcgcattctcagctacatgtcgagttctgggatcagcattgggcttcctggtcccccggggccccctggcttgccgggaacctcctatgaggagctcctctccttgctgcgagggtctgaattcagaggcatcgttggacccccaggtcccccgggtccaccagggatcccaggcaatgtgtggtccagcatcagcgtggaggacctctcgtcttacttacatactgccggcttgtcattcatcccaggccctccaggacctcctggtcccccagggcctcgagggcccccgggtgtctcaggagccctggcaacctatgcagctgaaaacagcgacagcttccggagcgagctgatcagctacctcacaagtcctgatgtgcgcagcttcattgttggccccccaggccctcctgggccgcagggaccccctggggacagccgcctcctgtccacggatgcctcccacagtcggggtagcagctcctcctcacacagctcatctgtcaggcggggcagctcctacagctcttccatgagcacaggaggaggtggtgcaggctccctgggtgcaggcggtgcctttggtgaagctgcaggagacaggggtccctatggcactgacatcggcccaggcggaggctatggggcagcagcagaaggcggcatgtatgctggcaatggcggactattgggagctgactttgctggagatctggattacaatgagctggctgtgagggtgtcagagagcatgcagcgtcagggcctactgcaagggatggcctacactgtccagggcccaccaggccagcctgggccacaggggccacccggcatcagcaaggtcttctctgcctacagcaacgtgactgcggacctcatggacttcttccaaacttatggagccattcaaggaccccctgggcaaaaaggagagatgggcactccaggacccaaaggtgacaggggccctgctgggccaccaggtcatcctgggccacctggccctcgaggacacaagggagaaaaaggagacaaaggtgaccaagtctatgctgggcggagaaggagaagaagtattgctgtcaagccgtgagctagccatggcaggacagctcctggaccaggcccatactagagttcatggatatgttatactgaaccaggccagagcaaacagaaaaagaaggttgagggcaatggacaaggaaggaataaagggagaagagggaaaacagaaaacctgatgctggggacacagcatcagctcaagacgtcaccctccattctgcactcagaaaatggcacttgggggactgggcgcagttggtctttaaccacttttcaatgtctaaaaacatttgtttgtggtctataagatgaaacatcatttcaatcgtaaaatttcccattaaagaagtttttttttctaa

SEQ ID NO: 59619 - DNA, 838 bp, Homo sapiens
tgctgtttgtggaaaataaagcattctataggcggagctagtgaacgcctcttttaaaacacgagtctccacacttccctgttcactttggttccagcatcctgtccagcaaagaagcaatcagccaaaatgatacctggaggcttatctgaggccaaacccgccactccagaaatccaggagattgttgataaggttaaaccacagcttgaagaaaaaacaaatgagacttacggaaaattggaagctgtgcagtataaaactcaagttgttgctggaacaaattactacattaaggtacgagcaggtgataataaatatatgcacttgaaagtattcaaaagtcttcccggacaaaatgaggacttggtacttactggataccaggttgacaaaaacaaggatgacgagctgacgggcttttagcagcatgtacccaaagtgttctgattccttcaactggctactgagtcatgatccttgctgataaatataaccatcaataaagaagcattcttttccaaagaaattatttcttcaattatttctcatttattgtattaagcagaaattaccttttctttctcaaaatcagtgttattgctttagagtataaactccatataaattgatggcaattggaaatcttataaaaactagtcaagcctaatgcaactggctaaaggatagtaccaccctcacccccaccataggcaggctggatcgtggactatcaattcaccagcctccttgttccctgtggctgctgataacccaacattccatctctaccctcatacttcaaaattaaatcaagtattttacaaaaaaaaaaaaa

SEQ ID NO: 59620 - DNA, 458 bp, Homo sapiens
gaccctagatcccaagatctccaaggatttggtggcatacccactccagcacacagaagcatgaggttcatgactctcctcttcctgacagctctggcaggagccctggtctgtgcctatgatccagaggccgcctctgccccaggatcggggaacccttgccatgaagcatcagcagctcaaaaggaaaatgcaggtgaagacccagggttagccagacaggcaccaaagccaaggaagcagagatccagccttctggaaaaaggcctagacggagcaaaaaaagctgtggggggactcggaaaactaggaaaagatgcagtcgaagatctagaaagcgtgggtaaaggagccgtccatgacgttaaagacgtccttgactcagtactatagctgtaaggagaagctgagaaatgatacccaggagcagcaggctttacgtcttcagcctaaaacct

SEQ ID NO: 59621 - DNA, 523 bp, Homo sapiens
caaatccatagggagctctgccttaccattgggttcctaattaactgagtgagtgggtgtgttctgcatggtgagaggcattggaatgatgcatcagaaaacatgtcataatgtcatcactgtaatatgacaagaattgcagctgtggctggaacctttataaagtgaccaagcacaccttttcatccagtctcagcgtggggtgaagcctagcagctatgaggatccattatcttctgtttgctttgctcttcctgtttttggtgcctgttccaggtcatggaggaatcataaacacattacagaaatattattgcagagtcagaggcggccggtgtgctgtgctcagctgccttccaaaggaggaacagatcggcaagtgctcgacgcgtggccgaaaatgctgccgaagaaagaaataaaaaccctgaaacatgacgagagtgttgtaaagtgtggaaatgccttcttaaagtttataaaagtaaaatcaaattacatttttttttcaaaaaaaaaaaaa

SEQ ID NO: 59622 - DNA, 2124 bp, Homo sapiens
ggcacaatgctcttgccctctaagaaggacctcaagactgccctggatgtctttgctgttttccagtggtccttcagtgccttgcttatcacaaccactgtgattgctgtcaacctctacctggtggtgttcacaccatactggcctgtcactgtgcttattcttacctggctggcttttgactggaagacccctcagcgaggcggccgccggtttacctgtgtgaggcactggcgcctgtggaaacactacagcgattatttccctctcaagcttctgaagactcatgacatctgccccagccgcaactacatcctcgtctgccaccctcatgggctctttgcccatggatggtttggccactttgccacagaggcctcaggcttctccaagatatttcctggcatcaccccttacatactcacactgggagcctttttctggatgcctttcctcagagaatatgtaatgtctacaggggcctgctctgtgagtcgatcctccattgactttctgctgactcataaaggcacaggcaacatggtcattgtggtgattggtggactggctgagtgcagatacagcctgccaggttcttctaccctggtgttgaagaaccggtctggctttgtgcgcatggcccttcagcatggggtgcctctaatacctgcctatgcctttggggagacggacctctatgatcagcacattttcactcctggtggctttgtcaaccgcttccagaagtggttccagagcatggtacacatctacccttgtgctttctatggacgtggcttcaccaagaactcctggggccttctgccctatagtcggcctgtaaccaccatcgtcggggagcctctaccaatgcccaagattgagaatccaagccaggagatcgtggctaaatatcacacactctatattgatgccctacgtaaactgtttgaccagcataagaccaagtttggtatctcagagacccaggagctggagataatttgacagacatccccagtagccttcaccctggctggaagctcttttctgccctttctttgcagctactggtgagatagtcccaagaaacagggaagagcctaggggagaggtgccctgacggcactttggtgccagcattgaggaaaacaatggacaaaataaaaagcccatcttctgataactgcgtgtgcaccaactactctgttttgaaggctctgggatgcatgtctctccttctctagctgtcaaacagccccatctcccggcattgagccccatcttctggcattgagtcctgcttcctacaggagtaggactggggccttgagagccagtgggctttgagtttaagctccaccaacttcaagccatgtgactttggggcaatcagtcacctctgagcctcctttcttcttctataaaatgagactaacaatctgtctcttgcttacctcaaaggccgttgggaagatcaaacaatattggatgtgattgaactttataaactggagagctacaccattttcttctccaaccattttacccatttcctgtccctgagcaaacaacgcccgaaataccctctgctacccactagccctcactcagtttctgcctcacaaagctgtaacagaatgggttgggctcaggcctaattttctctgtcattccctcagcaacttgcctatacttgtgtggccctataattctggcctttgtttgagagtcagccagcctgctcaggatgaaaatgaggcgcctggcttttagcagccataaagaactctccttctgaatggcaagtctctcagactcttggtctaatggctgttgcaatgacaggctacaaaatttggctcacatccctctcattccatccctcttgggtgggtgccatttggtccagtgatttacctgcattacgttggtcaatttggtctacaacatcctgcgtgtttactgcagtgtgagctgctgcctctatcctgggtgcctgcctcatgtgatgatttgtatacagtggccaaagacatgcttctgcttttctgctgtctttgttacttcttgtgccagagattacgttttccctgagcttccataaagtgtttttaaacagtc

SEQ ID NO: 59623 - DNA, 1708 bp, Homo sapiens
agtaagagattatagcaaagcatctataatcaactcagcttaagaagttttgaccttctggttaggcttcttgccacaacagaacagcaccataaccatggctttcttctcccgactgaatctccaggagggcctccaaaccttctttgttttgcaatggatcccagtctatatatttttaggagctattcccattctccttataccctactttctgttattcagtaagttctggcccttggctgtgctctccttagcctggctcacctatgattggaacacccacagtcaaggtggcaggcgttcagcttgggtacgaaactggaccctatggaagtatttccgaaattacttcccagtaaagctggtgaagactcatgatctttctcccaaacacaactacatcattgccaatcacccccatggcattctctcttttggtgtcttcatcaactttgccactgaggccactggcattgctcggattttcccatccatcactccctttgtagggaccttagaaaggatattttggatcccaattgtgcgagaatatgtgatgtcaatgggtgtgtgccctgtgagtagctcagccttgaagtacttgctgacccagaaaggctcaggcaatgccgtggttattgtggtgggtggagctgctgaagctctcttgtgccgaccaggagcctccactctcttcctcaagcagcgtaaaggttttgtgaagatggcactgcaaacaggggcataccttgtcccttcatattcctttggtgagaacgaagttttcaatcaggagaccttccctgagggcacgtggttaaggttgttccaaaaaaccttccaggacacattcaaaaaaatcctgggactaaatttctgtaccttccatggccggggcttcactcgcggatcctggggcttcctgcctttcaatcggcccattaccactgttgttggggaaccccttccaattcccaggattaagaggccaaaccagaagacagtagacaagtatcacgcactctacatcagtgccctgcgcaagctctttgaccaacacaaagttgaatatggcctccctgagacccaagagctgacaattacataacaggagccacattccccattgatcaacccccaaagccatgagggatccaagtagagccacagaaaaagaagaattccaggagagggaaagatcgtaaggatgagagaggagaccatccaagccagaaattatttaataaatcagagttctagcaatagagtcctctcccaagtggctgaggcaggcttaggggaaagaaccagaggggcaggggaggactggggagggctggctagccagaggagttggctgtaccacccctggttattttagggcaacaacccagttggggagtcttatgaatcattccagccaactctctgatcacaaagaatactgtgcccctttctcctaaaccttagttcaccatcactacgtaggtttagacttagaagctttatttggaacagggatagtttgtttcctcttggtcctttccttacaacttgggaactgccacaaggtaaaccagggacctgaactgtagctgcctggtccaagcagacaggattccgtcagttgtgatagagttctagattggcaatgcagttacattgtttcttctttgaaaataaagttctagacatataaaacagg

SEQ ID NO: 59624 - DNA, 2613 bp, Homo sapiens
agcatttgattgtggcttgggacgcgaggagaggcgcgcagcgaccgcctgacggcaggcaatggtgtaagcgcctctcggcctccccctccccccagacgcggccgggtcctcccttcgccttctggacacacacccctgcctcgtctcttccgcctctctcgcactccggtccgttcctgtcctctgcggaggccagccctggggaggtgcagcgcccgccaggatgagtggctccttcgatcgcaagctcagcagcatcctcaccgacatctccagctcccttagctgccatgcgggctccaaggactcgcctaccctgcccgagtcttctgtcactgacctgggctactacagcgctccccagcacgattactactcgggccagccctatggccagacggtgaacccctacacctaccaccaccaattcaatctcaatgggcttgcaggcacgggcgcttactcgcccaagtcggaatatacctacggagcctcctaccggcaatacggggcgtatcgggagcagccgctgccagcccaggacccagtgtcggtgaaggaggagccggaagcagaggtgcgcatggtgaatgggaagcccaagaaggtccgaaagccgcgtacgatctactccagctaccagctggccgccctgcagcgccgcttccagaaggcccagtacctggcgctgcccgagcgcgccgagctggccgcgcagctgggcctcacgcagacacaggtgaaaatctggttccagaaccgccgttccaagttcaagaaactctacaagaacggggaggtgccgctggagcacagtcccaataacagtgattccatggcctgcaactcaccaccatcacccgccctctgggacacctcttcccactccactccggcccctgcccgcagtcagctgcccccgccgctcccatacagtgcctcccccagctacctggacgaccccaccaactcctggtatcacgcacagaacctgagtggaccccacttacagcagcagccgcctcagccagccaccctgcaccatgcctctcccgggcccccgcccaaccctggggctgtgtactgagcacccatctggcctgcacccttgacaaaggaccccaggaccaggcagaaggcgcctccgtcctagccactcaggaatcatcgaggagcacagggaaaaggaactccctttccccctcccttgccccttcctccagggacccaagcgcttccagatgacatttgcatggaccaaggatgccccctgaacctccctccctctgcctagacactggggtacccctccagatgtggggacattccaccccagtggggacagccattcccctacctgctccaggagcctggattggctttaaatggctcatcatcttccagcttcttaaacttagtgcctgttcccagactggagaccttgggatgggggagagtgtggagggtttgcgggtcctgcctgtgctggggcacctggcaccgtggatcttaaaacttgccaggcctagttcctcctgagcctctggtggtctccccctgctcgagcggcccctcggccaataagacagtggacatcatgacgaggactccgggtggggacctgaactggtcaccgccctgcacttctagccctcatttaagatttgagggtgaaaccaaagaaaaccccctaagtgagggaatcttttaatatttgtggctttagaggaaagaactaaaggagccatctctctcccctctcctccgttccgagaggaggggtgggtctcagacgtttttcctatggacttatttcttccatgtccaggactttgcacaactttggttttaaaagctgttgaaaaataggaaaacaaagggcattgttcacagatagggccaagtctccccttgcaagggtgcctctgttctgtccctgcccccacctcaccttctctactcctccagtaagttggcagttttggtgccaaaccccaaatctccaaagagacataccaggcaagacaaacccccaaacacctcctttccggtggccttggaaacagattgctccgagctggagaatgtcgggtgaggtgtatgggagaggaggggagagttagaacttgtgcctttgggagtaaggggtaactgcctggagggctggtggcactgcccctccctgacccagacatcccaccaaagctaactttcccccacccctgatgcagtaaaacattgaaaaaaaaaaaaaaggagaggtagaagactgtagctatatatataaatatatagtaagttttttttttttaagagcaacagagagaagcagcctcctccctgctgcggtttcctatttatgtggccatgttcctcctggacggatctccctgtgtgtttcaagctgagagatgtgggctccggctggatttgggttttgtgggaggtgcaggggccaagagagacgtggtaggtctccaagagtcccacccgggggggaagaagcaaagccatctcccaccccctcctagccttctcatttctgctttcttactggactcatctttatatataatgttaataaaaaagacgaaaataaaaaaaaaaaaa

SEQ ID NO: 59625 - DNA, 4271 bp, Homo sapiens
acttgtaggaaagcctctttgcatttagacgtaattgaactggaaggaaggagactggccagggaatagggggaaagaaattctcccgttgctcctcctactgtttatcacttgcctccggactgtcttccaaaccaagctcagctgcatcaaggtggcagcagaataccctgtgcaagtgccagcgtcttcttagccgctctgtgcatcccaggctgccctgttatctggccaccgtccctggccattgggactgcttctgatggctctggcctctgctgccccagggagcatcttctgtaagcagctccttttctctctcctggttttaacattactttgcgatgcttgtcagaaagtttatcttcgagttccttctcatcttcaggctgaaacacttgtaggcaaagtgaatctggaggagtgtctcaagtcggccagcctaatccggtccagtgaccctgccttcagaattctagaagatggctcaatttacacaacacatgacctcattttgtcttctgaaaggaaaagtttttccattttcctttcagatggtcagagacgggaacaacaagagataaaagttgtactgtcagcaagagaaaacaagtctcctaagaagagacataccaaagacacagccctcaagcgcagcaagagacgatgggctcctattccagcttcattgatggagaactcgttgggtccatttccacaacacgttcagcagatccaatctgatgctgcacagaattacaccatcttttattccataagtgggccaggcgtggacaaagaacccttcaatttgttttacatagagaaagacactggggatatcttttgtacaaggagcattgaccgtgagaaatacgaacagtttgcgttatatggctatgcaacaactgcagatggctatgcaccagaatatccactccctttgatcatcaaaattgaagatgataatgataacgccccatattttgaacacagagtgactatctttactgtgcctgaaaattgccgatccggaacttcagtgggaaaagtgaccgccacagaccttgacgaacctgacactctccatactcgtctgaaatataaaatcttacaacaaatcccagatcatccaaagcatttctccatacacccagataccggtgtcatcaccacaactacaccttttctggatagagaaaaatgtgatacttaccagttaataatggaagtgcgagacatgggtggtcagcctttcggtttatttaatacaggaacaattactatttcacttgaggatgaaaatgacaatccaccatctttcacagaaacttcttatgttacagaagtagaagaaaacagaattgacgtggagattttgcgaatgaaggtacaggatcaggatttgccaaacactcctcactcaaaggctgtatacaaaatcttacaaggaaatgaaaatggaaacttcataattagcacagatccaaatacaaatgaaggagtgctgtgtgttgtcaagccattgaactatgaagtcaatcgccaagttattttgcaagttggtgtcattaacgaggcacaattctctaaagcagcgagctcacaaactcctacaatgtgcactacaactgtcaccgttaaaattatagacagtgatgagggccctgaatgccaccctccagtgaaagttattcagagtcaagatggcttcccagctggccaagaactccttggatacaaagcactggacccggaaatatccagtggtgaaggcttaaggtatcagaagttaggggatgaagataactggtttgaaattaatcaacacactggcgacttgagaactctaaaagtactagatagagaatccaaatttgtaaaaaacaaccaatacaatatttcagttgttgcagtggatgcagttggccgatcttgcactggaacattagtagttcatttggatgattacaacgatcacgcacctcaaattgacaaagaagtgaccatttgtcagaataatgaggattttgctgttctgaaacctgtagatccagatggacctgaaaatggaccaccttttcaattctttctggataattctgccagtaaaaactggaacatagaagaaaaggatggtaaaactgccattcttcgtcaacggcaaaatcttgattataactattattctgtgcctattcaaataaaagacaggcatggtttagttgcaacacatatgttaacagtgagagtatgtgactgttcaactccatctgagtgtagaatgaaggataaaagtacaagagacgttagaccaaatgtaatacttggaagatgggctattcttgctatggtgttgggttctgtattgttattatgtattctgtttacatgtttctgtgtcactgctaagagaacagtcaagaaatgttttccagaagacatagcccagcaaaatttaattgtatcaaatactgaaggacctggagaagaagtaacggaagcaaatattagactccccatgcagacatccaacatttgtgacacaagcatgtctgttggtactgttggtggccagggaatcaaaacacagcaaagttttgagatggtcaaaggaggctacactttggattccaacaaaggaggtggacatcagaccttggagtccgtcaagggagtggggcagggagatactggcagatatgcgtacacggactggcagagtttcacccaacctcggcttggcgaagaatccattagaggacacactctgattaaaaattaaacagtaaaagaaggtgtatttgtgtggacaagatgaggagcataaacattgtgaagactacgtttgttcgtataactatgaaggcaaaggttctctggccggctcagtaggttgctgcagcgatcggcaggaagaagagggactggagtttctagatcacctggaacccaaatttaggacattagcaaagacatgcatcaagaaataaatgtgccttttaatagtgtaatatccacagatgcataagtaggaatttattacttgcagaatgttagcagcatctgctaatgtttttgtttatggaggtaaactttgtcatgtataggtaagggtactataaatatgagattcccctacattctccttgtctggtataacttccatgttctctagaaatcaaggttttgtttgttaattctcttttatatgcatgtatatattgcccttttcacgactgtactgtacaccttcttgcaccttttatttgcaaactgatgttactttttgtgctgtggaagagcatttgggaaagctgggtattatagaggccaatgaaagatgaatttgcattgtagatgtacgaattaaatatgttcttcaaaatcttggggagaattatgttcttagaacatagttggtgccagataattgcattctctccacctgagtggtttaaaaaggacttttaagtattcttcagtgcaatcttcagttttgtgattaagttcatttctcttttacacttttgtactcctcagagcagtgctcccagcattgttttctttcaggatccttcagagctcagtccctggacctctgcccatgtggatttgttgttaggtcactccaacttctaaggttcttggaaagataaggaccagaacaagctcatagcaaattgaggggcagagattttatgaagattacatgagaagatttccatgaaagaattgcagccctgaggtccatgggttgacttatgctcacaaatatgtttcgtttgctcaacatggtttactactaacattttaaaaatataaatactttagcaaaaacattcactcttgagtttgacataggcctgccttatctgtggttgccacctgccatctccaagcatttggacaactagccctgatgcattaggctgcaactctgatatacagagactagcaccttgaatatgccagaaattgaattaccatctgtattagaacttaagactcagcctaaatttacagttactttaagaaaatgggcagtcagaattagggactagaatgtatatgagaaacccccactctactaaaaatataagaaattagccggacatggtggcgaatgactgtaatcccagctactcaggaggctgaggcaggagaatcgcttgaatccaggaggcggaggttgcagtgagccgagattgccactgcactccagcctgggcaacaagagcgaaactccgtctcaaaaaaaaaaaaaaaaa

SEQ ID NO: 59626 - DNA, 4225 bp, Homo sapiens
acttgtaggaaagcctctttgcatttagacgtaattgaactggaaggaaggagactggccagggaatagggggaaagaaattctcccgttgctcctcctactgtttatcacttgcctccggactgtcttccaaaccaagctcagctgcatcaaggtggcagcagaataccctgtgcaagtgccagcgtcttcttagccgctctgtgcatcccaggctgccctgttatctggccaccgtccctggccattgggactgcttctgatggctctggcctctgctgccccagggagcatcttctgtaagcagctccttttctctctcctggttttaacattactttgcgatgcttgtcagaaagtttatcttcgagttccttctcatcttcaggctgaaacacttgtaggcaaagtgaatctggaggagtgtctcaagtcggccagcctaatccggtccagtgaccctgccttcagaattctagaagatggctcaatttacacaacacatgacctcattttgtcttctgaaaggaaaagtttttccattttcctttcagatggtcagagacgggaacaacaagagataaaagttgtactgtcagcaagagaaaacaagtctcctaagaagagacataccaaagacacagccctcaagcgcagcaagagacgatgggctcctattccagcttcattgatggagaactcgttgggtccatttccacaacacgttcagcagatccaatctgatgctgcacagaattacaccatcttttattccataagtgggccaggcgtggacaaagaacccttcaatttgttttacatagagaaagacactggggatatcttttgtacaaggagcattgaccgtgagaaatacgaacagtttgcgttatatggctatgcaacaactgcagatggctatgcaccagaatatccactccctttgatcatcaaaattgaagatgataatgataacgccccatattttgaacacagagtgactatctttactgtgcctgaaaattgccgatccggaacttcagtgggaaaagtgaccgccacagaccttgacgaacctgacactctccatactcgtctgaaatataaaatcttacaacaaatcccagatcatccaaagcatttctccatacacccagataccggtgtcatcaccacaactacaccttttctggatagagaaaaatgtgatacttaccagttaataatggaagtgcgagacatgggtggtcagcctttcggtttatttaatacaggaacaattactatttcacttgaggatgaaaatgacaatccaccatctttcacagaaacttcttatgttacagaagtagaagaaaacagaattgacgtggagattttgcgaatgaaggtacaggatcaggatttgccaaacactcctcactcaaaggctgtatacaaaatcttacaaggaaatgaaaatggaaacttcataattagcacagatccaaatacaaatgaaggagtgctgtgtgttgtcaagccattgaactatgaagtcaatcgccaagttattttgcaagttggtgtcattaacgaggcacaattctctaaagcagcgagctcacaaactcctacaatgtgcactacaactgtcaccgttaaaattatagacagtgatgagggccctgaatgccaccctccagtgaaagttattcagagtcaagatggcttcccagctggccaagaactccttggatacaaagcactggacccggaaatatccagtggtgaaggcttaaggtatcagaagttaggggatgaagataactggtttgaaattaatcaacacactggcgacttgagaactctaaaagtactagatagagaatccaaatttgtaaaaaacaaccaatacaatatttcagttgttgcagtggatgcagttggccgatcttgcactggaacattagtagttcatttggatgattacaacgatcacgcacctcaaattgacaaagaagtgaccatttgtcagaataatgaggattttgctgttctgaaacctgtagatccagatggacctgaaaatggaccaccttttcaattctttctggataattctgccagtaaaaactggaacatagaagaaaaggatggtaaaactgccattcttcgtcaacggcaaaatcttgattataactattattctgtgcctattcaaataaaagacaggcatggtttagttgcaacacatatgttaacagtgagagtatgtgactgttcaactccatctgagtgtagaatgaaggataaaagtacaagagacgttagaccaaatgtaatacttggaagatgggctattcttgctatggtgttgggttctgtattgttattatgtattctgtttacatgtttctgtgtcactgctaagagaacagtcaagaaatgttttccagaagacatagcccagcaaaatttaattgtatcaaatactgaaggacctggagaagaagtaacggaagcaaatattagactccccatgcagacatccaacatttgtgacacaagcatgtctgttggtactgttggtggccagggaatcaaaacacagcaaagttttgagatggtcaaaggaggctacactttggattccaacaaaggaggtggacatcagaccttggagtccgtcaagggagtggggcagggagatactggcagatatgcgtacacggactggcagagtttcacccaacctcggcttggcgaaaaggtgtatttgtgtggacaagatgaggagcataaacattgtgaagactacgtttgttcgtataactatgaaggcaaaggttctctggccggctcagtaggttgctgcagcgatcggcaggaagaagagggactggagtttctagatcacctggaacccaaatttaggacattagcaaagacatgcatcaagaaataaatgtgccttttaatagtgtaatatccacagatgcataagtaggaatttattacttgcagaatgttagcagcatctgctaatgtttttgtttatggaggtaaactttgtcatgtataggtaagggtactataaatatgagattcccctacattctccttgtctggtataacttccatgttctctagaaatcaaggttttgtttgttaattctcttttatatgcatgtatatattgcccttttcacgactgtactgtacaccttcttgcaccttttatttgcaaactgatgttactttttgtgctgtggaagagcatttgggaaagctgggtattatagaggccaatgaaagatgaatttgcattgtagatgtacgaattaaatatgttcttcaaaatcttggggagaattatgttcttagaacatagttggtgccagataattgcattctctccacctgagtggtttaaaaaggacttttaagtattcttcagtgcaatcttcagttttgtgattaagttcatttctcttttacacttttgtactcctcagagcagtgctcccagcattgttttctttcaggatccttcagagctcagtccctggacctctgcccatgtggatttgttgttaggtcactccaacttctaaggttcttggaaagataaggaccagaacaagctcatagcaaattgaggggcagagattttatgaagattacatgagaagatttccatgaaagaattgcagccctgaggtccatgggttgacttatgctcacaaatatgtttcgtttgctcaacatggtttactactaacattttaaaaatataaatactttagcaaaaacattcactcttgagtttgacataggcctgccttatctgtggttgccacctgccatctccaagcatttggacaactagccctgatgcattaggctgcaactctgatatacagagactagcaccttgaatatgccagaaattgaattaccatctgtattagaacttaagactcagcctaaatttacagttactttaagaaaatgggcagtcagaattagggactagaatgtatatgagaaacccccactctactaaaaatataagaaattagccggacatggtggcgaatgactgtaatcccagctactcaggaggctgaggcaggagaatcgcttgaatccaggaggcggaggttgcagtgagccgagattgccactgcactccagcctgggcaacaagagcgaaactccgtctcaaaaaaaaaaaaaaaaa

SEQ ID NO: 59627 - DNA, 5879 bp, Homo sapiens
ggcaggtctcgctctcggcaccctcccggcgcccgcgttctcctggccctgcccggcatcccgatggccgccgctgggccccggcgctccgtgcgcggagccgtctgcctgcatctgctgctgaccctcgtgatcttcagtcgtgatggtgaagcctgcaaaaaggtgatacttaatgtaccttctaaactagaggcagacaaaataattggcagagttaatttggaagagtgcttcaggtctgcagacctcatccggtcaagtgatcctgatttcagagttctaaatgatgggtcagtgtacacagccagggctgttgcgctgtctgataagaaaagatcatttaccatatggctttctgacaaaaggaaacagacacagaaagaggttactgtgctgctagaacatcagaagaaggtatcgaagacaagacacactagagaaactgttctcaggcgtgccaagaggagatgggcacctattccttgctctatgcaagagaattccttgggccctttcccattgtttcttcaacaagttgaatctgatgcagcacagaactatactgtcttctactcaataagtggacgtggagttgataaagaacctttaaatttgttttatatagaaagagacactggaaatctattttgcactcggcctgtggatcgtgaagaatatgatgtttttgatttgattgcttatgcgtcaactgcagatggatattcagcagatctgcccctcccactacccatcagggtagaggatgaaaatgacaaccaccctgttttcacagaagcaatttataattttgaagttttggaaagtagtagacctggtactacagtgggggtggtttgtgccacagacagagatgaaccggacacaatgcatacgcgcctgaaatacagcattttgcagcagacaccaaggtcacctgggctcttttctgtgcatcccagcacaggcgtaatcaccacagtctctcattatttggacagagaggttgtagacaagtactcattgataatgaaagtacaagacatggatggccagttttttggattgataggcacatcaacttgtatcataacagtaacagattcaaatgataatgcacccactttcagacaaaatgcttatgaagcatttgtagaggaaaatgcattcaatgtggaaatcttacgaatacctatagaagataaggatttaattaacactgccaattggagagtcaattttaccattttaaagggaaatgaaaatggacatttcaaaatcagcacagacaaagaaactaatgaaggtgttctttctgttgtaaagccactgaattatgaagaaaaccgtcaagtgaacctggaaattggagtaaacaatgaagcgccatttgctagagatattcccagagtgacagccttgaacagagccttggttacagttcatgtgagggatctggatgaggggcctgaatgcactcctgcagcccaatatgtgcggattaaagaaaacttagcagtggggtcaaagatcaacggctataaggcatatgaccccgaaaatagaaatggcaatggtttaaggtacaaaaaattgcatgatcctaaaggttggatcaccattgatgaaatttcagggtcaatcataacttccaaaatcctggatagggaggttgaaactcccaaaaatgagttgtataatattacagtcctggcaatagacaaagatgatagatcatgtactggaacacttgctgtgaacattgaagatgtaaatgataatccaccagaaatacttcaagaatatgtagtcatttgcaaaccaaaaatggggtataccgacattttagctgttgatcctgatgaacctgtccatggagctccattttatttcagtttgcccaatacttctccagaaatcagtagactgtggagcctcaccaaagttaatgatacagctgcccgtctttcatatcagaaaaatgctggatttcaagaatataccattcctattactgtaaaagacagggccggccaagctgcaacaaaattattgagagttaatctgtgtgaatgtactcatccaactcagtgtcgtgcgacttcaaggagtacaggagtaatacttggaaaatgggcaatccttgcaatattactgggtatagcactgctcttttctgtattgctaactttagtatgtggagtttttggtgcaactaaagggaaacgttttcctgaagatttagcacagcaaaacttaattatatcaaacacagaagcacctggagacgatagagtgtgctctgccaatggatttatgacccaaactaccaacaactctagccaaggtttttgtggtactatgggatcaggaatgaaaaatggagggcaggaaaccattgaaatgatgaaaggaggaaaccagaccttggaatcctgccggggggctgggcatcatcataccctggactcctgcaggggaggacacacggaggtggacaactgcagatacacttactcggagtggcacagttttactcaaccccgtctcggtgaaaaattgcatcgatgtaatcagaatgaagaccgcatgccatcccaagattatgtcctcacttataactatgagggaagaggatctccagctggttctgtgggctgctgcagtgaaaagcaggaagaagatggccttgactttttaaataatttggaacccaaatttattacattagcagaagcatgcacaaagagataatgtcacagtgctacaattaggtctttgtcagacattctggaggtttccaaaaataatattgtaaagttcaatttcaacatgtatgtatatgatgatttttttctcaattttgaattatgctactcaccaatttatatttttaaagccagttgttgcttatcttttccaaaaagtgaaaaatgttaaaacagacaactggtaaatctcaaactccagcactggaattaaggtctctaaagcatctgctcttttttttttttacggatattttagtaataaatatgctggataaatattagtccaacaatagctaagttatgctaatatcacattattatgtattcactttaagtgatagtttaaaaaataaacaagaaatattgagtatcactatgtgaagaaagttttggaaaagaaacaatgaagactgaattaaattaaaaatgttgcagctcataaagaattgggactcacccctactgcactaccaaattcatttgactttggaggcaaaatgtgttgaagtgccctatgaagtagcaattttctataggaatatagttggaaataaatgtgtgtgtgtatattattattaatcaatgcaatatttaaaatgaaatgagaacaaagaggaaaatggtaaaaacttgaaatgaggctggggtatagtttgtcctacaatagaaaaaagagagagcttcctaggcctgggctcttaaatgctgcattataactgagtctatgaggaaatagttcctgtccaatttgtgtaatttgtttaaaattgtaaataaattaaacttttctggtttctgtgggaaggaaatagggaatccaatggaacagtagctttgctttgcagtctgtttcaagatttctgcatccacaagttagtagcaaactggggaatactcgctgcagctggggttccctgctttttggtagcaagggtccagagatgaggtgtttttttcggggagctaataacaaaaacattttaaaacttacctttactgaagttaaatcctctattgctgtttctattctctcttatagtgaccaacatctttttaatttagatccaaataaccatgtcctcctagagtttagaggctagagggagctgaggggaggatcttactgaaagcaccctggggagattgattgtccttaaacctaagccccacaaacttgacacctgatcaggtctgggagctacaaaatttcatttttctcctcactgcccttcttctgagtggcattggcctgaatcaaggaaagccaggccttgtgggcccccttctttcggctttctgctaaagcaacacctccagcagagattcccttaagtgactccaggttttccaccatccttcagcgtgaattaatttttaatcagtttgctttctccagagaaattttaaaataatagaagaaatagaaattttgaatgtataaaagaaaaagatcaagttgtcattttagaacagagggaactttgggagaaagcagcccaagtaggttatttgtacagtcagagggcaacaggaagatgcaggccttcaagggcaaggagaggccacaaggaatatgggtgggagtaaaagcaacatcgtctgcttcatactttttcctaggcttggcactgccttttcctttctcaggccaatggcaactgccatttgagtccggtgagggatcagccaacctcttctctatggctcaccttatttggagtgagaaatcaaggagacagagctgactgcatgatgagtctgaaggcatttgcaggatgagcctgaactggttgtgcagaacaaacaaggcattcatgggaattgttgtattccttctgcagccctccttctgggcactaagaaggtctatgaattaaatgcctatctaaaattctgatttattcctacattttctgttttctaatttgaccctaaaatctatgtgttttagacttagactttttattgccccccccccctttttttttgagacggagtctcgctctgacgcacaggctggagtgcagtggctccgatctctgctcactgaaagctccgcctcccgggttcatgccattctcctgcctcagcctcctgagtagctgggactacaggcgcccaccaccacgcccggctaattttttgtatttttaatagagacggggtttcactgtgttagccaggatggtctcgatctcctgacctcgtgatccgcctgcctcggcctcccaaagtgctgggattacaggcatgacccaccgctcccggccttgttttccgtttaaagtcgtcttcttttaatgtaatcattttgaacatgtgtgaaagttgatcatacgaattggatcaatcttgaaatactcaaccaaaagacagtcgagaagccagggggagaaagaactcagggcacaaaatattggtctgagaatggaattctctgtaagcctagttgctgaaatttcctgctgtaaccagaagccagttttatctaacggctactgaaacacccactgtgttttgctcactccctcactcaccgatcaaaacctgctacctccccaagactttactagtgccgataaactttctcaaagagcaaccagtatcacttccctgtttataaaacctctaaccatctctttgttctttgaacatgctgaaaaccacctggtctgcatgtatgcccgaatttgtaattcttttctctcaaatgaaaatttaattttagggattcatttctatattttcacatatgtagtattattatttccttatatgtgtaaggtgaaatttatggtatttgagtgtgcaagaaaatatatttttaaagctttcatttttcccccagtgaatgatttagaattttttatgtaaatatacagaatgttttttcttacttttataaggaagcagctgtctaaaatgcagtggggtttgttttgcaatgttttaaacagagttttagtattgctattaaaagaagttactttgcttttaaagaaacttggctgcttaaaataagcaaaaattggatgcataaagtaatatttacagatgtggggagatgtaataaaacaatattaacttggaaaaaaaaaaaaaaaaaaa

SEQ ID NO: 59628 - DNA, 5920 bp, Homo sapiens
ggcaggtctcgctctcggcaccctcccggcgcccgcgttctcctggccctgcccggcatcccgatggccgccgctgggccccggcgctccgtgcgcggagccgtctgcctgcatctgctgctgaccctcgtgatcttcagtcgtgatggtgaagcctgcaaaaaggtgatacttaatgtaccttctaaactagaggcagacaaaataattggcagagttaatttggaagagtgcttcaggtctgcagacctcatccggtcaagtgatcctgatttcagagttctaaatgatgggtcagtgtacacagccagggctgttgcgctgtctgataagaaaagatcatttaccatatggctttctgacaaaaggaaacagacacagaaagaggttactgtgctgctagaacatcagaagaaggtatcgaagacaagacacactagagaaactgttctcaggcgtgccaagaggagatgggcacctattccttgctctatgcaagagaattccttgggccctttcccattgtttcttcaacaagttgaatctgatgcagcacagaactatactgtcttctactcaataagtggacgtggagttgataaagaacctttaaatttgttttatatagaaagagacactggaaatctattttgcactcggcctgtggatcgtgaagaatatgatgtttttgatttgattgcttatgcgtcaactgcagatggatattcagcagatctgcccctcccactacccatcagggtagaggatgaaaatgacaaccaccctgttttcacagaagcaatttataattttgaagttttggaaagtagtagacctggtactacagtgggggtggtttgtgccacagacagagatgaaccggacacaatgcatacgcgcctgaaatacagcattttgcagcagacaccaaggtcacctgggctcttttctgtgcatcccagcacaggcgtaatcaccacagtctctcattatttggacagagaggttgtagacaagtactcattgataatgaaagtacaagacatggatggccagttttttggattgataggcacatcaacttgtatcataacagtaacagattcaaatgataatgcacccactttcagacaaaatgcttatgaagcatttgtagaggaaaatgcattcaatgtggaaatcttacgaatacctatagaagataaggatttaattaacactgccaattggagagtcaattttaccattttaaagggaaatgaaaatggacatttcaaaatcagcacagacaaagaaactaatgaaggtgttctttctgttgtaaagccactgaattatgaagaaaaccgtcaagtgaacctggaaattggagtaaacaatgaagcgccatttgctagagatattcccagagtgacagccttgaacagagccttggttacagttcatgtgagggatctggatgaggggcctgaatgcactcctgcagcccaatatgtgcggattaaagaaaacttagcagtggggtcaaagatcaacggctataaggcatatgaccccgaaaatagaaatggcaatggtttaaggtacaaaaaattgcatgatcctaaaggttggatcaccattgatgaaatttcagggtcaatcataacttccaaaatcctggatagggaggttgaaactcccaaaaatgagttgtataatattacagtcctggcaatagacaaagatgatagatcatgtactggaacacttgctgtgaacattgaagatgtaaatgataatccaccagaaatacttcaagaatatgtagtcatttgcaaaccaaaaatggggtataccgacattttagctgttgatcctgatgaacctgtccatggagctccattttatttcagtttgcccaatacttctccagaaatcagtagactgtggagcctcaccaaagttaatgatacagctgcccgtctttcatatcagaaaaatgctggatttcaagaatataccattcctattactgtaaaagacagggccggccaagctgcaacaaaattattgagagttaatctgtgtgaatgtactcatccaactcagtgtcgtgcgacttcaaggagtacaggagtaatacttggaaaatgggcaatccttgcaatattactgggtatagcactgctcttttctgtattgctaactttagtatgtggagtttttggtgcaactaaagggaaacgttttcctgaagatttagcacagcaaaacttaattatatcaaacacagaagcacctggagacgatagagtgtgctctgccaatggatttatgacccaaactaccaacaactctagccaaggtttttgtggtactatgggatcaggaatgaaaaatggagggcaggaaaccattgaaatgatgaaaggaggaaaccagaccttggaatcctgccggggggctgggcatcatcataccctggactcctgcaggggaggacacacggaggtggacaactgcagatacacttactcggagtggcacagttttactcaaccccgtctcggtgaagaatccattagaggacacactggttaaaaattaaacataaaagaaattgcatcgatgtaatcagaatgaagaccgcatgccatcccaagattatgtcctcacttataactatgagggaagaggatctccagctggttctgtgggctgctgcagtgaaaagcaggaagaagatggccttgactttttaaataatttggaacccaaatttattacattagcagaagcatgcacaaagagataatgtcacagtgctacaattaggtctttgtcagacattctggaggtttccaaaaataatattgtaaagttcaatttcaacatgtatgtatatgatgatttttttctcaattttgaattatgctactcaccaatttatatttttaaagccagttgttgcttatcttttccaaaaagtgaaaaatgttaaaacagacaactggtaaatctcaaactccagcactggaattaaggtctctaaagcatctgctcttttttttttttacggatattttagtaataaatatgctggataaatattagtccaacaatagctaagttatgctaatatcacattattatgtattcactttaagtgatagtttaaaaaataaacaagaaatattgagtatcactatgtgaagaaagttttggaaaagaaacaatgaagactgaattaaattaaaaatgttgcagctcataaagaattgggactcacccctactgcactaccaaattcatttgactttggaggcaaaatgtgttgaagtgccctatgaagtagcaattttctataggaatatagttggaaataaatgtgtgtgtgtatattattattaatcaatgcaatatttaaaatgaaatgagaacaaagaggaaaatggtaaaaacttgaaatgaggctggggtatagtttgtcctacaatagaaaaaagagagagcttcctaggcctgggctcttaaatgctgcattataactgagtctatgaggaaatagttcctgtccaatttgtgtaatttgtttaaaattgtaaataaattaaacttttctggtttctgtgggaaggaaatagggaatccaatggaacagtagctttgctttgcagtctgtttcaagatttctgcatccacaagttagtagcaaactggggaatactcgctgcagctggggttccctgctttttggtagcaagggtccagagatgaggtgtttttttcggggagctaataacaaaaacattttaaaacttacctttactgaagttaaatcctctattgctgtttctattctctcttatagtgaccaacatctttttaatttagatccaaataaccatgtcctcctagagtttagaggctagagggagctgaggggaggatcttactgaaagcaccctggggagattgattgtccttaaacctaagccccacaaacttgacacctgatcaggtctgggagctacaaaatttcatttttctcctcactgcccttcttctgagtggcattggcctgaatcaaggaaagccaggccttgtgggcccccttctttcggctttctgctaaagcaacacctccagcagagattcccttaagtgactccaggttttccaccatccttcagcgtgaattaatttttaatcagtttgctttctccagagaaattttaaaataatagaagaaatagaaattttgaatgtataaaagaaaaagatcaagttgtcattttagaacagagggaactttgggagaaagcagcccaagtaggttatttgtacagtcagagggcaacaggaagatgcaggccttcaagggcaaggagaggccacaaggaatatgggtgggagtaaaagcaacatcgtctgcttcatactttttcctaggcttggcactgccttttcctttctcaggccaatggcaactgccatttgagtccggtgagggatcagccaacctcttctctatggctcaccttatttggagtgagaaatcaaggagacagagctgactgcatgatgagtctgaaggcatttgcaggatgagcctgaactggttgtgcagaacaaacaaggcattcatgggaattgttgtattccttctgcagccctccttctgggcactaagaaggtctatgaattaaatgcctatctaaaattctgatttattcctacattttctgttttctaatttgaccctaaaatctatgtgttttagacttagactttttattgccccccccccctttttttttgagacggagtctcgctctgacgcacaggctggagtgcagtggctccgatctctgctcactgaaagctccgcctcccgggttcatgccattctcctgcctcagcctcctgagtagctgggactacaggcgcccaccaccacgcccggctaattttttgtatttttaatagagacggggtttcactgtgttagccaggatggtctcgatctcctgacctcgtgatccgcctgcctcggcctcccaaagtgctgggattacaggcatgacccaccgctcccggccttgttttccgtttaaagtcgtcttcttttaatgtaatcattttgaacatgtgtgaaagttgatcatacgaattggatcaatcttgaaatactcaaccaaaagacagtcgagaagccagggggagaaagaactcagggcacaaaatattggtctgagaatggaattctctgtaagcctagttgctgaaatttcctgctgtaaccagaagccagttttatctaacggctactgaaacacccactgtgttttgctcactcccactcaccgatcaaaacctgctacctccccaagactttactagtgccgataaactttctcaaagagcaaccagtatcacttccctgtttataaaacctctaaccatctctttgttctttgaacatgctgaaaaccacctggtctgcatgtatgcccgaatttgtaattcttttctctcaaatgaaaatttaattttagggattcatttctatattttcacatatgtagtattattatttccttatatgtgtaaggtgaaatttatggtatttgagtgtgcaagaaaatatatttttaaagctttcatttttcccccagtgaatgatttagaattttttatgtaaatatacagaatgttttttcttacttttataaggaagcagctgtctaaaatgcagtggggtttgttttgcaatgttttaaacagagttttagtattgctattaaaagaagttactttgcttttaaagaaacttggctgcttaaaataagcaaaaattggatgcataaagtaatatttacagatgtggggagatgtaataaaacaatattaacttggaaaaaaaaaaaaaaaaaaa

SEQ ID NO: 59629 - DNA, 4512 bp, Homo sapiens
cccagcccaagtttttagggtggggatccagactggttatacgtaccttcagtccttctcccagaggaaggcagaaacacctcaaagcctgcatgtaagaacatctactgagaaattattttaatcagacaccagctgagtgggagaaaggaaaagaacagagaagaacaaacaaaactcccttggtcttggatgtaagagaatccagcagagatggactggagtttcttcagagtagttgcagtgctgttcatttttctggtggtggtagaagttaacagtgaattccgaatccaggtaagagattataacactaaaaatggcaccatcaaatggcattcaatccgaaggcagaaacgtgaatggatcaagttcgcagcagcctgtcgtgaaggtgaagacaactcaaagaggaacccaatcgccaaaattcactcagattgtgctgcaaaccagcaagttacataccgcatctctggagtaggaattgatcagccaccatatgggatctttgtcattaatcagaaaactggtgaaattaatataacatccatagttgatcgagaggtcactcctttcttcattatctactgccgagctctgaactcaatgggccaagatttagagaggcctctagagctcagagtcagggttttggatataaatgacaaccctccagtgttttcaatggctacatttgcaggacaaatagaagaaaattctaatgcaaatacactggtgatgatactcaatgctactgacgcagatgaaccgaacaatttgaactcaaaaatagccttcaagattataagacaagaaccttcagattcaccaatgtttattatcaacagaaatactggagaaattcgaacgatgaataattttctagacagagagcaatacggccagtatgctcttgctgtaagaggctctgaccgagatggtggggcagatggcatgtcagcggaatgtgagtgcaacattaaaatcctcgatgtcaatgataatatcccttacatggaacagtcttcatataccatagaaattcaagaaaatactctaaattcaaatttgctcgagattagagtaattgatttggatgaagagttctcagctaactggatggcagtaattttctttatctctggaaatgaaggaaattggtttgagatagaaatgaatgaaagaacaaatgtgggaattttaaaggttgttaagcccttagattatgaagctatgcagagtctgcaactcagtattggtgtcagaaataaagctgaatttcatcattcaattatgtctcaatataaactgaaagcatctgcaatttctgtgactgtgttaaatgtaattgaaggcccagtgtttcgtccaggttcaaagacatatgttgtaactggtaatatgggatcaaatgataaagtgggagactttgtagctactgacctggacacaggtagaccttcaacgactgttaggtatgtaatgggaaataatccagctgacctgctagctgttgattcaagaacaggcaaactcactttgaaaaataaagttaccaaggaacagtacaatatgctcggaggaaaataccaaggaacgattctctctatagatgataatcttcaaagaacttgcactggtacaattaatattaacattcaaagttttggtaatgacgacaggactaatacagagccgaacactaaaattactaccaatactggcagacaagaaagtacttcttccactaactatgataccagcacaacttctactgactctagccaagtatattcttctgaacccggaaacggagccaaagatttgttatcagacaatgtacattttggtcctgctggcattggactcctcatcatgggattcttggtcttaggattggtcccatttttgatgatctgttgtgattgtggaggtgctcctcgtagtgcagctggctttgagcctgttcccgaatgttcagatggagcaattcattcatgggcagtagaaggaccacagcctgaacccagggatataaccactgtcataccacaaataccacctgataacgcaaatataattgaatgcattgacaactcaggagtttatacaaatgagtatggtggcagagaaatgcaagatctgggaggaggagagagaatgacaggatttgaactaacagagggagttaaaacttcaggaatgcctgagatatgtcaagaatactctggaacattaagaagaaattctatgagggaatgtagagaaggaggtctgaatatgaatttcatggaaagctacttctgtcagaaagcatatgcttacgcagatgaagatgaaggacgcccatctaatgactgtttgctcatatatgacatcgaaggtgtaggttcccctgctggctctgtgggttgttgtagcttcattggagaagacctggatgacagcttcttggataccctgggacctaaatttaagaagttggcagacatcagcctaggaaaagaatcatatccagaccttgatccttcttggccaccacaaagcactgaaccagtttgccttcctcaggaaacagagcccgttgttagtggacacccaccaatctccccacatttcggcactaccacagtaatttctgagagcacctatccctcgggacctggtgtactgcatcctaagcctattctcgatcctctgggctatggtaatgtcactgtgaccgagtcttacaccacctctgacactctgaagccctctgtgcacgttcacgataaccgaccagcatcaaacgtggtagtgacagagagagtggtcggcccaatctctggcgctgatttgcatggaatgttagagatgcctgacttgcgagatgggtcgaatgttatagtgacagaaagggtaatagcaccaagctctagtctacccacctctctgactatccatcatcctagagagtcttcaaatgtggtagtgacagaaagagtaatccaaccaacttccggcatgataggtagtctgagtatgcaccccgagttagccaatgcccacaatgtcattgtgacagagagggttgtttctggtgctggcgtaactggaattagtggcaccactgggatcagcggtggcataggcagcagtggcctggttggcaccagcatgggtgctgggagcggtgccctgagtggagctggcataagtggtggtggcattggcctgagcagcttgggagggacagccagcattggccacatgaggagttcctctgaccatcactttaaccaaaccattgggtccgcctcccctagcacagctcgaagtcgaatcacaaagtatagtaccgtgcaatatagcaagtagtcaggaccccagctcactttttcatagtcattgtggtttagatccaattcccaccactaaaaaactaacaatgtgatttataacgcacaacttcgtgctcaggtcatctaggagcaaggtgagaaatcacaatgagaaaaataaatggaaacaccactgctaggggagagctctccttagcattcataaacttttctcttatattaggactaaggaactaaaacttgaggcagagtcttctttgtgcctgagtggcctgtagtccatctccagcatgtaactggccttacgatggcaattggcatcattctccttgctctgttttgcttttccatatagctcgagcaaaattcaaaaagaactaaatatgcaatatatgttcatatctatgggaaaaatctaaaatgtgtgccagatgccctgttggtttcacagataacataaataaaaattcaaccacagatttatacaagggttaaccattttttttaagtttgactacatagtcaagtccacaagccatcaagcactcctaccttaattattgcactagagaaaataaattccaaattaggaagtgtttcctaggaggaaaattccattagagagtggcaataggatgaggtttcttcagggtaaactagcaatgcctgagcctgaaccttaatgtggggcctcagttaatatccctgtggagtcaaggattcttctgattctagtgtgtgtttagtgatagatgtagtcttgacgaatattgcttactggtgaggttgaggaatatcacactcgtctttccctttaccactgtggttttgacttaagaaagcaaaactcactaagtttacttctcgaattgaagcaagtgaggcctgacatggttgtcatcactagtggcaaatgaccttccaagtaagcagatgggaactgaattgtgttttcaggttttgtttttagtaggtgatattcattcgtatccagctctttattacatagctctgaagttaaaatgatttacataggccgagctgtggacaaaaaaaaagaagcagcagcttgtagtatgcttaagctttggggaatttttttttaaggggatctaaaaaaatgtttttagaacatgtaaaatgtttaatggtgaaagttggaaaa

SEQ ID NO: 59630 - DNA, 3336 bp, Homo sapiens
ttttcttagacattaactgcagacggctggcaggatagaagcagcggctcacttggactttttcaccagggaaatcagagacaatgatggggctcttccccagaactacaggggctctggccatcttcgtggtggtcatattggttcatggagaattgcgaatagagactaaaggtcaatatgatgaagaagagatgactatgcaacaagctaaaagaaggcaaaaacgtgaatgggtgaaatttgccaaaccctgcagagaaggagaagataactcaaaaagaaacccaattgccaagattacttcagattaccaagcaacccagaaaatcacctaccgaatctctggagtgggaatcgatcagccgccttttggaatctttgttgttgacaaaaacactggagatattaacataacagctatagtcgaccgggaggaaactccaagcttcctgatcacatgtcgggctctaaatgcccaaggactagatgtagagaaaccacttatactaacggttaaaattttggatattaatgataatcctccagtattttcacaacaaattttcatgggtgaaattgaagaaaatagtgcctcaaactcactggtgatgatactaaatgccacagatgcagatgaaccaaaccacttgaattctaaaattgccttcaaaattgtctctcaggaaccagcaggcacacccatgttcctcctaagcagaaacactggggaagtccgtactttgaccaattctcttgaccgagagcaagctagcagctatcgtctggttgtgagtggtgcagacaaagatggagaaggactatcaactcaatgtgaatgtaatattaaagtgaaagatgtcaacgataacttcccaatgtttagagactctcagtattcagcacgtattgaagaaaatattttaagttctgaattacttcgatttcaagtaacagatttggatgaagagtacacagataattggcttgcagtatatttctttacctctgggaatgaaggaaattggtttgaaatacaaactgatcctagaactaatgaaggcatcctgaaagtggtgaaggctctagattatgaacaactacaaagcgtgaaacttagtattgctgtcaaaaacaaagctgaatttcaccaatcagttatctctcgataccgagttcagtcaaccccagtcacaattcaggtaataaatgtaagagaaggaattgcattccgtcctgcttccaagacatttactgtgcaaaaaggcataagtagcaaaaaattggtggattatatcctgggaacatatcaagccatcgatgaggacactaacaaagctgcctcaaatgtcaaatatgtcatgggacgtaacgatggtggatacctaatgattgattcaaaaactgctgaaatcaaatttgtcaaaaatatgaaccgagattctactttcatagttaacaaaacaatcacagctgaggttctggccatagatgaatacacgggtaaaacttctacaggcacggtatatgttagagtacccgatttcaatgacaattgtccaacagctgtcctcgaaaaagatgcagtttgcagttcttcaccttccgtggttgtctccgctagaacactgaataatagatacactggcccctatacatttgcactggaagatcaacctgtaaagttgcctgccgtatggagtatcacaaccctcaatgctacctcggccctcctcagagcccaggaacagatacctcctggagtataccacatctccctggtacttacagacagtcagaacaatcggtgtgagatgccacgcagcttgacactggaagtctgtcagtgtgacaacaggggcatctgtggaacttcttacccaaccacaagccctgggaccaggtatggcaggccgcactcagggaggctggggcctgccgccatcggcctgctgctccttggtctcctgctgctgctgttggccccccttctgctgttgacctgtgactgtggggcaggttctactgggggagtgacaggtggttttatcccagttcctgatggctcagaaggaacaattcatcagtggggaattgaaggagcccatcctgaagacaaggaaatcacaaatatttgtgtgcctcctgtaacagccaatggagccgatttcatggaaagttctgaagtttgtacaaatacgtatgccagaggcacagcggtggaaggcacttcaggaatggaaatgaccactaagcttggagcagccactgaatctggaggtgctgcaggctttgcaacagggacagtgtcaggagctgcttcaggattcggagcagccactggagttggcatctgttcctcagggcagtctggaaccatgagaacaaggcattccactggaggaaccaataaggactacgctgatggggcgataagcatgaattttctggactcctacttttctcagaaagcatttgcctgtgcggaggaagacgatggccaggaagcaaatgactgcttgttgatctatgataatgaaggcgcagatgccactggttctcctgtgggctccgtgggttgttgcagttttattgctgatgacctggatgacagcttcttggactcacttggacccaaatttaaaaaacttgcagagataagccttggtgttgatggtgaaggcaaagaagttcagccaccctctaaagacagcggttatgggattgaatcctgtggccatcccatagaagtccagcagacaggatttgttaagtgccagactttgtcaggaagtcaaggagcttctgctttgtccgcctctgggtctgtccagccagctgtttccatccctgaccctctgcagcatggtaactatttagtaacggagacttactcggcttctggttccctcgtgcaaccttccactgcaggctttgatccacttctcacacaaaatgtgatagtgacagaaagggtgatctgtcccatttccagtgttcctggcaacctagctggcccaacgcagctacgagggtcacatactatgctctgtacagaggatccttgctcccgtctaatatgaccagaatgagctggaataccacactgaccaaatctggatctttggactaaagtattcaaaatagcatagcaaagctcactgtattgggctaataatttggcacttattagcttctctcataaactgatcacgattataaattaaatgtttgggttcataccccaaaagcaatatgttgtcactcctaattctcaagtactattcaaattgtagtaaatcttaaagtttttcaaaaccctaaaatcatattcgc

SEQ ID NO: 59631 - DNA, 1347 bp, Homo sapiens
cgccgccgcgcacatgcctaggttcgacgccctcctccctttgcccaggagttccttctgtcccggctctgttccgtctcgccccgaggttcacgccatcctcggagccccagcctttcacccagcgcctccaagctttggaccttgacttctgcaaaactagatggtcacagccatgaatgtctcacatgaagtaaatcagctgttccagccctataacttcgagctgtccaaggacatgaggccctttttcgaggagtattgggcaacctcattccccatagccctgatctacctggttctcatcgctgtggggcagaactacatgaaggaacgcaagggcttcaacctgcaagggcctctcatcctctggtccttctgccttgcaatcttcagtatcctgggggcagtgaggatgtggggcattatggggactgtgctacttaccgggggcctaaagcaaaccgtgtgcttcatcaacttcatcgataattccacagtcaaattctggtcctgggtctttcttctcagcaaggtcatagaactcggagacacagccttcatcatcctgcgtaagcggccactcatctttattcactggtaccaccacagcacagtgctcgtgtacacaagctttggatacaagaacaaagtgcctgcaggaggctggttcgtcaccatgaactttggtgttcatgccatcatgtacacctactacactctgaaggctgccaacgtgaagccccccaagatgctgcccatgctcatcaccagcctgcagatcttgcagatgtttgtaggagccatcgtcagcatcctcacgtacatctggaggcaggatcagggatgccacaccacgatggaacacttattctggtccttcatcttgtatatgacctatttcatcctctttgcccacttcttctgccagacctacatcaggcccaaggtcaaagccaagaccaagagccagtgaaggtttggagagaacaatgaagctccaggctctctcttctccagggcaccaagaggctgggcttagttttgggagaatgattaggttgccttacctgcatggtttccccagaggatgtgtgccccaaggtggctggaatttttgacagacaagaagggtgaccttgggatgggggtgtggtctgttactttaatgtttctgtttttaatgtgaaggccaagcaggccctgggatgggagtggggcggaggagggtcctaagagctgattatttaatttctatccagaaatctttcttcttcttgctctgtttttttaaattaaagatttcaacaaaaaaaaaaaaaaaaaaaaaaaaaaaaaaaaaaaaaa

SEQ ID NO: 59632 - DNA, 12747 bp, Homo sapiens
cttttggtgaacaaggttcacatttattgccaaaagatgtctactctcctggaaaacatctttgccataattaatcttttcaagcaatattcaaaaaaagataaaaacactgacacattgagtaaaaaagagctgaaggaacttctggaaaaggaatttcggcaaatcctgaagaatccagatgacccagatatggttgatgtcttcatggatcacttggatatagaccacaacaagaaaattgacttcactgagtttcttctgatggtattcaagttggctcaagcatattatgagtctaccagaaaagagaatttaccgatatcaggacacaagcacagaaagcacagtcatcatgataaacatgaagataataaacaggaagaaaacaaagaaaacagaaaaagaccctcaagtctggaaagaagaaacaatagaaaagggaataagggaagatccaagagcccaagagaaacaggggggaaaaggcatgaatctagttctgaaaaaaaagaaagaaaaggatattcacctactcatagagaagaagaatatggaaaaaaccatcataactcaagtaaaaaagagaaaaacaagactgaaaatactagattaggagacaataggaagaggctaagtgaaagacttgaagagaaagaagacaatgaagaaggagtatatgattatgaaaatacaggaagaatgactcaaaaatggatacaatcaggccatattgccacatattacacaatccaggatgaagcctatgacaccactgatagtctattagaagaaaacaaaatatatgaaagatcaaggtcatctgatggcaaatcatcatctcaagtgaacaggtcaagacatgaaaatacaagccaggtaccattgcaggagtccaggacaagaaagcgtaggggatccagagttagccaggacagggacagtgagggacactcagaagactctgagaggcactctgggtcggcttccagaaaccatcatggatctgcgtgggagcagtcaagagatggctccagacaccccaggtcccatgatgaagacagagccagtcatgggcactctgcagacagctccagacaatcaggcactcgtcacgcagagacttcctctcgtggacagactgcatcatcccatgaacaggcaagatcaagtccaggagaaagacatggatccggccaccagcagtcagcagacagctccagacactcagccactgggcgcgggcaagcttcatctgcagtcagcgatcgtggacaccgggggtctagcggtagtcaggccagtgacagtgagggacattcagaaaactcagacacacaatcagtgtcaggccacggaaaggctgggctgagacagcagagccaccaagagtccacacgtggccggtcaggggaacggtctggacgttcagggtcttccctctaccaggtgagcactcatgaacagcctgactctgcccatggacggaccgggaccagcactggaggaagacaaggatcgcaccacgagcaggcacgagacagctccaggcattcagcgtcccaagagggtcaggacaccattcgtggacacccggggtcaagcagaggaggaaggcagggatcccaccacgagcaatcggtaaataggtctggacactcaggttcccatcacagccacaccacatcccagggaaggtctgatgcctcccatgggcagtcaggatccagaagtgcaagcagacaaacacgaaatgaggaacaatcaggagacggcaccaggcactcagggtcacgtcatcatgaagcttcctctcaggctgacagctctagacactcacaggtgggccagggacaatcatcggggcccaggacaagtaggaaccagggatccagtgttagccaggacagtgacagtcagggacactcagaagactctgagaggtggtctgggtctgcttccagaaaccatcatggatctgctcaggagcagtcaagagatggctccagacaccccaggtcccatcacgaagacagagctggtcatgggcactctgcagacagctccagaaaatcaggcactcgtcacacacagaattcctctagtggacaggctgcgtcatcccatgaacaggcaagatcaagtgcaggagaaagacatggatcccgccaccagctccagtcagcagacagctccagacactcaggcactgggcacggacaagcttcatctgcagtcagagacagtggacaccgagggtccagtggtagtcaggccactgacagtgagggacattcagaagactcagacacacagtcagtgtcaggccatggacaggctggtcaccatcagcagagccaccaagagtccgcacgtgaccggtcaggggaaaggtctcgacgttcagggtctttcctctaccaggtgagcactcataaacagtctgagtcctcccatggatggacagggcccagcactggagtaagacaaggatcccaccatgagcaggcacgagacaactccaggcactcagcatcccaagatggtcaggacaccattcgtggacacccggggtcaagcagaagaggaaggcaggggtcccaccacgagcaatcggtagataggtctggacactcagggtcccatcacagccacaccacatcccagggaaggtctgatgcctcccgtgggcagtcaggatccagaagtgcaagcagaacaacacgtaatgaggaacaatcaagagacggctccaggcactcagggtcacgtcaccatgaagcttcctctcatgccgacatctctagacactcacaggcaggccagggacaatcagaggggtccaggacaagcaggcgccagggatccagtgttagccaggacagtgacagtgagggacattcagaagactctgagaggtggtctgggtctgcttccagaaaccatcgtggatctgctcaggagcagtcaagacatggctccagacaccccaggtcccatcacgaagacagagccggtcacgggcactctgcagacagctccagacaatcaggaactcctcacgcagagacttcctctggtggacaggctgcgtcatcccatgaacaggcaagatcaagtccaggagaaagacacggatcccgccaccagcagtcagcagacagctccagacactcaggcattccgcgcagacaagcttcatctgcagtcagagacagtggacactgggggtccagtggtagtcaggccagtgatagtgagggacattcagaggagtcagacacacagtcagtgtcaggccatggacaggatgggccccatcagcagagccaccaagagtccgcacgtgactggtcagggggaaggtctggacgttcagggtctttcatctaccaggtgagcactcatgaacagtctgagtctgcccatgggcggaccaggaccagcactggacgaagacaaggatcccaccacgagcaggcacgagacagctccaggcactcagcgtcccaagagggtcaggacaccattcgtgcacacccggggtcaaggagaggaggaaggcagggatcccaccatgagcaatcggtagatagatctggacactcagggtcccatcacagccacaccacatcccagggaaggtctgatgcctcccatgggcagtcaggatccagaagtgcaagcagacaaactcgtaaggacaaacaatcaggagacggctccaggcactcagggtcacgtcaccatgaagctgcctcttgggctgacagctctagacactcacaggtgggacaggaacaatcatcggggtccaggacaagcaggcaccagggatccagtgttagccaggacagtgacagtgagagacactcagacgactccgagaggttgtctgggtctgcttccagaaaccatcatggatcttctcgggagcagtcaagagatggctccagacaccctgggttccatcaagaagacagagccagtcacgggcactctgcagacagctccagacaatcaggcactcatcacacagagtcttcctctcatggacaggctgtgtcatcccatgaacaggcaagatcaagtccaggagaaagacatggatcccgccaccagcagtcagcagacagctccagacactcaggcattgggcacagacaagcttcatctgcagtcagagacagtggacaccgagggtccagtggtagtcaggtcactaacagtgagggacattcagaagactcagacacacagtcagtgtcagcccacggacaagctgggccccatcagcagagccacaaagagtccgcacgtggccagtcaggggaaagctctggacgttcaaggtctttcctctaccaggtgagctctcatgaacagtctgagtccacacacggacagactgcacccagcactggaggaagacaaggatcccgccatgagcaggcacgaaacagctctaggcactcagcatcccaagacggtcaggacaccattcgtggacacccggggtcaagcagaggaggaaggcagggatcctaccacgagcaatcagtagataggtctggacactcagggtaccatcacagccacaccacaccccagggaaggtctgatgcctcccatgggcagtcaggacccagaagtgcaagcaggcaaacaagaaatgaggaacaatcaggagacggctccaggcactcagggtcacgtcaccatgaaccttccactcgggccggcagctctagacactcacaggtgggccagggagaatcagcggggtccaagacaagcaggcgccagggatccagtgttagtcaggacagggacagtgagggacactcagaagactctgagaggcggtctgagtcggcttccagaaaccattatggatctgctcgggagcagtcaagacatggctccaggaaccccaggtcccatcaagaagatagagccagtcatgggcactctgcagagagctccagacaatcaggcactcgtcatgcagagacttcctctggtggacaggctgcatcatcccaggaacaggcaaggtcaagtccaggagaaagacatggatcccgccaccagcagtcagcagacagctccacagactcaggcactgggcgcagacaagattcatctgtagtcggagacagtggaaaccgagggtccagtggtagccaggccagtgacagcgagggacactcagaagagtcagacacacagtcagtgtcagcccacggacaggctgggccccatcagcagagccaccaagagtccacacgtggccagtcaggggaaaggtctggacgttcagggtctttcctctaccaggtgagcactcatgaacagtctgagtccgcccatggacgcacagggcccagcactggaggaagacaaagatcccgccacgagcaggcacgagacagctccaggcactcagcgtcccaagagggtcaggacaccattcgtggacacccagggtcaagcagaggaggaaggcagggatcccactatgagcaatcggtagatagttctggacactcagggtctcatcacagccacaccacgtcccaggaaaggtctgatgtctcccgtgggcagtcaggatccagaagtgtcagcagacaaacacgtaatgagaaacaatcaggagacggctccaggcactcagggtcgcgtcaccatgaagcttcctctcgggccgacagctctagacactcgcaggtgggccagggacaatcatcagggcccaggacaagcaggaaccagggatccagtgttagccaggacagtgacagtcagggacactcagaagactctgagaggtggtctgggtctgcttccagaaaccatcttggatctgcttgggagcagtcaagagatggctccagacaccctgggtcccatcacgaagacagagccggtcacgggcactctgcagacagctccagacaatcaggcactcgtcacacagagtcttcctctcgtggacaggctgcgtcatcccatgaacaggcaagatcaagtgcaggagaaagacatggatcccaccaccagctccagtcagcagacagctccagacactcaggcattgggcatggacaagcttcatctgcagtcagagacagtggacaccgagggtacagtggtagtcaggccagtgacagtgagggacattcagaagactcagacacacagtcagtgtcagcacagggaaaagctgggccccatcagcagagccacaaagagtccgcacgtggccagtcaggggaaagctctggacgttcagggtctttcctctaccaggtgagcactcatgaacagtctgagtccacccatggacagtctgcgcccagcactggaggaagacaaggatcccattatgatcaggcacaagacagctccaggcactcagcatcccaagagggtcaggacaccattcgtggacacccggggccaagcagaggaggaagacaggggtcccaccaagagcaatcggtagataggtctggacactcagggtctcatcacagccacaccacatcccagggaaggtctgatgcctcccgtgggcagtcaggatccagaagtgcaagcagaaaaacatatgacaaggaacaatcaggagatggctctaggcactcagggtcgcatcatcatgaagcttcctcttgggccgacagctctagacactcactggtgggccagggacaatcatcagggcccaggacaagcaggccccggggatccagtgttagccaggacagtgacagtgagggacactcagaagattctgagaggcggtctgggtctgcgtccagaaaccatcatggatctgctcaggagcagtcaagagatggctccagacaccccaggtcccatcacgaagacagagccggtcatgggcactctgcagagagctccagacaatcaggcactcatcatgcagagaattcctctggtggacaggctgcatcatcccatgaacaggcaagatcaagtgcaggagagagacacggatcccaccaccagcagtcagcagacagctccagacactcaggcattgggcacggacaagcttcatctgcagtcagagacagtggacaccgagggtccagtggtagtcaggccagtgacagtgagggacattcagaagactcagacacacagtcagtgtcagcccacggacaggctgggccccatcagcagagccaccaagagtccacacgtggccggtcagcaggaaggtctggacgttcagggtctttcctctaccaggtgagcactcatgaacagtctgagtccgcccatggacggaccgggaccagcactggaggaagacaaggatcccaccacaagcaggcacgagacagctccaggcactcaacgtcccaagagggtcaggacaccattcatggacacccggggtcaagcagtggaggaaggcagggatcccactacgagcaattggtagatagatctggacactcagggtctcatcacagccacaccacatcccagggaaggtctgatgcctcccatgggcactcaggatccagaagtgcaagcagacaaactcgtaacgatgaacaatcaggagacggctccaggcactcagggtcgcgtcaccatgaagcttcctctcgggccgacagctctggacactcgcaggtgggccagggacaatcagaggggcccaggacaagcaggaactggggatccagttttagccaggacagtgacagtcagggacactcagaagactctgagaggtggtctgggtctgcttccagaaaccatcatggatctgctcaggagcagctaagagatggctccagacaccccaggtcccatcaagaagacagagctggtcatgggcactctgcagacagctccagacaatcaggcactcgtcacacacagacttcctctggtggacaggctgcatcatcccatgaacaggcaagatcaagtgcaggagaaagacatggatcccaccaccagcagtcagcagacagctccagacactcaggcattgggcacggacaagcttcatctgcagtcagagacagtggacaccgagggtacagtggtagtcaggccagtgacaatgagggacattcagaagactcagacacacagtcagtgtcagcccacggacaggctgggtcccatcagcagagccaccaagagtccgcacgtggccggtcaggggaaacgtctggacattcaggatctttcctctaccaggtgagcactcatgaacagtctgagtcctcccatggatggacggggcccagcactagaggaagacaaggatcccgccatgagcaggcacaagacagctccaggcactcagcatcccaagacggtcaggacaccattcgtggacacccggggtcaagcagaggaggaaggcaggggtaccaccacgagcattcggtagatagctctggacactcagggtcccatcacagccacaccacatcccagggaaggtctgatgcctcccgtgggcagtcaggatccagaagtgcaagcagaacaacacgtaatgaggaacaatcaggagacggctccaggcactcagggtcgcgtcaccatgaagcttccactcatgccgacatctctagacactcacaggcagtccagggacaatcagaggggtccaggagaagcaggcgccagggatccagtgtgagccaggacagtgacagtgagggacattcagaagactctgagaggtggtctgggtctgcttccagaaaccatcatggatctgctcaggagcagctaagagatggctccagacaccccaggtcccatcaagaagacagagctggtcatgggcactctgcagacagctccagacaatcaggcactcgtcacacacagacttcctctggtggacaggctgcatcatcccatgaacaggcaagatcaagtgcaggagaaagacatggatcccaccaccagcagtcagcagacagctccagacactcaggcattgggcacggacaagcttcatctgcagtcagagacagtggacaccgagggtacagtggtagtcaggccagtgacaatgagggacattcagaagactcagacacacagtcagtgtcagcccacggacaggctgggtcccatcagcagagccaccaagagtccgcacgtggccggtcaggggaaacgtctggacattcaggatctttcctctaccaggtgagcactcatgaacagtctgagtcctcccatggatggacggggcccagcactagaggaagacaaggatcccgccatgagcaggcacaagacagctccaggcactcagcatcccaatacggtcaggacaccattcgtggacacccggggtcaagcagaggaggaaggcaggggtaccaccacgagcattcggtagatagctctggacactcagggtcccatcacagccacaccacatcccagggaaggtctgatgcctcccgtgggcagtcaggatccagaagtgcaagcagaacaacacgtaatgaggaacaatcaggagacagctccaggcactcagtgtcacgtcaccatgaagcttccactcatgccgacatctctagacactcacaggcagtccagggacaatcagaggggtccaggagaagcaggcgccagggatccagtgtgagccaggacagtgacagtgagggacattcagaagactctgagaggtggtctgggtctgcttccagaaaccatcgtggatctgttcaggagcagtcaaggcacggctccagacaccccaggtcccatcacgaagacagagccggtcacgggcactctgcagaccgctccagacaatcaggcactcgtcacgcagagacttcctctggtggacaggctgcatcatcccatgaacaggcaagatcaagtccaggagagagacacggatcccgccaccagcagtcagcagacagctccagacactcaggcattccgcgtggacaagcttcatctgcagtcagagacagtagacactgggggtccagtggtagtcaggccagtgatagtgagggacattcagaagagtcagacacacagtcagtgtcaggccatggacaggctgggccccatcagcagagccaccaagagtccgcacgtgaccggtcagggggaaggtctggacgttcagggtctttcctctaccaggtgagcactcatgaacagtctgagtctgcccatgggcggaccaggaccagcactggacgaagacaaggatcccaccacgagcaggcacgagacagctccaggcactcagcgtcccaagagggtcaggacaccattcgtggacacccggggtcaagcagaagaggaaggcagggatcccactacgagcaatcggtagataggtctggacactcagggtcccatcacagccacaccacatcccagggaaggtctgatgcctcccgtgggcagtcaggatccagaagtgccagcagacaaactcgtaatgacgaacaatcaggagatggctccaggcactcatggtcgcatcaccatgaagcttccactcaggcggacagctctagacactcacagtccggccagggacaatcagcggggcccaggacaagcaggaaccagggatccagtgttagccaggacagtgacagtcagggacactcagaagactctgagaggtggtctgggtctgcttccagaaaccatcgtggatctgctcaggagcagtcaagagatggctccagacaccccacgtcccatcacgaagacagagccggtcacgggcactctgcagagagctccagacaatcaggcactcatcatgcagagaattcctctggtggacaggctgcatcatcccatgaacaggcaagatcaagtgcaggagagagacatggatcccaccaccagcagtcagcagacagctccagacactcaggcattgggcacggacaagcttcatctgcagtcagagacagtggacaccgagggtccagtggtagtcaggccagtgacagtgagggacattcagaagactcagacacacagtcagtgtcagcccacggacaggctgggccccatcagcagagccaccaagagtccacacgtggccggtcagcaggaaggtctggacgttcagggtctttcctctaccaggtgagcactcatgaacagtctgagtctgcccatggacgggctgggcccagtactggaggaagacaaggatcccgccacgagcaggcacgagacagctccaggcactcagcgtcccaagagggtcaggacaccattcgtggacacccggggtcaaggagaggaggaagacagggatcctaccacgagcaatcggtagataggtctggacactcagggtcccatcacagccacaccacatcccagggaaggtctgatgcctcccatgggcagtcaggatccagaagtgcaagcagagaaacacgtaatgaggaacagtcaggagacggctccaggcactcagggtcgcgtcaccatgaagcttccactcaggctgacagctctagacactcacagtccggccagggtgaatcagcggggtccaggagaagcaggcgccagggatccagtgttagccaggacagtgacagtgaggcatacccagaggactctgagaggcgatctgagtctgcttccagaaaccatcatggatcttctcgggagcagtcaagagatggctccagacaccccggatcctctcaccgcgatacagccagtcatgtacagtcttcacctgtacagtcagactctagtaccgctaaggaacatggtcactttagtagtctttcacaagattctgcgtatcactcaggaatacagtcacgtggcagtcctcacagttctagttcttatcattatcaatctgagggcactgaaaggcaaaaaggtcaatcaggtttagtttggagacatggcagctatggtagtgcagattatgattatggtgaatccgggtttagacactctcagcacggaagtgttagttacaattccaatcctgttgttttcaaggaaagatctgatatctgtaaagcaagtgcgtttggtaaagatcatccaaggtattatgcaacgtatattaataaggacccaggtttatgtggccattctagtgatatatcgaaacaactgggatttagtcagtcacagagatactattactatgagtaagaaattaatggcaaaggaattaatccaagaatagaagaatgaagcaagttcactttcaatcaagaaacttcataatactttcagggaagttatcttttcctgtcaatctgtttaaaatatgctatagtatttcattagtttggtggtagcttatttttattgtgtaatgatctttaaacgctatatttcagaaatattaaatggaagaaatcaatatcatggagagctaactttagaaaactagctggagtattttaggagattctgggtcaagtaatgttttatgtttttgaaagtttaagttttagacactccccaaatttctaaattaatctttttcagaaatatcgaaggagccaaaaatataaaacagttctgtataccaaagtggctatatcaacatcagggctagcacatctttctctattatccttctattggaattctagtattctgtattcaaaaaatcatcttggacataattaatattatagtaagctgcatctaaattaaaaataaactatt

SEQ ID NO: 59633 - DNA, 3159 bp, Homo sapiens
acagtttcacccagcaagcgtgagaacaggtactgcttcctgagcaccgccagccaccggcaccaagaccggccacatcccagcactgcccacctctgctcccagccgccagatgacggaggctctcgccagaccctcagcacgcagagctggcttctgatagaagtgctcgggaaagaaagcaaagcgggaggtgcctctttagaaaccacgaagtgcacgcggcgtcgacagtgatcacgccacctggacagccagagtccaaggcataaggaggaaaatgagtctcctcaaagagcggaagccaaaaaagccacattacatccccaggcctccaggaaagcccttcaagtataaatgtttccaatgtccctttacttgcaatgagaagtcacatctttttaatcacatgaagtatggtctttgtaaaaactcgattactttagtatcagagcaggatcgagttcccaagtgccctaaatctaactcactagaccccaagcaaaccaaccagcccgatgccacggcgaagccagcctcttccaagtctgtcgcaaatggactctctgccttcgactcgaagcttcagcacagctctgccagggaagacatcaaggaaaacctggagctgcaagcccggggaacccacaggtgcctgggacagaagccagccctccacagggcatcaccctgcaagagcccagctccggaagccgccctcggtgcccagcctgctctggaaggcgcagctcggccttctgcatttgttccagtcggcgagcacagactcaaggggccagacaacgccgagccgcccgagacactggctttacacaaccccactgccaaggccgtgtctttccacaccaagtcggccttccacactcctggctacccctggaaagccggctcacctttccttccaccagagtttccacataaaatctcatctacaaaggggcttggggccatttccccttacatgcaccccacaatcccagagtacccgcctcacttttacacagagcacgggctggccaccatctactcgccttacctgctggctgggagctcgcctgagtgtgacgcacccctgctgtcagtctacggaacccaagacccgagacacttcctgcctcacccggggccgatccctaagcacctggctccatctccagccacatacgatcactacaggtttttccagcaatatccctctaacctgccgattccttacggattttacaggccagagtctgcattttcctcctatggtctcagactcccacctgtcactggcctcacccgagatcagagctctcacctgcttgaagaagccaccctggtctatccagcctcgagtccttccaggttaaacccttcggaccccaacagaaaacacgtcgagttcgaaagtccaattcctgaggctaaagactcctccaaggctgggcagagagacacggaagggtccaaaatgagcccccgcgcagggagtgcagccacgggctccccagggaggccgagccccaccgacttcatgcagacgagccagacctgcgaaggcctgtacgacctctccaacaaggcagcctccagcgcactgggaagactctacccgccagagcaaagcctcacagccttcaggcctgttaagaaaagcacagaatgcctacctgcccaggctgctgagaccacagcagagtctccagtaagcctcaatgttgtgaacggagaccctcctgctccgaccggaagcgcctctctcgtctcggaggccgcgccttccagtccggacgacagctccgggatgggccccctcaacctctccaagaaatcagagataaacctggcagccacccacgaacccacgtaccaaggcagcccccaggcggaaaccgccagcttctcagagctgcaggaccttccactcaatctctcggtgaaggacccctgtaacacccaggctccgaggcccgccttccccggtcgaccacgagctgcggaacctgctgctgctgttccacagaagactgggacagaaggttctgaggatgggcccagccaccctgagaccaagccaggcagcctcgacggtgacggggccccacccacaggccccggcgaggaggctccagacgcatgcgcggtggacagcagcgaggagcagaagcagacggcagccgtggccctgtgccagctggcggcctacagccccaggaacatccgggtgggcgatggggatgctgcggccccggaacctgcctgccggcaagacacacccacactgagctccatggagagccaagaggcccagtgtgacctcagacccaaaggacaaaagaggacaagtctaagggatgctggaaaatcccagcaaggagctaagaaggcgaagctgcaggacacggccagagtgttcacactacgaaggagggcccgggtgtcctaacgccgggttcacacgtgtgttcacagagctacggccacacacacgccttccaaggtggcaagctacaacacctctgaactggcactttcacatttttacaaatgcagctgctgcttctcaaaaaaacaaacaaacaaacaaacaaaaaaccctccaattcagtttttataaatattaagcatgaatattaaaaggtgcttctacttttggttgtaaaaacacctgaatgactctaagactgatatgtattttcaagtctaagctgtcttacagaagatcttttataaatgtttccttataaatatctcaccattacaacaaattgttttaactgtttttctattagctctagctgcatatttgatgtaaatgacaattactgaaaaaatgtcagaaaaaacattttcagtactaacattaaagtgccatatgtaaaaaagaaaaatgtgatttgtataactaaataacacacaaacatcaagaggctatttatacaaataatttatttccactagggaaagtgcattactggtgaaggtattatcaatttattctacttgcttataatgttacagtgaatgttctggcttactctgcctcactttccattccccaaaatgatgtgtatgttgctaattttccaataaactcatatgaaccataaggaaacataaaatgcaaataaacataaatctatgttatccttt

SEQ ID NO: 59634 - DNA, 2168 bp, Homo sapiens
gcagcagttgagtccatgtaagatgattgtgcacgtgtgtgtgtgtgtgtgtgtgtgtgtgtcctcactcacttaaaaaagaccatttctgtgcattctttatgctggaaccctcctctgcctccctctccaggaaatcccataggatcccatacctgctttagaatgtgtgtgagacacttcccagtgcctggcatgtggtaggagctcagtacatgtaaactgttttcctttgaccactcaaagtagtcacttgttggggaggccaatggcggcttccccggtctctgagctgatgggcgtctggtccctgcctccccttccttcactggctgatgacaaatacctgaatgtcatcacatcctccgtgtcctcatctgttattctggaacacaggccagggagggtacagggtagtcccccttcaacagaggctggcctttcttgggatgtgggctggctggtgttggtccaaggatggatgcagagggtgaggcacccatcctgctagtccggccggatgctggcaggagggcggggtgaggaggggcggagcttccagaacaaaggagaatggggagcccaggggccagcctaggcatcaaaaaggctctgcagagtgaacaggccacagcactgcctgcctctgccccagcagtcagccagccgaccgcgcctgctccctcctgcttgcccaaggccgggcaagtcatccccgctctgcttcgagaggccccgttttccagcgtgattgcgccgacactgctctgtgggtttctcttcttggcgtgggttgctgctgaggttccagaggagagcagcaggatggccgggagcggagccaggagtgaggaaggccgccggcagcatgccttcgtcccggaaccttttgatggggccaatgtcgtcccaaacctctggctgcacagctttgaagtcatcaatgacctcaaccattgggaccatatcaccaagctaaggttcctgaaagagtccctcagaggagaggccctgggtgtctacaataggctcagtccccaggaccagggagactatgggactgtgaaagaggccctcctgaaggcctttggggtccctggggctgcccccagccacctgcccaaagagatcgtctttgccaacagcatgggtaagggctactatctcaaggggaagattggcaaagtgcccgtgaggttcctggtggactctggggcccaggtctctgtggtccacccaaacttgtgggaggaggtcactgatggcgatctggacaccctgcagccctttgagaatgtggtaaaggtggccaatggtgctgaaatgaagatcctgggtgtctgggatacagcggtgtccctaggcaagctgaagctgaaggcacagttcctagtggccaatgcgagtgccgaggaagccatcattggcactgatgtgctccaggaccacaatgctatcctggactttgagcaccgcacatgcaccctgaaagggaagaagtttcgccttctgcctgtgggagggtccctggaagatgagtttgacctggagctcatagaggaggacccctcctcagaagaagggcggcaggagctatcccactgagaagccaccttttctttaacctcctaaatattggtgggaagacccaccgctgtggggggggttgcatatcctcatgggggtcactgggcttggccagtctgcttatcaactcttgctcttctctcccctttgcctccctctgcaggggccttaatctgcccctggtaggggaggcttccactgaacaggcacaggtgagggagagcaggctggcttagagggacagggtccccatggtcatcaagctgctgttgatgacaaagactcaaaggctggaagagctcccaaggaagctagaaatgcttgtctttgaaagaactgtgggaccccttcagattccctgaggtatggcttggtcactctcaggtcctcaaagcctgtcttagttgggctgggtcctagctgcagggtctttgtgagggtcacagttgctctgggacacctccctgaagagcctttccacctgtacaatcgtattttctttctgtcatttgctttgaagcccattgtgccttatgccaataattcaattgctgcaaacaccaataaagattgattcatgg

SEQ ID NO: 59635 - DNA, 2056 bp, Homo sapiens
aaagttacattttctctggaactctcctaggccactccctgctgatgcaacatctgggtttgggcagaaaggagggtgcttcggagcccgccctttctgagcttcctgggccggctctagaacaattcaggcttcgctgcgactcagacctcagctccaacatatgcattctgaagaaagatggctgagatggacagaatgctttattttggaaagaaacaatgttctaggtcaaactgagtctaccaaatgcagactttcacaatggttctagaagaaatctggacaagtcttttcatgtggtttttctacgcattgattccatgtttgctcacagatgaagtggccattctgcctgcccctcagaacctctctgtactctcaaccaacatgaagcatctcttgatgtggagcccagtgatcgcgcctggagaaacagtgtactattctgtcgaataccagggggagtacgagagcctgtacacgagccacatctggatccccagcagctggtgctcactcactgaaggtcctgagtgtgatgtcactgatgacatcacggccactgtgccatacaaccttcgtgtcagggccacattgggctcacagacctcagcctggagcatcctgaagcatccctttaatagaaactcaaccatccttacccgacctgggatggagatcaccaaagatggcttccacctggttattgagctggaggacctggggccccagtttgagttccttgtggcctactggaggagggagcctggtgccgaggaacatgtcaaaatggtgaggagtgggggtattccagtgcacctagaaaccatggagccaggggctgcatactgtgtgaaggcccagacattcgtgaaggccattgggaggtacagcgccttcagccagacagaatgtgtggaggtgcaaggagaggccattcccctggtactggccctgtttgcctttgttggcttcatgctgatccttgtggtcgtgccactgttcgtctggaaaatgggccggctgctccagtactcctgttgccccgtggtggtcctcccagacaccttgaaaataaccaattcaccccagaagttaatcagctgcagaagggaggaggtggatgcctgtgccacggctgtgatgtctcctgaggaactcctcagggcctggatctcataggtttgcggaagggcccaggtgaagccgagaacctggtctgcatgacatggaaaccatgaggggacaagttgtgtttctgttttccgccacggacaagggatgagagaagtaggaagagcctgttgtctacaagtctagaagcaaccatcagaggcagggtggtttgtctaacagaacactgactgaggcttaggggatgtgacctctagactgggggctgccacttgctggctgagcaaccctgggaaaagtgacttcatcccttcggtcctaagttttctcatctgtaatgggggaattacctacacacctgctaaacacacacacacagagtctctctctatatatacacacgtacacataaatacacccagcacttgcaaggctagagggaaactggtgacactctacagtctgactgattcagtgtttctggagagcaggacataaatgtatgatgagaatgatcaaggactctacacactgggtggcttggagagcccactttcccagaataatccttgagagaaaaggaatcatgggagcaatggtgttgagttcacttcaagcccaatgccggtgcagaggggaatggcttagcgagctctacagtaggtgacctggaggaaggtcacagccacactgaaaatgggatgtgcatgaacacggaggatccatgaactactgtaaagtgttgacagtgtgtgcacactgcagacagcaggtgaaatgtatgtgtgcaatgcgacgagaatgcagaagtcagtaacatgtgcatgtttgttgtgctccttttttctgttggtaaagtacagaattcagcaaataaaaagggccaccctggccaaaagcggtaaaaaaaaaaaaaaaa

SEQ ID NO: 59636 - DNA, 1777 bp, Homo sapiens
aggagggagctgcaccctggtgggcagccatgggagtgtgtcaggtggaagcagccgtcagggtccctctctgctctctgtccggacagacagggctccaaccttcacttcagttcttgtgaactcccaccaggtaggcacggcccccaccaggcgccatggactggaagacactccaggccctactgagcggtgtgaacaagtactccacagcgttcgggcgcatctggctgtccgtggtgttcgtcttccgggtgctggtatacgtggtggctgcagagcgcgtgtggggggatgagcagaaggactttgactgcaacaccaagcagcccggctgcaccaacgtctgctacgacaactacttccccatctccaacatccgcctctgggccctgcagctcatcttcgtcacatgcccctcgctgctggtcatcctgcacgtggcctaccgtgaggagcgggagcgccggcaccgccagaaacacggggaccagtgcgccaagctgtacgacaacgcaggcaagaagcacggaggcctgtggtggacctacctgttcagcctcatcttcaagctcatcattgagttcctcttcctctacctgctgcacactctctggcatggcttcaatatgccgcgcctggtgcagtgtgccaacgtggccccctgccccaacatcgtggactgctacattgcccgacctaccgagaagaaaatcttcacctacttcatggtgggcgcctccgccgtctgcatcgtactcaccatctgtgagctctgctacctcatctgccacagggtcctgcgaggcctgcacaaggacaagcctcgagggggttgcagcccctcgtcctccgccagccgagcttccacctgccgctgccaccacaagctggtggaggctggggaggtggatccagacccaggcaataacaagctgcaggcttcagcacccaacctgacccccatctgaccacagggcaggggtggggcaacatgcgggctgccaatgggacatgcagggcggtgtggcaggtggagaggtcctacaggggctgagtgaccccactctgagttcactaagttatgcaactttcgttttggcagatattttttgacactgggaactgggctgtctagccgggtataggtaacccacaggcccagtgccagccctcaaaggacatagactttgaaacaagcgaattaactatctacgctgcctgcaaggggccacttagggcactgctagcagggcttcaaccaggaagggatcaacccaggaagggatgatcaggagaggcttccctgaggacataatgtgtaagagaggtgagaagtgctcccaagcagacacaacagcagcacagaggtctggaggccacacaaaaagtgatgctcgccctgggctagcctcagcagacctaaggcatctctactccctccagaggagccgcccagattcctgcagtggagaggaggtcttccagcagcagcaggtctggagggctgagaatgaacctgactagaggttctggagatacccagaggtcccccaggtcatcacttggctcagtggaagccctctttccccaaatcctactccctcagcctcaggcagtggtgctcccatcttcctccccacaactgtgctcaggctggtgccagcctttcagaccctgctcccagggacttgggtggatgcgctgatagaacatcctcaagacagtttccttgaaatcaataaatactgtgttttatacaaaaaaaaaaaaaaaa

SEQ ID NO: 59637 - DNA, 2220 bp, Homo sapiens
gaacttctttcctggcacaggactcactgtgccccttcccgctgtgggtacaaggtctgccccccaccccagctctccaaagcccaccggcctccctggaggccgaggtcgacggcccgtcgcaccgggagggggggctcccaggggtgccccacgcacggtcaaggtcccgcgccaagcggggaccgggctgggccggaagcgggcacggtactcgcggcaaactagcgtgggcgagtcctgattgcagtcggacctgccgccgcggcacttaacagtttgcagagtgcttcccgcccctgatctcattggagccttcggacagcccagcccatggccaccgatgcccccatttcacgcctgaggaagcggaggctcagacgggccaccagcccctccggaggctggcccgggagcgcctggcagcgtcgggtctaggagccggctccctcctgctccctcctccgcgccgcccggggtgtgcccgccgtctgtgtgcaccactgctgagcccagctccggcgccctcgcctctgctgtgggccccggggacgcggggtcaggccaccgcgttggccaggccgctgcaggtaggcacggcccccaccaggcgccatggactggaagacactccaggccctactgagcggtgtgaacaagtactccacagcgttcgggcgcatctggctgtccgtggtgttcgtcttccgggtgctggtatacgtggtggctgcagagcgcgtgtggggggatgagcagaaggactttgactgcaacaccaagcagcccggctgcaccaacgtctgctacgacaactacttccccatctccaacatccgcctctgggccctgcagctcatcttcgtcacatgcccctcgctgctggtcatcctgcacgtggcctaccgtgaggagcgggagcgccggcaccgccagaaacacggggaccagtgcgccaagctgtacgacaacgcaggcaagaagcacggaggcctgtggtggacctacctgttcagcctcatcttcaagctcatcattgagttcctcttcctctacctgctgcacactctctggcatggcttcaatatgccgcgcctggtgcagtgtgccaacgtggccccctgccccaacatcgtggactgctacattgcccgacctaccgagaagaaaatcttcacctacttcatggtgggcgcctccgccgtctgcatcgtactcaccatctgtgagctctgctacctcatctgccacagggtcctgcgaggcctgcacaaggacaagcctcgagggggttgcagcccctcgtcctccgccagccgagcttccacctgccgctgccaccacaagctggtggaggctggggaggtggatccagacccaggcaataacaagctgcaggcttcagcacccaacctgacccccatctgaccacagggcaggggtggggcaacatgcgggctgccaatgggacatgcagggcggtgtggcaggtggagaggtcctacaggggctgagtgaccccactctgagttcactaagttatgcaactttcgttttggcagatattttttgacactgggaactgggctgtctagccgggtataggtaacccacaggcccagtgccagccctcaaaggacatagactttgaaacaagcgaattaactatctacgctgcctgcaaggggccacttagggcactgctagcagggcttcaaccaggaagggatcaacccaggaagggatgatcaggagaggcttccctgaggacataatgtgtaagagaggtgagaagtgctcccaagcagacacaacagcagcacagaggtctggaggccacacaaaaagtgatgctcgccctgggctagcctcagcagacctaaggcatctctactccctccagaggagccgcccagattcctgcagtggagaggaggtcttccagcagcagcaggtctggagggctgagaatgaacctgactagaggttctggagatacccagaggtcccccaggtcatcacttggctcagtggaagccctctttccccaaatcctactccctcagcctcaggcagtggtgctcccatcttcctccccacaactgtgctcaggctggtgccagcctttcagaccctgctcccagggacttgggtggatgcgctgatagaacatcctcaagacagtttccttgaaatcaataaatactgtgttttataaaa

SEQ ID NO: 59638 - DNA, 6175 bp, Homo sapiens
atggcccagccttttccacccaaagacctgttactgaattttgtctccatgtgtctgaagggtacttccccatcatcattttcattcatcctaagaaaggcggctccctgtgtggaggtggtggccgcgaacattttggctgaactgagcagtcaaccttctcatttttgctggaaggatttgagagaatatgggggagatggtacacgagccagtggaggattagtggggttttatgttgttgtgatgaactttatgatcaacgcccccatcgagcttgctttgcttacgcaaggcctcagcctttgcctcttccccaaacccaagctacctgaggaggaggagctgagtgagggggagggaccaacagatttgtcccctgtgcaggctgcctgcctgcttgagttacatccacaaatgcctcggaagcagccagctggctgcatctttctcctcacattcctgggtctgtctgggctggttggcacagttaccagaacgtactacattgggattgtggaagaatactggaactatgtaccccaagggaagaatgttattactgggaaaagtttcacagaagacaaacttgcaaccttatttctcgaaagagggcccaacaggataggcagtatttacaaaaaggctgtttacagacgcttcacggatggaacctactccatagagatccccaaacctccctggcttggattcctgggccccatcttgagggccgaagtgggtgatgtgattgtcattcatttaaagaactttgcttctcgaccttactctctgcatccacatggcgttttctacaacaaagattcagaaggagccctatacccagatggaacatctggaaggaacaaaaatgatgacatggttcctcctgggaaaaactacacctacgtctggccggtgagagaagaatatgcacctactccagccgatgccaactgcctgacctgggtgtaccattcgcacatcgacgccccaaaggacatctgctctgggctaattgggcccctgctggtctgcaaggaaggtatcctgaatagatattcagggacacggaatgatgtggatcgagagtttgttataatgtttactcttgtggatgagaatcaaagctggtacctcaatgaaaatatcaaacatttctgcaccaaccctgattcagttgacaagaaagatgctgttttccagaggagtaacaaaatgcatgccctcaatggatacctcttcggaaacttcccggagcctgatatgtgtgttggagaatctgtgtcctggcacctatttggaatggggaatgaaatagacatccattctatctatttctatggtaacaccttcatcagcagagggcatcggactgatgtcgtcaacctgttcccagccaccttccttacaacagaaatgatagccgagaatcctgggaagtggatgataacctgccaggtcagcgaccacctacaagctggtatgctggggcaatacaatgttgataactgcaaaagtgatattttctaccccaagatgaagggtcaacagaggcgctactttatagcagctgaaaaaattctttgggattatgctcctcaaggttcatataatggtgactctgatctctacttcacacaaggggacaacagaataggaggaaaatactggaaggttcggtatactgaatttgttgatgcaacttttactaaaagaaagagactctctgctgaagaagcccatcttggaattcttggcccagtcatcaaggcagaggtgggtgataccctgttagtgacctttgccaacaaagccgacaaggtctatagcattttaccccatggtgtgatctatgacaaggcatctgatgcagccccaaacctagatggatttgtgaaaccaggggcgcatgttaaaccaggtgaaaccttcacatacaagtggacagtgcctgagagcgtaagcccaactgctggtgatcctccctgtctgacctatctttacttctcagcagttgatccaattaaggacaccagctctggcctggtagggcctttgctagtctgtaaaaagggcgtcctcaatgctgatgggacacagaaaggaatagacaaggagttttacctactgttcacagtctttgatgagaatctgagcagatattttgatgaaaacattcagaagtttatctggcatcccttcagcattgacaaagaagataaagagtttgtgaaatccaaccgaatgcatgctgttaacggctacatgtatggcaaccagccaggcttaaacatgtgtaaaagggatagagtttcctggcatctgattggattgggcactgacactgacatgcatggaattgtttttcaagggaacaccatccacctacgagggactcaccgagactccctggccctgtttccccacatggccacaacagcattcatgcagccagaccatgcaggtatttttagggtgttttgtgccaccatgccccacctctcgagaggcatgggtcagatctatgaggtcagcagctgtgacaacagggacccttctgagcagcggtacgggatgataagaactttttacatcgccgctgaagaagtagaatgggattatgcccctaacaaaaactgggagttcgaaaagcagcacgtggacgcaagaggggaaagacatggagatatatttatgaaccgcactgaaaattggattggctctcagtacaagaaggtggtttacagggaatatacggatggagaatttgtggagatcaaagcccgaccaccacgagaggagcacttagaactcctgggcccaatgattcatgctgaggtgggcaacaccgtcctgatcatatttaagaacaaagccagtaggccctactccatctcagcccagggtgtggaggagatggatagtggaaagcaattccaagtgcccatgacaaaaccaggagaagtaaaaacttatagatggaatatccctaaaagatccggtccagggccttctgatcccaattgtattccatgggtttactattcaacagtaaactttgtgaaggatacgtatagtggtttgatgggtcctctgattacatgccgaaaaggagtcttgaatgaaaagggaagaagaagtgacgttgattatgaatttgctctcttgtttttggtatttaatgagaatgaatcctggtatctggatgacaatattaagaagtatctcaacaaagatccacgagattttaagcgcactgatgattttgaggaaagcaacagaatgcatgccattaatggaaagatttttgggaatctccatggcctcataatgaacgaagatacaatgacaaactggtatttgttagggataggaagtgaagtggacatacataccatccattatcatgctgagagctttcttttcaaaatagataaatcttaccgagaagatgtgtatgatctctttcctgggacattccaaaccattgaactgtttgcagatcacccagggacatggctgctacactgtcatgtgtctgaccacatccatgctggcatggagacaacctacacggtccttcgtaacatagacaacaggattccttactccaccacatctcctggagtggcatctcacccagccacggtgccatctaacgaacgacctggcaaagagcagctctatttctttggcaagaatctgggtccaacaggagccaaggcagccttggtcatccttttcatcattggactcctccttctaatcaccacggtgattctctccctcagactctgctctgcaatgaagcagacagattaccagcaagtccagtcctgtgctctccccacggatgctctgtgaaccatctggtctccctcaacaggaaagggtgatgtcccacagctggccagatggcagccaacagggaaactggaccaaggcatcactcaccaaggaaggttgacactgtatcctggatcagccttctgatcctctcaaacatcatccaaagcaatttgcttttatttatttatttttaaatgggctgcgaataatcctcaggtataaaacacagaaaaaggagaatgggcatggctgagaatgtcaactcttagtctattctttggttggattcactgaataggagacactctgaaagatatctttatattccatcttttataattcttgaacagtgctttcttagctaaccaccaaagtttctaggtgaacagcttctagaaaaagttagagtgcctcagacatttaactggaagggcactactttttcaacattgttgcataacatgcatcccttggttctgtggaaaatatctttcttaggagttcttggcaatgtctaagtcagtgtctgctgatagaattagaccaaataaattttttggaggctttaaccagctctcctggccttttcctctttgatataaatagcctgtgcagtgcttgttttaaaaagcaaagttatacgttttttaaaaaattgctgctgtttttattcaaacctgtagaaatacttgaatgtttacaactcacttcatgttacatgtttttacaatatgtttctgtggcaatgtttgtactttcaaaaatcaagtagagaaattgtatttctactgcagactgtgggagggctgaaatctgtaaaagaacatgttaggctctccctttatgaatcagggactccctgagagtttagagcaagctttctatcagggagggaagctttgcaggaggcaagtctgggcttgaatttggagtctgatttttcattcagttagagggaatctttacaagtcctcatcttctatgaaattataacattctcattgtatgagaaacatcaggaggaatttatcaatgtaggtgactagataggagaagggacctctaaatatcctagattctatggcttttaaagacatacctcttcatggaaggagaaaaaaggaaaaggaaaggtgagaaaaagataatcttggtggcagattctcttaaaccattaaaccagctttgaaaattaataaataatttccaaggttcaaatgcaaaaaaattattgaacaactaaactcaacccattatgaggcaatctacactgtccatacctatgcttagacagtaggtgtaagattgataaaagtaacattgtttattacaagactgagaaattgcttttagctctgggcgagatgccctgagattccaatgccaatgctagatgagtgatactggtatgcctgccttagcagtgggtaatttgaatgtcaaagtgagtgacaaggacctaagaaatattctggtggagggacctttcacactgtctcatcttcatcttcatgaggggaaatgggtaattggatagaagctatagtcttaacataaaaggggatgcaaatgctaatagttctgttcatagtttgcttgaatgtcatatcaaacagcatacacaaaagattttgaatttcaatctgctaaccattgacaatgtgatttcatagtacatgttctacagttttcatacatgtgtaggctgcataatttcataattatggtaaatgccttatttattacccaccttagtaagacaagttgttcagttgtttttttttcttttcagtttatttttttaatgaaaacaaaaccacaaagtagtttgattgcatcatttatcattttaataaagtgtcacataaggtggctatttgcatggttattttcacttaaaattatctatcactgaactaggggaggtggttaaagtggaattaatttttagatatttaggggctatgactatgccaatgacacttgttagaggaaatgaaacaaaatagtgtatctccacaaataatatgacttctcaaacattgtttcctcaaacataactacactccttgttctcagcctcactcttgagaaaatcaactctgccttcacttacacacatatttcttcctattacaatacacgtgtccctgctcctagcaggacagtctcttcatttgactttgggtctcattgcttcttgctttctcaagacttcattcccttgggtatccatttttcctcctgcatctttctatgaaaccatcagcaatgtccgccattaaaaacagaaagcaatgtgctgtcttatttaactctataa

SEQ ID NO: 59639 - DNA, 6175 bp, Homo sapiens
atggcccagccttttccacccaaagacctgttactgaattttgtctccatgtgtctgaagggtacttccccatcatcattttcattcatcctaagaaaggcggctccctgtgtggaggtggtggccgcgaacattttggctgaactgagcagtcaaccttctcatttttgctggaaggatttgagagaatatgggggagatggtacacgagccagtggaggattagtggggttttatgttgttgtgatgaactttatgatcaacgcccccatcgagcttgctttgcttacgcaaggcctcagcctttgcctcttccccaaacccaagctacctgaggaggaggagctgagtgagggggagggaccaacagatttgtcccctgtgcaggctacctgcctgcttgagttacatccacaaatgcctcggaagcagccagctggctgcatctttctcctcacattcctgggtctgtctgggctggttggcacagttaccagaacgtactacattgggattgtggaagaatactggaactatgtaccccaagggaagaatgttattactgggaaaagtttcacagaagacaaacttgcaaccttatttctcgaaagagggcccaacaggataggcagtatttacaaaaaggctgtttacagacgcttcacggatggaacctactccatagagatccccaaacctccctggcttggattcctgggccccatcttgagggccgaagtgggtgatgtgattgtcattcatttaaagaactttgcttctcgaccttactctctgcatccacatggcgttttctacaacaaagattcagaaggagccctatacccagatggaacatctggaaggaacaaaaatgatgacatggttcctcctgggaaaaactacacctacgtctggccggtgagagaagaatatgcacctactccagccgatgccaactgcctgacctgggtgtaccattcgcacatcgacgccccaaaggacatctgctctgggctaattgggcccctgctggtctgcaaggaaggtatcctgaatagatattcagggacacggaatgatgtggatcgagagtttgttataatgtttactcttgtggatgagaatcaaagctggtacctcaatgaaaatatcaaacatttctgcaccgaccctgattcagttgacaagaaagatgctgttttccagaggagtaacaaaatgcatgccctcaatggatacctcttcggaaacttcccggagcctgatatgtgtgttggagaatctgtgtcctggcacctatttggaatggggaatgaaatagacatccattctatctatttctatggtaacaccttcatcagcagagggcatcggactgatgtcgtcaacctgttcccagccaccttccttacaacagaaatgatagccgagaatcctgggaagtggatgataacctgccaggtcagcgaccacctacaagctggtatgctggggcaatacaatgttgataactgcaaaagtgatattttctaccccaagatgaagggtcaacagaggcgctactttatagcagctgaaaaaattctttgggattatgctcctcaaggttcatataatggtgactctgatctctacttcacacaaggggacaacagaataggaggaaaatactggaaggttcggtatactgaatttgttgatgcaacttttactaaaagaaagagactctctgctgaagaagcccatcttggaattcttggcccagtcatcaaggcagaggtgggtgataccctgttagtgacctttgccaacaaagccgacaaggtctatagcattttaccccatggtgtgatctatgacaaggcatctgatgcagccccaaacctagatggatttgtgaaaccaggggcgcatgttaaaccaggtgaaaccttcacatacaagtggacagtgcctgagagcgtaagcccaactgctggtgatcctccctgtctgacctatctttacttctcagcagttgatccaattaaggacaccagctctggcctggtagggcctttgctagtctgtaaaaagggcgtcctcaatgctgatgggacacagaaaggaatagacaaggagttttacctactgttcacagtctttgatgagaatctgagcagatattttgatgaaaacattcagaagtttatctggcatcccttcagcattgacaaagaagataaagagtttgtgaaatccaaccgaatgcatgctgttaacggctacatgtatggcaaccagccaggcttaaacatgtgtaaaagggatagagtttcctggcatctgattggattgggcactgacactgacatgcatggaattgtttttcaagggaacaccatccacctacgagggactcaccgagactccctggccctgtttccccacatggccacaacagcattcatgcagccagaccatgcaggtatttttagggtgttttgtgccaccatgccccacctctcgagaggcatgggtcagatctatgaggtcagcagctgtgacaacagggacccttctgagcagcggtacgggatgataagaactttttacatcgccgctgaagaagtagaatgggattatgcccctaacaaaaactgggagttcgaaaagcagcacgtggacgcaagaggggaaagacatggagatatatttatgaaccgcactgaaaattggattggctctcagtacaagaaggtggtttacagggaatatacggatggagaatttgtggagatcaaagcccgaccaccacgagaggagcacttagaactcctgggcccaatgattcatgctgaggtgggcaacaccgtcctgatcatatttaagaacaaagccagtaggccctactccatctcagcccagggtgtggaggagatggatagtggaaagcaattccaagtgcccatgacaaaaccaggagaagtaaaaacttatagatggaatatccctaaaagatccggtccagggccttctgatcccaattgtattccatgggtttactattcaacagtaaactttgtgaaggatacgtatagtggtttgatgggtcctctgattacatgccgaaaaggagtcttgaatgaaaagggaagaagaagtgacgttgattatgaatttgctctcttgtttttggtatttaatgagaatgaatcctggtatctggatgacaatattaagaagtatctcaacaaagatccacgagattttaagcgcactgatgattttgaggaaagcaacagaatgcatgccattaatggaaagatttttgggaatctccatggcctcataatgaacgaagatacaatgacaaactggtatttgttagggataggaagtgaagtggacatacataccatccattatcatgctgagagctttcttttcaaaatagataaatcttaccgagaagatgtgtatgatctctttcctgggacattccaaaccattgaactgtttgcagatcacccagggacatggctgctacactgtcatgtgtctgaccacatccatgctggcatggagacaacctacacggtccttcgtaacatagacaacaggattccttactccaccacatctcctggagtggcatctcacccagccacggtgccatctaacgaacgacctggcaaagagcagctctatttctttggcaagaatctgggtccaacaggagccaaggcagccttggtcatccttttcatcattggactcctccttctaatcaccacggtgattctctccctcagactctgctctgcaatgaagcagacagattaccagcaagtccagtcctgtgctctccccacggatgctctgtgaaccatctggtctccctcaacaggaaagggtgatgtcccacagctggccagatggcagccaacagggaaactggaccaaggcatcactcaccaaggaaggttgacactgtatcctggatcagccttctgatcctctcaaacatcatccaaagcaatttgcttttatttatttatttttaaatgggctgcgaataatcctcaggtataaaacacagaaaaaggagaatgggcatggctgagaatgtcaactcttagtctattctttggttggattcactgaataggagacactgtgaaagatatctttatattccatcttttataattcttgaacagtgctttcttagctaaccaccaaagtttctaggtgaacagcttctagaaaaagttagagtgcctcagacatttaactggaagggcactactttttcaacattgttgcataacatgcgtcccttggttctgtggaaaatatctttcttaggagttcttggcaatgtctaagtcagtgtctgctgatagaattagaccaaataaattttttggaggctttaaccagctctcctggccttttcctctttgatataaatagcctgtgcagtgcttgttttaaaaagcaaagttatacgttttttaaaaaattgctgctgtttttattcaaacctgtagaaatacttgaatgtttacaactcacttcatgttacatgtttttacaatatgtttctgtggcaatgtttgtactttcaaaaatcaagtagagaaattgtatttctactgcagactgtgggagggctgaaatctgtaaaagaacatgttaggctctccctttatgaatcagggactccctgagagtttagagcaagctttctatcagggagggaagctttgcaggaggcaagtctgggcttgaatttggagtctgatttttcattcagttagagggaatctttacaagtcctcatcttctatgaaattataacattctcattgtatgagaaacatcaggaggaatttatcaatgtaggtgactagataggagaagggacctctaaatatcctagattctatggcttttaaagacatacctcttcatggaaggagaaaaaaggaaaaggaaaggtgagaaaaagataatcttggtggcagattctcttaaaccattaaaccagctttgaaaattaataaataatttccaaggttcaaatgcaaaaaaattattgaacaactaaactcaacccattatgaggcaatctacactgtccatacctatgcttagacagtaggtgtaagattgataaaagtaacattgtttattacaagactgagaaattgcttttagctctgggcgagatgccctgagattccaatgccaatgctagatgagtgatactggtatgcctgccttagcagtgggtaatttgaatgtcaaagtgagtgacaaggacctaagaaatattctggtggagggacctttcacactgtctcatcttcatcttcatgaggggaaatgggtaattggatagaagctatagtcttaacataaaaggggatgcaaatgctaatagttctgttcatagtttgcttgaatgtcatatcaaacagcatacacaaaagattttgaatttcaatctgctaaccattgacaatgtgatttcatagtacatgttctacagttttcatacatgtgtaggctgcataatttcataattatggtaaatgccttatttattacccaccttagtaagacaagttgttcagttgtttttttttcttttcagtttatttttttaatgaaaacaaaaccacaaagtagtttgattgcatcatttatcattttaataaagtgtcacataaggtggctatttgcatggttattttcacttaaaattatctatcactgaactaggggaggtggttaaagtggaattaatttttagatatttaggggctatgactatgccaatgacacttgttagaggaaatgaaacaaaatagtgtatctccacaaataatatgacttctcaaacattgtttcctcaaacataactacactccttgttctcagcctcactcttgagaaaatcaactctgccttcacttacacacatatttcttcctattacaatacacgtgtccctgctcctagcaggacagtctcttcatttgactttgggtctcattgcttcttgctttctcaagacttcattcccttgggtatccatttttcctcctgcatctttctatgaaaccatcagcaatgtccgccattaaaaacagaaagcaatgtgctgtcttatttaactctataa

SEQ ID NO: 59640 - DNA, 1092 bp, Homo sapiens
tctcacttatgtcttggaagatggctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcggggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctacgcacgaccttgcagcggcaagtggagcccacagtgaccatctccccatccaggacagaggccctcaaccaccacaacctgctggtctgctcagtgacagatttctatccagcccagatcaaagtccagtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgacctcgagggcctccacctgcaggactcctgcactgactcctgaggacttttgtctgggattggtcatcactcttctgtaatgcccacctgcccctgcccagaattcctagctgcctgtgtcatcctgtcccactgaggtcagagtcctacagtggctcatgcagccacaggtcaccttctgtgatccccatcccaaggcactggcggtgactctgcttcctgtactgacccagagcctctgcctgtgcactgcaagctgtgtctactcaggccccaaggggcatctctgtttccattctccccccacagacctgtcaagagaagcatgacaaacaaaatcatttacctaactttagtgctttttcccataattaaacctgattctgagttaaaaaaaaaaaaaaaaaaaaaaaaaaaaaaaaaa

SEQ ID NO: 59641 - DNA, 4298 bp, Homo sapiens
cttgaatcttggggcaggaactcagaaaacttccagcccgggcagcgcgcgcttggtgcaagactcaggagctagcagcccgtccccctccgactctccggtgccgccgctgcctgctcccgccaccctaggaggcgcggtgccacccactactctgtcctctgcctgtgctccgtgcccgaccctatcccggcggagtctccccatcctcctttgctttccgactgcccaaggcactttcaatctcaatctcttctctctctctctctctctctctctctctctctctctctctctctctctctctctcgcagggtggggggaagaggaggaggaattctttccccgcctaacatttcaagggacacaattcactccaagtctcttccctttccaagccgcttccgaagtgctcccggtgcccgcaactcctgatcccaacccgcgagaggagcctctgcgacctcaaagcctctcttccttctccctcgcttccctcctcctcttgctacctccacctccaccgccacctccacctccggcacccacccaccgccgccgccgccaccggcagcgcctcctcctctcctcctcctcctcccctcttctctttttggcagccgctggacgtccggtgttgatggtggcagcggcggcagcctaagcaacagcagccctcgcagcccgccagctcgcgctcgccccgccggcgtccccagccctatcacctcatctcccgaaaggtgctgggcagctccggggcggtcgaggcgaagcggctgcagcggcggtagcggcggcgggaggcaggatgagcgcacgcggtgagggcgcggggcagccgtccacttcagcccagggacaacctgccgccccagcgcctcagaagagaggacgcggccgccccaggaagcagcagcaagaaccaaccggtgagccctctcctaagagacccaggggaagacccaaaggcagcaaaaacaagagtccctctaaagcagctcaaaagaaagcagaagccactggagaaaaacggccaagaggcagacctaggaaatggtggttgctaatgaagagcccgtgctggtgaaggaagcctgctgatcccggaactggccttgcgcgcaagtggtgggatgacagacacattcccttccttgaactgcactcttttcccttgcactcagaggtggcccgagagagccccgccacaacaagttgttcagaagaagcctgctcaggaggaaactgaagagacatcctcacaagagtctgccgaagaggactagggggcgccaacgttcgatttctacctcagcagcagttggatcttttgaagggagaagacactgcagtgaccacttattctgtattgccatggtctttccactttcatctggggtggggtggggtggggtgggggaggggggggtggggtggggagaaatcacataaccttaaaaaggactatattaatcaccttctttgtaatcccttcacagtcccaggtttagtgaaaaactgctgtaaacacaggggacacagcttaacaatgcaacttttaattactgttttcttttttcttaacctactaatagtttgttgatctgataagcaagagtgggcgggtgagaaaaaccgaattgggtttagtcaatcactgcactgcatgcaaacaagaaacgtgtcacacttgtgacgtcgggcattcatataggaagaacgcggtgtgtaacactgtgtacacctcaaataccaccccaacccactccctgtagtgaatcctctgtttagaacaccaaagataaggactagatactactttctctttttcgtataatcttgtagacacttacttgatgatttttaactttttatttctaaatgagacgaaatgctgatgtatcctttcattcagctaacaaactagaaaaggttatgttcatttttcaaaaagggaagtaagcaaacaaatattgccaactcttctatttatggatatcacacatatcagcaggagtaataaatttactcacagcacttgttttcaggacaacacttcattttcaggaaatctacttcctacagagccaaaatgccatttagcaataaataacacttgtcagcctcagagcatttaaggaaactagacaagtaaaattatcctctttgtaatttaatgaaaaggtacaacagaataatgcatgatgaactcacctaattatgaggtgggaggagcgaaatctaaatttcttttgctatagttatacatcaatttaaaaagcaaaaaaaaaaaaggggggggcaatctctctctgtgtctttctctctctctcttcctctccctctctcttttcattgtgtatcagtttccatgaaagacctgaataccacttacctcaaattaagcatatgtgttacttcaagtaatacgttttgacataagatggttgaccaaggtgcttttcttcggcttgagttcaccatctcttcattcaaactgcacttttagccagagatgcaatatatccccactactcaatactacctctgaatgttacaacgaatttacagtctagtacttattacatgctgctatacacaagcaatgcaagaaaaaaacttactgggtaggtgattctaatcatctgcagttctttttgtacacttaattacagttaaagaagcaatctccttactgtgtttcagcatgactatgtatttttctatgtttttttaattaaaaatttttaaaatacttgtttcagcttctctgctagatttctacattaacttgaaaattttttaaccaagtcgctcctaggttcttaaggataattttcctcaatcacactacacatcacacaagatttgactgtaatatttaaatattaccctccaagtctgtacctcaaatgaattctttaaggagatggactaattgacttgcaaagacctacctccagacttcaaaaggaatgaacttgttacttgcagcattcatttgttttttcaatgtttgaaatagttcaaactgcagctaaccctagtcaaaactatttttgtaaaagacatttgatagaaaggaacacgtttttacatacttttgcaaaataagtaaataataaataaaataaaagccaaccttcaaagaaacttgaagctttgtaggtgagatgcaacaagccctgcttttgcataatgcaatcaaaaatatgtgtttttaagattagttgaatataagaaaatgcttgacaaatattttcatgtattttacacaaatgtgatttttgtaatatgtctcaaccagatttattttaaacgcttcttatgtagagtttttatgcctttctctcctagtgagtgtgctgactttttaacatggtattatcaactgggccaggaggtagtttctcatgacggcttttgtcagtatggcttttagtactgaagccaaatgaaactcaaaaccatctctcttccagctgcttcagggaggtagtttcaaaggccacatacctctctgagactggcagatcgctcactgttgtgaatcaccaaaggagctatggagagaattaaaactcaacattactgttaactgtgcgttaaataagcaaataaacagtggctcataaaaataaaagtcgcattccatatctttggatgggccttttagaaacctcattggccagctcataaaatggaagcaattgctcatgttggccaaacatggtgcaccgagtgatttccatctctggtaaagttacacttttatttcctgtatgttgtacaatcaaaacacactactacctcttaagtcccagtatacctcatttttcatactgaaaaaaaaagcttgtggccaatggaacagtaagaacatcataaaatttttatatatatagtttatttttgtgggagataaattttataggactgttctttgctgttgttggtcgcagctacataagactggacatttaacttttctaccatttctgcaagttaggtatgtttgcaggagaaaagtatcaagacgtttaactgcagttgactttctccctgttcctttgagtgtcttctaactttattctttgttctttatgtagaattgctgtctatgattgtactttgaatcgcttgcttgttgaaaatatttctctagtgtattatcactgtctgttctgcacaataaacataacagcctctgtgatccccatgtgttttgattcctgctctttgttacagttccattaaatgagtaataaagtttggtcaaaacagaaaaaaaaaaa

SEQ ID NO: 59642 - DNA, 4150 bp, Homo sapiens
cttgaatcttggggcaggaactcagaaaacttccagcccgggcagcgcgcgcttggtgcaagactcaggagctagcagcccgtccccctccgactctccggtgccgccgctgcctgctcccgccaccctaggaggcgcggtgccacccactactctgtcctctgcctgtgctccgtgcccgaccctatcccggcggagtctccccatcctcctttgctttccgactgcccaaggcactttcaatctcaatctcttctctctctctctctctctctctctctctctctctctctctctctctctctctctcgcagggtggggggaagaggaggaggaattctttccccgcctaacatttcaagggacacaattcactccaagtctcttccctttccaagccgcttccgaagtgctcccggtgcccgcaactcctgatcccaacccgcgagaggagcctctgcgacctcaaagcctctcttccttctccctcgcttccctcctcctcttgctacctccacctccaccgccacctccacctccggcacccacccaccgccgccgccgccaccggcagcgcctcctcctctcctcctcctcctcccctcttctctttttggcagccgctggacgtccggtgttgatggtggcagcggcggcagcctaagcaacagcagccctcgcagcccgccagctcgcgctcgccccgccggcgtccccagccctatcacctcatctcccgaaaggtgctgggcagctccggggcggtcgaggcgaagcggctgcagcggcggtagcggcggcgggaggcaggatgagcgcacgcggtgagggcgcggggcagccgtccacttcagcccagggacaacctgccgccccagcgcctcagaagagaggacgcggccgccccaggaagcagcagcaagaaccaaccggtgagccctctcctaagagacccaggggaagacccaaaggcagcaaaaacaagagtccctctaaagcagctcaaaagaaagcagaagccactggagaaaaacggccaagaggcagacctaggaaatggccacaacaagttgttcagaagaagcctgctcaggaggaaactgaagagacatcctcacaagagtctgccgaagaggactagggggcgccaacgttcgatttctacctcagcagcagttggatcttttgaagggagaagacactgcagtgaccacttattctgtattgccatggtctttccactttcatctggggtggggtggggtggggtgggggaggggggggtggggtggggagaaatcacataaccttaaaaaggactatattaatcaccttctttgtaatcccttcacagtcccaggtttagtgaaaaactgctgtaaacacaggggacacagcttaacaatgcaacttttaattactgttttcttttttcttaacctactaatagtttgttgatctgataagcaagagtgggcgggtgagaaaaaccgaattgggtttagtcaatcactgcactgcatgcaaacaagaaacgtgtcacacttgtgacgtcgggcattcatataggaagaacgcggtgtgtaacactgtgtacacctcaaataccaccccaacccactccctgtagtgaatcctctgtttagaacaccaaagataaggactagatactactttctctttttcgtataatcttgtagacacttacttgatgatttttaactttttatttctaaatgagacgaaatgctgatgtatcctttcattcagctaacaaactagaaaaggttatgttcatttttcaaaaagggaagtaagcaaacaaatattgccaactcttctatttatggatatcacacatatcagcaggagtaataaatttactcacagcacttgttttcaggacaacacttcattttcaggaaatctacttcctacagagccaaaatgccatttagcaataaataacacttgtcagcctcagagcatttaaggaaactagacaagtaaaattatcctctttgtaatttaatgaaaaggtacaacagaataatgcatgatgaactcacctaattatgaggtgggaggagcgaaatctaaatttcttttgctatagttatacatcaatttaaaaagcaaaaaaaaaaaaggggggggcaatctctctctgtgtctttctctctctctcttcctctccctctctcttttcattgtgtatcagtttccatgaaagacctgaataccacttacctcaaattaagcatatgtgttacttcaagtaatacgttttgacataagatggttgaccaaggtgcttttcttcggcttgagttcaccatctcttcattcaaactgcacttttagccagagatgcaatatatccccactactcaatactacctctgaatgttacaacgaatttacagtctagtacttattacatgctgctatacacaagcaatgcaagaaaaaaacttactgggtaggtgattctaatcatctgcagttctttttgtacacttaattacagttaaagaagcaatctccttactgtgtttcagcatgactatgtatttttctatgtttttttaattaaaaatttttaaaatacttgtttcagcttctctgctagatttctacattaacttgaaaattttttaaccaagtcgctcctaggttcttaaggataattttcctcaatcacactacacatcacacaagatttgactgtaatatttaaatattaccctccaagtctgtacctcaaatgaattctttaaggagatggactaattgacttgcaaagacctacctccagacttcaaaaggaatgaacttgttacttgcagcattcatttgttttttcaatgtttgaaatagttcaaactgcagctaaccctagtcaaaactatttttgtaaaagacatttgatagaaaggaacacgtttttacatacttttgcaaaataagtaaataataaataaaataaaagccaaccttcaaagaaacttgaagctttgtaggtgagatgcaacaagccctgcttttgcataatgcaatcaaaaatatgtgtttttaagattagttgaatataagaaaatgcttgacaaatattttcatgtattttacacaaatgtgatttttgtaatatgtctcaaccagatttattttaaacgcttcttatgtagagtttttatgcctttctctcctagtgagtgtgctgactttttaacatggtattatcaactgggccaggaggtagtttctcatgacggcttttgtcagtatggcttttagtactgaagccaaatgaaactcaaaaccatctctcttccagctgcttcagggaggtagtttcaaaggccacatacctctctgagactggcagatcgctcactgttgtgaatcaccaaaggagctatggagagaattaaaactcaacattactgttaactgtgcgttaaataagcaaataaacagtggctcataaaaataaaagtcgcattccatatctttggatgggccttttagaaacctcattggccagctcataaaatggaagcaattgctcatgttggccaaacatggtgcaccgagtgatttccatctctggtaaagttacacttttatttcctgtatgttgtacaatcaaaacacactactacctcttaagtcccagtatacctcatttttcatactgaaaaaaaaagcttgtggccaatggaacagtaagaacatcataaaatttttatatatatagtttatttttgtgggagataaattttataggactgttctttgctgttgttggtcgcagctacataagactggacatttaacttttctaccatttctgcaagttaggtatgtttgcaggagaaaagtatcaagacgtttaactgcagttgactttctccctgttcctttgagtgtcttctaactttattctttgttctttatgtagaattgctgtctatgattgtactttgaatcgcttgcttgttgaaaatatttctctagtgtattatcactgtctgttctgcacaataaacataacagcctctgtgatccccatgtgttttgattcctgctctttgttacagttccattaaatgagtaataaagtttggtcaaaacagaaaaaaaaaaa

SEQ ID NO: 59643 - DNA, 2435 bp, Homo sapiens
aggggtggagagaaaagaggggagggatggggggaggggaaacaggagcgaggtgtctccctagctcgctgcctctggcaagtggagtttttaaaaagctccagcagatcatgtcatgacgacttcgctgctcctgcatccacgctggccggagagccttatgtacgtctatgaggacagcgcggcggagagcggcatcggcggcggcggcggaggaggaggcggcggcacgggcggagcggggggtggctgcagcggagcgagccccggcaaagccccgagcatggatggtctgggcagcagctgcccggccagccactgccgcgacctgcttccgcaccccgtgctgggccgcccgccggctcccctgggcgcccctcagggcgccgtctatacggacatcccggccccggaggcggcgcgccagtgtgccccgccgcccgcaccccccacctcgtccagcgccaccctgggctacggctaccccttcgggggcagctactacggctgccgcctgtcgcacaacgtgaacctgcagcagaagccttgcgcctaccacccgggcgataaatacccggagccgtcgggcgccctgcccggtgacgacctgtcctctagggccaaggagttcgccttctaccccagcttcgccagctcctaccaggcgatgcccggctacctggacgtgtcggtggtgcccgggatcagcgggcacccggagccgcgtcacgacgccctcatccccgtcgaaggctaccagcactgggctctctccaatggctgggacagtcaggtgtactgctccaaggagcagtcgcagtccgcccacctctggaagtctcccttcccagacgtggttcccctgcagcccgaggtgagcagctaccggcgcgggcgcaagaaacgcgtgccctacactaaggtgcagctgaaggagctagagaaggaatacgcggctagcaagttcatcaccaaagagaagcgccggcgcatctccgccaccacgaacctctctgagcgccaggtaaccatctggttccagaaccggcgggtcaaagagaagaaggtggtcagcaaatcgaaagcgcctcatctccactccacctgaccacccacccgctgcttgccccatctatttatgtctccgctttgtaccataaccgaacccacggaaagacgctgcgcgggtgcagaagagtatttaatgttaaggaaagagaagaaccgcgccgcccggaggcagagaggctccatggccgtgctgctgggccatccccaactccctatcccatccccagcctccacccccatccagatgggactcacgtggcttcaacagctttggaaatgggtcccgagtgggccgtgcgaggaaggctgtcgacctctactcctccttgcgctcaccttgccagaaagtctggtggcagcgcagagcccaatcattccaaccaaagcagggttggggaatcccgaatggccccaattcttgcctcatcctatgaccaggcttttagaggaccttccctaagggcgcagcttcggagcaggatctgtccagctcatactttccttcgctgtccctcccgcactccttaggcaagatttcccagtaaagattttctgtgcgtattttaaaagtcgtgttaatactcatgataattattagggacctggcagcgtgattggagtatggatgtttccgtaaaagctggaattccgtaaaagcattgacgcagcccctacactccatcccaaccaagaaactgcatttcctggggccaggtgggagctgcctttgccccactgcctcccctgttctgctctctcagtcaacatgtggaaatccaaggaggacaaagactccagccacgctgctaaatagggctcctctctcctctctctctctctaggtggtaaggttggggattagtccaggtacagaagcagaacttttttctaaggataaacatctcttccaaggggatggagagtgggtccctcaacaaagtccctgtccagtcacctttccatcagggcactagcccaggaatgactcctcacactttcacctttactgatttccagaggaaagctagaggatctagttcaagaggcaagaagatctggccctcaattagctagatgtagatgctgcctaacagttccctcctcaaaggccaccttggtgctgtgggggccccttgcctcttcccttcccactggtgcattacaaaacagtgttcttttgaaatgttcatcaggaataggcttttttaaaaaatgttgtgtatctgtatatagtattgtgatgtctgaatgacaatgtactgaatgcaaaaaggaaaaaaacccacaaacatgtttttaaaataaaatatctttttttgccttgaaaaaaaaaaaaaaaaaaaaaaaaaaaaaaaaaaaaaaaa

SEQ ID NO: 59644 - DNA, 4981 bp, Homo sapiens
ggccccggagctggcccatggggagcaggcgcccggtgccggccacgacgaccgccaccgcccgcgccgcgaccggccggtgaagcccagggacccccctctgggagagccccatgagggcaggagagtgatggagagtacgcccagcttcctgaagggcaccccaacctgggagaagacggccccagagaacggcatcgtgagacaggagcccggcagcccgcctcgagatggactgcaccatgggccgctgtgcctgggagagcctgctcccttttggaggggcgtcctgagcaccccagactcctggcttccccctggcttcccccagggccccaaggacatgctcccacttgtggagggcgagggcccccagaatggggagaggaaggtcaactggctgggcagcaaagagggactgcgctggaaggaggccatgcttacccatccgctggcattctgcgggccagcgtgcccacctcgctgtggccccctgatgcctgagcatagtggtggccatctcaagagtgaccctgtggccttccggccctggcactgccctttccttctggagaccaagatcctggagcgagctcccttctgggtgcccacctgcttgccaccctacctagtgtctggcctgcccccagagcatccatgtgactggcccctgaccccgcacccctgggtatactccgggggccagcccaaagtgccctctgccttcagcttaggcagcaagggcttttactacaaggatccgagcattcccaggttggcaaaggagcccttggcagctgcggaacctgggttgtttggcttaaactctggtgggcacctgcagagagccggggaggccgaacgcccttcactgcaccagagggatggagagatgggagctggccggcagcagaatccttgcccgctcttcctggggcagccagacactgtgccctggacctcctggcccgcttgtcccccaggccttgttcatactcttggcaacgtctgggctgggccaggcgatgggaaccttgggtaccagctggggccaccagcaacaccaaggtgcccctctcctgagccgcctgtcacccagcggggctgctgttcatcctacccacccactaaaggtgggggtcttggcccttgtgggaagtgccaggagggcctggaggggggtgccagtggagccagcgaacccagcgaggaagtgaacaaggcctctggccccagggcctgtccccccagccaccacaccaagctgaagaagacatggctcacacggcactcggagcagtttgaatgtccacgcggctgccctgaggtcgaggagaggccggttgctcggctccgggccctcaaaagggcaggcagccccgaggtccagggagcaatgggcagtccagcccccaagcggccaccggacccttttccaggcactgcagaacagggggctgggggttggcaggaggtgcgggacacatcgatagggaacaaggatgtggactcgggacagcatgatgagcagaaaggaccccaagatggccaggccagtctccaggacccgggacttcaggacataccatgcctggctctccctgcaaaactggctcaatgccaaagttgtgcccaggcagctggagagggaggagggcacgcctgccactctcagcaagtgcggagatcgcctctgggaggggagctgcagcaggaggaagacacagccaccaactccagctctgaggaaggcccagggtccggccctgacagccggctcagcacaggcctcgccaagcacctgctcagtggtttgggggaccgactgtgccgcctgctgcggagggagcgggaggccctggcttgggcccagcgggaaggccaagggccagccgtgacagaggacagcccaggcattccacgctgctgcagccgttgccaccatggactcttcaacacccactggcgatgtccccgctgcagccaccggctgtgtgtggcctgtggtcgtgtggcaggcactgggcgggccagggagaaagcaggctttcaggagcagtccgcggaggagtgcacgcaggaggccgggcacgctgcctgttccctgatgctgacccagtttgtctccagccaggctttggcagagctgagcactgcaatgcaccaggtctgggtcaagtttgatatccgggggcactgcccctgccaagctgatgcccgggtatgggcccccggggatgcaggccagcagaaggaatcaacacagaaaacgcccccaactccacaaccttcctgcaatggcgacacccacaggaccaagagcatcaaagaggagacccccgattccgctgagaccccagcagaggaccgtgctggccgagggcccctgccttgtccttctctctgcgaactgctggcttctaccgcggtcaaactctgcttgggccatgagcgaatacacatggccttcgcccccgtcactccggccctgcccagtgatgaccgcatcaccaacatcctggacagcattatcgcacaggtggtggaacggaagatccaggagaaagccctggggccggggcttcgagctggcccgggtctgcgcaagggcctgggcctgcccctctctccagtgcggccccggctgcctcccccaggggctttgctgtggctgcaggagccccagccttgccctcggcgtggcttccacctcttccaggagcactggaggcagggccagcctgtgttggtgtcagggatccaaaggacattgcagggcaacctgtgggggacagaagctcttggggcacttggaggccaggtgcaggcgctgagccccctcggacctccccagcccagcagcctgggcagcacaacattctgggagggcttctcctggcctgagcttcgcccaaagtcagacgagggctctgtcctcctgctgcaccgagctttgggggatgaggacaccagcagggtggagaacctagctgccagtctgccacttccggagtactgcgccctccatggaaaactcaacctggcttcctacctcccaccgggccttgccctgcgtccactggagccccagctctgggcagcctatggtgtgagcccgcaccggggacacctggggaccaagaacctctgtgtggaggtggccgacctggtcagcatcctggtgcatgccgacacaccactgcctgcctggcaccgggcacagaaagacttcctttcaggcctggacggggaggggctctggtctccgggcagccaggtcagcactgtgtggcacgtgttccgggcacaggacgcccagcgcatccgccgctttctccagatggtgtgcccggccggggcaggcgccctggagcctggcgccccaggcagctgctacctggatgcagggctgcggcggcgcctgcgggaggagtggggcgtgagctgctggaccctgctccaggcccccggagaggccgtgctggtgcctgcaggggctccccaccaggtgcagggcctggtgagcacagtcagcgtcactcagcacttcctctcccctgagacctctgccctctctgctcagctctgccaccagggacccagccttccccctgactgccacctgctttatgcccagatggactgggctgtgttccaagcagtgaaggtggccgtggggacattacaggaggccaaatagagggatgctaggtgtctgggatcggggtggggacaggtagaccaggtgctcagcccaggcacaacttcagcaggggatggcgctaggggacttggggatttctggtcaaccccacaagcaccactctgggcacaagcagggcactctgttcccctcccccttaagccaacaaccacagtgccaccaagctcacacctgtccttctcaggctggcatctcccccaccctgtgccccttttcatggtaccaggcccgcactgggggcaattgacttcctccaatccccactcctccgagacccaggagacaaacagcccttccttggggaaacttgggaatcattctggcttaaacaacacctcctcctgctgctcactcccgctgagcccactctactgccccagctccgtttctaccaccgcatcctcactgggctcactgcaggcatgctgaacaaggggcctccaaccttctgccctcctgccaaaagatctggggagtgtgaggagagggtggcatcaggagctgctcaggcttggcggagggagcggcatgggcgatgtcactcagccccttcccggtccgcccgcttccctccttcatgatttccattaaagtctgttgttttgtgactgctgccagtgtggttggccctgcccctgcaggccacatggtccagggagggagggggacatggaaatctgccttagagacaaatggagtagggcagcccggagctggggcccaagggacaggacaccactgcctgctcttcgtctggggcctggggccttgcctcccactgaggagactttgggtggggtggggggctgtcccccaaagatgctcctgagtgcaagagcaggcaaggcagagtcctggggcacagccacgaggtgacctccctgtgcagagactcccgagccctactccacccagcaagctccagtccgccccatctctcccgtctaccctgacctggagatccagaagtatggcccagaagagcccttgccccgcctgtctgcccttggtggcagtggccatggccgacgccaggcccagccaccctgggactgagcctgactgcttcagacagccgacccctccttgtccccgctccacgcccgcagcctcctggtggcgctccgccctctcccgcttcctttgtgtatctcagccctacaaagaaaaacactcccactcttgtcatacctaattgttcctgctgtggtttggggaattttttttattaaataaagttttttattataagggtaa

SEQ ID NO: 59645 - DNA, 4816 bp, Homo sapiens
ggccccggagctggcccatggggagcaggcgcccggtgccggccacgacgaccgccaccgcccgcgccgcgaccggccggtgaagcccagggacccccctctgggagagccccatgagggcaggagagtgatggagagtacgcccagcttcctgaagggcaccccaacctgggagaagacggccccagagaacggcatcgtgagacaggagcccggcagcccgcctcgagatggactgcaccatgggccgctgtgcctgggagagcctgctcccttttggaggggcgtcctgagcaccccagactcctggcttccccctggcttcccccagggccccaaggacatgctcccacttgtggagggcgagggcccccagaatggggagaggaaggtcaactggctgggcagcaaagagggactgcgctggaaggaggccatgcttacccatccgctggcattctgcgggccagcgtgcccacctcgctgtggccccctgatgcctgagcatagtggtggccatctcaagagtgaccctgtggccttccggccctggcactgccctttccttctggagaccaagatcctggagcgagctcccttctgggtgcccacctgcttgccaccctacctagtgtctggcctgcccccagagcatccatgtgactggcccctgaccccgcacccctgggtatactccgggggccagcccaaagtgccctctgccttcagcttaggcagcaagggcttttactacaaggatccgagcattcccaggttggcaaaggagcccttggcagctgcggaacctgggttgtttggcttaaactctggtgggcacctgcagagagccggggaggccgaacgcccttcactgcaccagagggatggagagatgggagctggccggcagcagaatccttgcccgctcttcctggggcagccagacactgtgccctggacctcctggcccgcttgtcccccaggccttgttcatactcttggcaacgtctgggctgggccaggcgatgggaaccttgggtaccagctggggccaccagcaacaccaaggtgcccctctcctgagccgcctgtcacccagcggggctgctgttcatcctacccacccactaaaggtgggggtcttggcccttgtgggaagtgccaggagggcctggaggggggtgccagtggagccagcgaacccagcgaggaagtgaacaaggcctctggccccagggcctgtccccccagccaccacaccaagctgaagaagacatggctcacacggcactcggagcagtttgaatgtccacgcggctgccctgaggtcgaggagaggccggttgctcggctccgggccctcaaaagggcaggcagccccgaggtccagggagcaatgggcagtccagcccccaagcggccaccggacccttttccaggcactgcagaacagggggctgggggttggcaggaggtgcgggacacatcgatagggaacaaggatgtggactcgggacagcatgatgagcagaaaggaccccaagatggccaggccagtctccaggacccgggacttcaggacataccatgcctggctctccctgcaaaactggctcaatgccaaagttgtgcccaggcagctggagagggaggagggcacgcctgccactctcagcaagtgcggagatcgcctctgggaggggagctgcagcaggaggaagacacagccaccaactccagctctgaggaaggcccagggtccggccctgacagccggctcagcacaggcctcgccaagcacctgctcagtggtttgggggaccgactgtgccgcctgctgcggagggagcgggaggccctggcttgggcccagcgggaaggccaagggccagccgtgacagaggacagcccaggcattccacgctgctgcagccgttgccaccatggactcttcaacacccactggcgatgtccccgctgcagccaccggctgtgtgtggcctgtggtcgtgtggcaggcactgggcgggccagggagaaagcaggctttcaggagcagtccgcggaggagtgcacgcaggaggccgggcacgctgcctgttccctgatgctgacccagtttgtctccagccaggctttggcagagctgagcactgcaatgcaccaggtctgggtcaagtttgatatccgggggcactgcccctgccaagctgatgcccgggtatgggcccccggggatgcaggccagcagaaggaatcaacacagaaaacgcccccaactccacaaccttcctgcaatggcgacacccacaggaccaagagcatcaaagaggagacccccgattccgctgagaccccagcagaggaccgtgctggccgagggcccctgccttgtccttctctctgcgaactgctggcttctaccgcggtcaaactctgcttgggccatgagcgaatacacatggccttcgcccccgtcactccggccctgcccagtgatgaccgcatcaccaacatcctggacagcattatcgcacaggtggtggaacggaagatccaggagaaagccctggggccggggcttcgagctggcccgggtctgcgcaagggcctgggcctgcccctctctccagtgcggccccggctgcctcccccaggggctttgctgtggctgcaggagccccagccttgccctcggcgtggcttccacctcttccaggagcactggaggcagggccagcctgtgttggtgtcagggatccaaaggacattgcagggcaacctgtgggggacagaagctcttggggcacttggaggccaggtgcaggcgctgagccccctcggacctccccagcccagcagcctgggcagcacaacattctgggagggcttctcctggcctgagcttcgcccaaagtcagacgagggctctgtcctcctgctgcaccgagctttgggggatgaggacaccagcagggtggagaacctagctgccagtctgccacttccggagtactgcgccctccatggaaaactcaacctggcttcctacctcccaccgggccttgccctgcgtccactggagccccagctctgggcagcctatggtgtgagcccgcaccggggacacctggggaccaagaacctctgtgtggaggtggccgacctggtcagcatcctggtgcatgccgacacaccactgcctgcctggcaccgggcacagaaagacttcctttcaggcctggacggggaggggctctggtctccgggcagccaggtcagcactgtgtggcacgtgttccgggcacaggacgcccagcgcatccgccgctttctccagatggtgcagggcctggtgagcacagtcagcgtcactcagcacttcctctcccctgagacctctgccctctctgctcagctctgccaccagggacccagccttccccctgactgccacctgctttatgcccagatggactgggctgtgttccaagcagtgaaggtggccgtggggacattacaggaggccaaatagagggatgctaggtgtctgggatcggggtggggacaggtagaccaggtgctcagcccaggcacaacttcagcaggggatggcgctaggggacttggggatttctggtcaaccccacaagcaccactctgggcacaagcagggcactctgttcccctcccccttaagccaacaaccacagtgccaccaagctcacacctgtccttctcaggctggcatctcccccaccctgtgccccttttcatggtaccaggcccgcactgggggcaattgacttcctccaatccccactcctccgagacccaggagacaaacagcccttccttggggaaacttgggaatcattctggcttaaacaacacctcctcctgctgctcactcccgctgagcccactctactgccccagctccgtttctaccaccgcatcctcactgggctcactgcaggcatgctgaacaaggggcctccaaccttctgccctcctgccaaaagatctggggagtgtgaggagagggtggcatcaggagctgctcaggcttggcggagggagcggcatgggcgatgtcactcagccccttcccggtccgcccgcttccctccttcatgatttccattaaagtctgttgttttgtgactgctgccagtgtggttggccctgcccctgcaggccacatggtccagggagggagggggacatggaaatctgccttagagacaaatggagtagggcagcccggagctggggcccaagggacaggacaccactgcctgctcttcgtctggggcctggggccttgcctcccactgaggagactttgggtggggtggggggctgtcccccaaagatgctcctgagtgcaagagcaggcaaggcagagtcctggggcacagccacgaggtgacctccctgtgcagagactcccgagccctactccacccagcaagctccagtccgccccatctctcccgtctaccctgacctggagatccagaagtatggcccagaagagcccttgccccgcctgtctgcccttggtggcagtggccatggccgacgccaggcccagccaccctgggactgagcctgactgcttcagacagccgacccctccttgtccccgctccacgcccgcagcctcctggtggcgctccgccctctcccgcttcctttgtgtatctcagccctacaaagaaaaacactcccactcttgtcatacctaattgttcctgctgtggtttggggaattttttttattaaataaagttttttattataagggtaa

SEQ ID NO: 59646 - DNA, 936 bp, Homo sapiens
atgctgctcgtggccctggtgctcggcgcctactgcctctgcgccctccccggccgctgcccgccggccgcccgcgcccccgcgccggcccccgcgccctccgagccgtccagctccgtccaccgcccgggagcacccggcctgcctttggccagcggtcccggccgccggcgcttcccgcaagcgctcatcgttggcgtgaagaagggcggcacgcgcgccctgctggagtttctgcggctgcaccccgacgtccgcgcgctgggctctgagccccacttcttcgacaggtgctacgagcgcggcctcgcctggtaccggagtctgatgccccgaaccctggatgggcagatcaccatggagaagacccccagctacttcgtgacgcgagaggccccccgccgcatccacgccatgtccccggacacgaagctgatcgtggtggtgcggaaccccgtgacccgggccatctccgactatacccagacgctctccaagaccccgggcctgcccagcttccgcgccctggccttccgccacggcctgggccccgtggacacagcctggagcgccgtccgcatcggcctgtacgcccagcacctggaccactggctgcgctacttccccctgtcccacttcctgttcgtcagcggggagcgtctggtcagcgacccggccggagaggtcggccgcgtgcaggacttcctgggcctgaaacgggtcgtcacggacaagcacttctacttcaacgccaccaagggcttcccctgcctcaagaaggcccagggcggcagccgtccccgctgcctgggcaagtccaagggccggccacacccacgcgtgccccaggccgtggtccggcgcctgcaggagttctaccggcccttcaaccgcaggttctaccagatgacgggccaggacttcggctggggctga

SEQ ID NO: 59647 - DNA, 771 bp, Homo sapiens
ctccactgcaaccacccagagccatggctccccgaggctgcatcgtagctgtctttgccattttctgcatctccaggctcctctgctcacacggagccccagtggcccccatgactccttacctgatgctgtgccagccacacaagagatgtggggacaagttctacgaccccctgcagcactgttgctatgatgatgccgtcgtgcccttggccaggacccagacgtgtggaaactgcaccttcagagtctgctttgagcagtgctgcccctggaccttcatggtgaagctgataaaccagaactgcgactcagcccggacctcggatgacaggctttgtcgcagtgtcagctaatggaacatcaggggaacgatgactcctggattctccttcctgggtgggcctggagaaagaggctggtgttacctgagatctgggatgctgagtggctgtttgggggccagagaaacacacactcaactgcccacttcattctgtgacctgtctgaggcccaccctgcagctgccctgaggaggcccacaggtccccttctagaattctggacagcatgagatgcgtgtgctgatgggggcccagggactctgaaccctcctgatgacccctatggccaacatcaacccggcaccaccccaaggctggctggggaacccttcacccttctgtgagattttccatcatctcaagttctcttctatccaggagcaaagcacaggatcataataaatttatgtactttataaatgaaaa

SEQ ID NO: 59648 - DNA, 894 bp, Homo sapiens
tttgggtttggacgggtgcgtttgtttttcatagtgcaggtctggagccggactgagatggggagtagagggaccccttgaaacttcagggtggatgaatatgaagtttcatcaccagctgtgatgtttgatattggactgtggttgtgccagttgacactcaggagtggagactagatctgcaatctgttgggactgtgatgaggggatcatcctgccctcgaaccagacccagccctgtagcccaggcactattgcctggagttcctgggctctcagcgccaggaaatcatgaggttcagtgtctcaggcatgaggaccgactaccccaggagtgtgctggctcctgcttatgtgtcagtctgtctcctcctcttgtgtccaagggaagtcatcgctcccgctggctcagaaccatggctgtgccagccggcacccaggtgtggagacaagatctacaaccccttggagcagtgctgttacaatgacgccatcgtgtccctgagcgagacccgccaatgtggtcccccctgcaccttctggccctgctttgagctctgctgtcttgattcctttggcctcacaaacgattttgttgtgaagctgaaggttcagggtgtgaattcccagtgccactcatctcccatctccagtaaatgtgaaagcagaagacgttttccctgagaagacatagaaagaaaatcaactttcactaaggcatctcagaaacataggctagggtaatatgtgtaccagtagagaagcctgaggaatttacaaaatgatgcagctccaagccattgtatggcccatgtgggagactgatgggacatggagaatgacagtagattatcaggaaataaataaagtggtttttccaatgtaaaaaaaaaa

SEQ ID NO: 59649 - DNA, 662 bp, Homo sapiens
attctcctagagcatctttggaagcatgaggccacgatgctgcatcttggctcttgtctgctggataacagtcttcctcctccagtgttcaaaaggaactacagacgctcctgttggctcaggactgtggctgtgccagccgacacccaggtgtgggaacaagatctacaacccttcagagcagtgctgttatgatgatgccatcttatccttaaaggagacccgccgctgtggctccacctgcaccttctggccctgctttgagctctgctgtcccgagtcttttggcccccagcagaagtttcttgtgaagttgagggttctgggtatgaagtctcagtgtcacttatctcccatctcccggagctgtaccaggaacaggaggcacgtcctgtacccataaaaaccccaggctccactggcagacggcagacaaggggagaagagacgaagcagctggacatcggagactacagttgaacttcggagagaagcaacttgacttcagagggatggctcaatgacatagctttggagaggagcccagctggggatggccagacttcaggggaagaatgccttcctgcttcatcccctttccagctccccttcccgctgagagccactttcatcggcaataaaatcccccacatttaccatct

SEQ ID NO: 59650 - DNA, 2717 bp, Homo sapiens
cgctgggaatcctgctcctcctcaggtcctggcagtttcagggcccctccctaggccttacttaaaaggctgaggcatccttggaggaacaggcagactccacagctcccgccaggagaaaggaacattctgaggggagtctacaccctgtggagctcaagatggtcctgagtggggcgctgtgcttccgaatgaaggactcggcattgaaggtgctttatctgcataataaccagcttctagctggagggctgcatgcagggaaggtcattaaaggtgaagagatcagcgtggtccccaatcggtggctggatgccagcctgtcccccgtcatcctgggtgtccagggtggaagccagtgcctgtcatgtggggtggggcaggagccgactctaacactagagccagtgaacatcatggagctctatcttggtgccaaggaatccaagagcttcaccttctaccggcgggacatggggctcacctccagcttcgagtcggctgcctacccgggctggttcctgtgcacggtgcctgaagccgatcagcctgtcagactcacccagcttcccgagaatggtggctggaatgcccccatcacagacttctacttccagcagtgtgactagggcaacgtgccccccagaactccctgggcagagccagctcgggtgaggggtgagtggaggagacccatggcggacaatcactctctctgctctcaggacccccacgtctgacttagtgggcacctgaccactttgtcttctggttcccagtttggataaattctgagatttggagctcagtccacggtcctcccccactggatggtgctactgctgtggaatcttgtaaaaaccatgtggggtaaactgggaataacatgaaaagatttctgtggaggtggggtgggggagtggtgggaatcattcctgcttaatggtaactgaccagtgttaccctgagccccgcaggccaacccatccccagttgagccttatagggtcagtagctctccacatgaagacctgtcactcaccactatgcaggagagggaggtggtcatagagtcagggatctatggcccttggcccagccccacctccttccctttaatcctgccactgtcatatgctacctttcctatctcttccctcatcatcttgttgtgggcatgaggaggtgctgatgtcagaagaaatggctcgagctcagaagataaaagataagtagggtatgctgatcctcttttaaaaacccaagatacaatcaaaatcccagatgctggtctctattcccatgaaaaagtgctcatgacatattgagaagacctacttacaaagtggcatatattgcaatttattttaattaaaagatacctatttatatatttctttatagaaaaaagtctggaagagtttacttcaattgtagcaatgtcagggtggtggcagtataggtgatttttcttttaattctgttaatttacctgtatttcctaatttttctacaatgaagatgaattccttgtataaaaataagaaaagaaattaatcttgaggtaagcagagtagacatcatctctgattgtcctcagcctccacttccccagagtaaattcaaattgaatcgagctctgctgctctggttggttgtagtagtgatcaggaaacagatctcagcaaagccactgaggaggaggctgtgctgagtttgtgtggctggaatctctgggtaaggaacttaaagaacaaaaatcatctggtaattctttcctagaaggatcacagcccctgggattccaaggcattggatccagtctctaagaaggctgctgtactggttgaattgtgtccccctcaaattcacatccttcttggaatctcagtctgtgagtttatttggagataaggtctctgcagatgtagttagttaagacaaggtcatgctggatgaaggtagacctaaattcaatatgactggtttccttgtatgaaaaggagaggacacagagacagaggagatgcggggaagactatgtaaagatgaaggcagagatcggagttttgcagccacaagctaagaaacaccaaggattgtggcaaccatcagaagcttggaagaggcaaagaagaattcttccctagaggctttagagggataacggctctgctgaaaccttaatctcagacttccagcctcctgaacgaagaaagaataaatttcggctgttttaagccaccaaggataattggttacagcagctctaggaaactaatacagctgctaaaatgatccctgtctcctcgtgtttacattctgtgtgtgtcccctcccacaatgtaccaaagttgtctttgtgaccaatagaatatggcagaagtgatggcatgccacttccaagattaggttataaaagacactgcagcttctacttgagccctctctctctgccacccaccgcccccaatctatcttggctcactcgctctgggggaagctagctgccatgctatgagcaggcctataaagagacttacgtggtaaaaaatgaagtctcctgcccacagccacattagtgaacctagaagcagagactctgtgagataatcgatgtttgttgttttaagttgctcagttttggtctaacttgttatgcagcaatagataaataatatgcagagaaagagaaaaaaaaaaaaaaaaaaaaaaaa

SEQ ID NO: 59651 - DNA, 2689 bp, Homo sapiens
ggagagtcccacctctaacatctcctgtaggcctggcaatggcaggcaggaaagacagaggaaggaaggagggagaagggaaggagtgaaggaaggagtgaaaaaggggagtctacaccctgtggagctcaagatggtcctgagtggggcgctgtgcttccgaatgaaggactcggcattgaaggtgctttatctgcataataaccagcttctagctggagggctgcatgcagggaaggtcattaaaggtgaagagatcagcgtggtccccaatcggtggctggatgccagcctgtcccccgtcatcctgggtgtccagggtggaagccagtgcctgtcatgtggggtggggcaggagccgactctaacactagagccagtgaacatcatggagctctatcttggtgccaaggaatccaagagcttcaccttctaccggcgggacatggggctcacctccagcttcgagtcggctgcctacccgggctggttcctgtgcacggtgcctgaagccgatcagcctgtcagactcacccagcttcccgagaatggtggctggaatgcccccatcacagacttctacttccagcagtgtgactagggcaacgtgccccccagaactccctgggcagagccagctcgggtgaggggtgagtggaggagacccatggcggacaatcactctctctgctctcaggacccccacgtctgacttagtgggcacctgaccactttgtcttctggttcccagtttggataaattctgagatttggagctcagtccacggtcctcccccactggatggtgctactgctgtggaatcttgtaaaaaccatgtggggtaaactgggaataacatgaaaagatttctgtggaggtggggtgggggagtggtgggaatcattcctgcttaatggtaactgaccagtgttaccctgagccccgcaggccaacccatccccagttgagccttatagggtcagtagctctccacatgaagacctgtcactcaccactatgcaggagagggaggtggtcatagagtcagggatctatggcccttggcccagccccacctccttccctttaatcctgccactgtcatatgctacctttcctatctcttccctcatcatcttgttgtgggcatgaggaggtgctgatgtcagaagaaatggctcgagctcagaagataaaagataagtagggtatgctgatcctcttttaaaaacccaagatacaatcaaaatcccagatgctggtctctattcccatgaaaaagtgctcatgacatattgagaagacctacttacaaagtggcatatattgcaatttattttaattaaaagatacctatttatatatttctttatagaaaaaagtctggaagagtttacttcaattgtagcaatgtcagggtggtggcagtataggtgatttttcttttaattctgttaatttacctgtatttcctaatttttctacaatgaagatgaattccttgtataaaaataagaaaagaaattaatcttgaggtaagcagagtagacatcatctctgattgtcctcagcctccacttccccagagtaaattcaaattgaatcgagctctgctgctctggttggttgtagtagtgatcaggaaacagatctcagcaaagccactgaggaggaggctgtgctgagtttgtgtggctggaatctctgggtaaggaacttaaagaacaaaaatcatctggtaattctttcctagaaggatcacagcccctgggattccaaggcattggatccagtctctaagaaggctgctgtactggttgaattgtgtccccctcaaattcacatccttcttggaatctcagtctgtgagtttatttggagataaggtctctgcagatgtagttagttaagacaaggtcatgctggatgaaggtagacctaaattcaatatgactggtttccttgtatgaaaaggagaggacacagagacagaggagatgcggggaagactatgtaaagatgaaggcagagatcggagttttgcagccacaagctaagaaacaccaaggattgtggcaaccatcagaagcttggaagaggcaaagaagaattcttccctagaggctttagagggataacggctctgctgaaaccttaatctcagacttccagcctcctgaacgaagaaagaataaatttcggctgttttaagccaccaaggataattggttacagcagctctaggaaactaatacagctgctaaaatgatccctgtctcctcgtgtttacattctgtgtgtgtcccctcccacaatgtaccaaagttgtctttgtgaccaatagaatatggcagaagtgatggcatgccacttccaagattaggttataaaagacactgcagcttctacttgagccctctctctctgccacccaccgcccccaatctatcttggctcactcgctctgggggaagctagctgccatgctatgagcaggcctataaagagacttacgtggtaaaaaatgaagtctcctgcccacagccacattagtgaacctagaagcagagactctgtgagataatcgatgtttgttgttttaagttgctcagttttggtctaacttgttatgcagcaatagataaataatatgcagagaaagagaaaaaaaaaaaaaaaaaaaaaaaa

SEQ ID NO: 59652 - DNA, 787 bp, Homo sapiens
cttcattccattttctgttgagtaataaactcaacgttgaaaatgtcctttgtgggggagaactcaggagtgaaaatgggctctgaggactgggaaaaagatgaaccccagtgctgcttagaagacccggctggaagccccctggaaccaggcccaagcctccccaccatgaattttgttcacacaagtccaaaggtgaagaacttaaacccgaagaaattcagcattcatgaccaggatcacaaagtactggtcctggactctgggaatctcatagcagttccagataaaaactacatacgcccagagatcttctttgcattagcctcatccttgagctcagcctctgcggagaaaggaagtccgattctcctgggggtctctaaaggggagttttgtctctactgtgacaaggataaaggacaaagtcatccatcccttcagctgaagaaggagaaactgatgaagctggctgcccaaaaggaatcagcacgccggcccttcatcttttatagggctcaggtgggctcctggaacatgctggagtcggcggctcaccccggatggttcatctgcacctcctgcaattgtaatgagcctgttggggtgacagataaatttgagaacaggaaacacattgaattttcatttcaaccagtttgcaaagctgaaatgagccccagtgaggtcagcgattaggaaactgccccattgaacgccttcctcgctaatttgaactaattgtataaaaacaccaaacctgctcactaaaaaaaaaaaaaaaaaa

SEQ ID NO: 59653 - DNA, 724 bp, Homo sapiens
cttcattccattttctgttgagtaataaactcaacgttgaaaatgtcctttgtgggggagaactcaggagtgaaaatgggctctgaggactgggaaaaagatgaaccccagtgctgcttagaaggtccaaaggtgaagaacttaaacccgaagaaattcagcattcatgaccaggatcacaaagtactggtcctggactctgggaatctcatagcagttccagataaaaactacatacgcccagagatcttctttgcattagcctcatccttgagctcagcctctgcggagaaaggaagtccgattctcctgggggtctctaaaggggagttttgtctctactgtgacaaggataaaggacaaagtcatccatcccttcagctgaagaaggagaaactgatgaagctggctgcccaaaaggaatcagcacgccggcccttcatcttttatagggctcaggtgggctcctggaacatgctggagtcggcggctcaccccggatggttcatctgcacctcctgcaattgtaatgagcctgttggggtgacagataaatttgagaacaggaaacacattgaattttcatttcaaccagtttgcaaagctgaaatgagccccagtgaggtcagcgattaggaaactgccccattgaacgccttcctcgctaatttgaactaattgtataaaaacaccaaacctgctcactaaaaaaaaaaaaaaaaaa

SEQ ID NO: 59654 - DNA, 604 bp, Homo sapiens
cttcattccattttctgttgagtaataaactcaacgttgaaaatgtcctttgtgggggagaactcaggagtgaaaatgggctctgaggactgggaaaaagatgaaccccagtgctgcttagaagagatcttctttgcattagcctcatccttgagctcagcctctgcggagaaaggaagtccgattctcctgggggtctctaaaggggagttttgtctctactgtgacaaggataaaggacaaagtcatccatcccttcagctgaagaaggagaaactgatgaagctggctgcccaaaaggaatcagcacgccggcccttcatcttttatagggctcaggtgggctcctggaacatgctggagtcggcggctcaccccggatggttcatctgcacctcctgcaattgtaatgagcctgttggggtgacagataaatttgagaacaggaaacacattgaattttcatttcaaccagtttgcaaagctgaaatgagccccagtgaggtcagcgattaggaaactgccccattgaacgccttcctcgctaatttgaactaattgtataaaaacaccaaacctgctcactaaaaaaaaaaaaaaaaaa

SEQ ID NO: 59655 - DNA, 667 bp, Homo sapiens
cttcattccattttctgttgagtaataaactcaacgttgaaaatgtcctttgtgggggagaactcaggagtgaaaatgggctctgaggactgggaaaaagatgaaccccagtgctgcttagaagacccggctggaagccccctggaaccaggcccaagcctccccaccatgaattttgttcacacaaagatcttctttgcattagcctcatccttgagctcagcctctgcggagaaaggaagtccgattctcctgggggtctctaaaggggagttttgtctctactgtgacaaggataaaggacaaagtcatccatcccttcagctgaagaaggagaaactgatgaagctggctgcccaaaaggaatcagcacgccggcccttcatcttttatagggctcaggtgggctcctggaacatgctggagtcggcggctcaccccggatggttcatctgcacctcctgcaattgtaatgagcctgttggggtgacagataaatttgagaacaggaaacacattgaattttcatttcaaccagtttgcaaagctgaaatgagccccagtgaggtcagcgattaggaaactgccccattgaacgccttcctcgctaatttgaactaattgtataaaaacaccaaacctgctcactaaaaaaaaaaaaaaaaaa

SEQ ID NO: 59656 - DNA, 667 bp, Homo sapiens
atgtcaggctgtgataggagggaaacagaaaccaaaggaaagaacagctttaagaagcgcttaagaggtccaaaggtgaagaacttaaacccgaagaaattcagcattcatgaccaggatcacaaagtactggtcctggactctgggaatctcatagcagttccagataaaaactacatacgcccagagatcttctttgcattagcctcatccttgagctcagcctctgcggagaaaggaagtccgattctcctgggggtctctaaaggggagttttgtctctactgtgacaaggataaaggacaaagtcatccatcccttcagctgaagaaggagaaactgatgaagctggctgcccaaaaggaatcagcacgccggcccttcatcttttatagggctcaggtgggctcctggaacatgctggagtcggcggctcaccccggatggttcatctgcacctcctgcaattgtaatgagcctgttggggtgacagataaatttgagaacaggaaacacattgaattttcatttcaaccagtttgcaaagctgaaatgagccccagtgaggtcagcgattaggaaactgccccattgaacgccttcctcgctaatttgaactaattgtataaaaacaccaaacctgctcactaaaaaaaaaaaaaaaaaa

SEQ ID NO: 59657 - DNA, 5925 bp, Homo sapiens
gcgctgcccgcctcgtccccacccccccaacccccgcgcccgccctcggacagtccctgctcgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactggctgcggctggaagttcgagcccctgctgggggaggagctggacctgcggcgcgtcacgtggcggctgcccccggagctcatcccgcgcctgtcggccagcagcgggcgctcctccgacgccgaggcgccccacgggcccccggacgacggcggcgcgggcgggaagggcggcagcctgccccgcagtgcgacacccgggccccccggagagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgctaaaaaaa

SEQ ID NO: 59658 - DNA, 5695 bp, Homo sapiens
ggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacggcctccctcccatctgggaacacgggaggagcaggcttccgctgtcctgggccctggggtcccggagtcgggctcagatgaaagggttccccccttccaggggcccacgagactctataatcctggctgggaggccagcagcgccctcctggggcccagactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgctaaaaaaa

SEQ ID NO: 59659 - DNA, 5715 bp, Homo sapiens
gcgctgcccgcctcgtccccacccccccaacccccgcgcccgccctcggacagtccctgctcgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgctaaaaaaa

SEQ ID NO: 59660 - DNA, 2165 bp, Homo sapiens
ctctgcctcagccttactgtgagtctggttgacagtagcttctaagatgtcccagcaacacacactgccagtgaccctctcccctgccctcagtcaggagctcctcaagactgttcctcctccagtcaatacccatcaggagcaaatgaaacagccaactccactgcctcccccatgccagaaggtgcctgtcgagctcccagtggaggtcccatcaaagcaagaggaaaagcacatgactgctgtaaagggactgcctgagcaagaatgtgagcaacagcagaaggagccacaggagcaggagctgcagcaacagcactgggaacagcatgaggaatatcagaaagcagaaaacccagagcagcagcttaagcaggagaaaacacaaagggatcagcagctaaacaaacagctggaagaagagaagaagctcttagaccagcaactggatcaagagctagtcaagagagatgagcaactgggaatgaagaaagagcaactgttggagctcccagagcagcaggaggggcacctgaagcacctagagcagcaggagggacagctgaagcacccggagcagcaggaggggcagctggagctcccagagcagcaggaggggcagctggagctcccagagcagcaggaggggcagctggagctcccagagcagcaggaggggcagctggagctcccagagcagcaggaggggcagctggagctcccagagcagcaggaggggcagctggagctcccacagcagcaggaggggcagctggagctctctgagcagcaggaggggcagctggagctctctgagcagcaggagggacagctgaagcacctggagcaccaggaggggcagctggaggtcccagaggagcagatggggcagctgaagtacctggaacagcaggaggggcagctgaagcacctggatcagcaggagaagcagccagagctcccagagcagcagatggggcagctgaagcacctggagcagcaggaggggcagcctaagcatctggagcagcaggaggggcaactggagcagctggaggagcaggaggggcagctgaagcacctggagcagcaggaggggcagctggagcacctggagcaccaggaagggcagctggggctcccagagcagcaggtgctgcagctgaagcagctagagaagcagcaggggcagccaaagcacctggaggaggaggaggggcagctgaagcacctggtgcagcaggaggggcagctgaagcatctggtgcagcaggaggggcagctggagcagcaggagaggcaggtggagcacctggagcagcaggtggggcagctgaagcacctagaggagcaggagggacaactgaagcatctggagcagcagcaggggcagttggaggtcccagagcagcaggtggggcagccaaagaacctggagcaggaggagaagcaactggagctcccagagcagcaagagggccaggtgaagcacctggagaagcaggaggcacagctggagctcccagagcagcaggtaggacagccaaagcacctggaacagcaggaaaagcacctagagcacccagagcagcaggacggacaactaaaacatctggagcagcaggaggggcagctgaaggacctggagcagcagaaggggcagctggagcagcctgtgtttgccccagctccaggccaggtccaagacattcaaccagccctgcccacaaagggagaagtattgcttcctgtagagcaccagcagcagaagcaggaggtgcagtggccacccaaacataaataaccacccgcagtgtccagaggccctcagatcgtctcatacaagggaagagagagccactggctccacttatttcgggtccgctaggtggcccgtctcatctgtgaacttgactctgtccctctacatgtctctttaatggggtgagggtgggggagagagggaattattgtccagtgccaaccccaatgaccccaatcccaacctcaggtgagcagagcctctacttgagggactattgttactataggaatccttacttccccagtattgaagctgaatcagtgagtgtgtacaatgatacataataaatcctggaagtcttgggatcctaaaaaaaaaaaaaaaaaaaaaaaaaaaaaaa

SEQ ID NO: 59661 - DNA, 1979 bp, Homo sapiens
agaaactcacacaccttgacaatctgtctgtccgtctgcagctgcgtgactgtctgtctctgccatgtctctctccccatgccgggcccagaggggcttcagcgctcgctcagcctgttctgctcgctcaaggggccgcagcaggggaggcttcagcagcaggggcggcttcagcagcaggagccttaattcctttggggggtgcctggaaggctctcgtgggagtacctgggggtcagggggtaggctgggggtgcggtttggggagtggagtggtgggcctgggctctccctgtgccctccggggggcatccaagaagtgaccatcaaccagaatccgctgaccccactgaagattgagatcgatccccagttccaggtggtgcggacgcaggagacccaggagatcagaaccctcaacaaccagtttgcttccttcattgacaaggtgcggttcctggagcagcagaacaaggtcctggagacgaagtggcatctgctgcagcaacaggggttgagtggcagccagcagggcctggagcctgtctttgaggcctgcctggatcagctcaggaagcagctggagcagctccagggagaacgaggggctctggatgctgagttgaaggcctgccgggaccaggaggaggagtataagtccaagtatgaggaggaggcccacaggcgtgccacacttgagaacgactttgtggtcctcaagaaggatgtggatggggttttcctgagcaagatggagttggagggcaagctggaggctctgagagagtacctctacttcttgaagcatctgaatgaagaagagctgggccagctccaggcccaggccagcgacacgtctgtggtgctgtccatggacaacaaccgctacctggacttcagcagcatcatcactgaggtccgcgcccggtacgaggagatcgcccggagcagcaaggctgaggctgaggccttgtaccagaccaagtaccaggaacttcaggtgtctgcccagcttcatggggacaggatgcaggaaacgaaagtccagatctctcagctacaccaagagattcagaggctgcagagtcagactgagaacctcaagaagcagaacgccagcctgcaggccgccatcactgatgctgagcagcgtggggagctggccctcaaggacgctcaggccaaggtggacgagctggaggctgctctgaggatggccaagcagaacctggcccggctgctgtgcgagtaccaggagctgacgagcacgaagctttccctggatgtggagattgccacttaccgcaggctgctggagggcgaggagtgcaggatgtctggggagtgcaccagccaggtcactatctcctcggtgggaggcagcgctgtcatgtctggaggagttggtggaggcttggggagcacttgtggactcggtagtgggaaaggcagccctgggtcctgctgcaccagcattgtgactggaggctccaacatcattctgggctctgggaaggaccctgttttggattcctgctctgtgtctggctccagcgctggctccagctgccacaccatcctgaagaagacagttgagtcgagtctgaagacatccatcacctactgagcgacccagcagccacctccttcctgaacacatttggcccactccccccatcagccggctctgcaaggccaactccgtgtccgctgcccacagcccaagccagcccacagcggatgctgcaaaaatcaataaagtctcccctcctgctgttctgaatgctctaagtgcttgcacacctcacccagcaaaacaaaagctgtgtggctccccagcttcctctcctcggaaggcaattgtggcatatctgtgtccagacgtgttctattggtatctcactccacatcccagccactctatcaaggaaactaaattcatccaaggtagttcaattaaattgactttttgaaaaagt

SEQ ID NO: 59662 - DNA, 2856 bp, Homo sapiens
ccttggagactgcttttctccagctctgtcaactcaacctttcccaccatgagtcggcaactgaacatcaagtccagtggtgacaagggcaacttcagtgtgcattcggcagtggtgccaaggaaggctgtgggtagcctggcttcttactgtgcagctggcagaggggctggcgctggctttggcagtcggagcctctatagccttggagggaatcggcgtatttctttcaatgtggctggtggcggcgttcgggctggaggttacggcttcaggcctggctctgggtatggagggggccgggccagtggctttgctggcagtatgtttggcagtgtggccctggggcctgcatgtttgtctgtgtgcccacctgggggcatccaccaggtcactgtcaacaagagcctcttggcccccctcaacgtggagctggaccctgagatccagaaggtgcgcgcccaggagcgggaacagatcaaggtgctgaacgacaagttcgcctccttcattgacaaggtacgcttcctagagcagcagaaccaggttctagaaaccaagtgggagctgctgcagcagctggacctgaacaactgcaagaagaacctggagcccatccttgagggctacatcagcaacctgcggaagcagctggagacactgtctggggacagggtgaggctggactcggagctgagaagcatgagggatctggtggaggactataagaagagatatgaggtggagattaaccggcgcacaacagcagagaatgagtttgtggtgcttaagaaggatgcagatgcagcctacgcagtcaaggtggagcttcaggccaaagtggactcactggacaaagacatcaagttcctcaagtgtctgtatgatgcagagatcgctcagatccagactcacgccagtgagacctctgtcatcctgtccatggacaacaaccgggacctggaccttgacagcatcatcgctgaggtccgcatgcattatgaggagatcgccctgaagagcaaggccgaggccgaggccctgtaccagaccaagatccaggagctgcagctggcagccagtcggcatggtgacgacctgaaacacaccaggagcgagatggtggagctgaaccggctcatccagaggatccggtgtgagatcgggaatgtgaagaagcagcgtgccagcctggagacggccatcgctgacgctgagcagcggggagacaatgccctgaaggatgcccaggccaagctggatgagctggagggcgccctgcaccaggccaaggaggagctggcgcggatgctgcgcgagtaccaggagctcatgagcctgaaactggccctggacatggagattgccacctaccgcaagctgctggagggcgaggagtgcaggatgtctggtgagaatccatcctctgtgagcatctctgtcatcagcagtagcagctacagctaccaccaccccagctctgcgggtgttgaccttggggccagcgctgtggcaggcagctctggcagcacccagagcgggcagaccaagaccacagaggcgcgagggggagacctcaaggacacccagggcaagagcaccccagccagcatcccagcaaggaaagccacccgctagacccatggcctcacccacctcagcacttggaagaagaggtgactttgccacccccaaaggtgtctgccacacccaagttcccaggccctgagttttaaaactgtctgtagtacactcaactgtctgcatcgtggtttagcttttactttcaagctctgattgacacagtcaccttccctgtttccttaggtcccatgtggactaacgacttctcattttcctcgctgcctttggctggcaggaggctttggaggcacaagccattataaccttcttggccctaaggaagctgtgatcatccctagaaagagggaaggagcaggagacgacaggggaggggctggtttgttctgtgcttaggccaagttagctactgtctgagaggttttacatcccctgccagcatggtggggtgacacgagacctgtaagcaggtggtgagaagttagacagcctttacttgctccatcagaaacaactttgcaggatgacgccaatatttaggacaccacgtgtacatctgtagaccaccagctgcacccatctccacaaagccaagtgaaggtgtattggggattctctgccagcctgtgtcacccacccacctccttcattatcagcaatagctaccatcatttgtcaagcacctactagatgccagacaccctacacatattgcctcctattctcatccattcctgcaaagaagatgcaatgagcatccttggaacagactgggagcctgatcccaagaggctgctgaactggccccagtcacccacctatgtgccagagtcaggcctggccgacacaaggatctatgctttttctgtggtgtgtcactgcctttttaacaaaagggctgtcaaagtcaccattctttttgatgagggcagcgtaattacattgccttttgtcaggactgtgggtatgtgatttgtcttccacagtctctctggggctgtgtcctacatagcttctgactctcaatttttggtgccatgagctgagctcagtgagtggagctggcttttctgtcgctgagtggtactgcctagtccagatgtcgtggctcagggtgtaaatattcctaagaatggcagcatctatttcctcttttgtttgaattaaagactctgaatttctgctgaaaaaaaaaaaaaaaaaaaaaaaaaaaaaaaaaaaaaaaaaaaaaaaaaaaaaaaaaaaaaaaaaaaa

SEQ ID NO: 59663 - DNA, 1796 bp, Homo sapiens
gcctggagctagcctgggggcgagccagggtcccccaacccccgggatgaccgcggccagccgggccaacccctacagcatcgtgtcatcggaggaggacgggctgcacctggtcaccatgtcgggcgccaacggcttcggcaacggcaaggtgcacacgcggcgcaggtgccgcaaccgcttcgtcaagaagaatggccagtgcaacattgagttcgccaacatggacgagaagtcacagcgctacctggctgacatgttcaccacctgtgtggacatccgctggcggtacatgctgctcatcttctcgctggccttccttgcctcctggctgctgttcggcatcatcttctgggtcatcgcggtggcacacggtgacctggagccggctgagggccggggccgcacaccctgtgtgatgcaggtgcacggcttcatggcggccttcctcttctccatcgagacgcagaccaccatcggctacgggctgcgctgtgtgacggaggagtgcccggtggccgtcttcatggtggtggcccagtccatcgtgggctgcatcatcgactccttcatgattggtgccatcatggccaagatggcaaggcccaagaagcgggcacagacgctgctgttcagccacaacgccgtggtggccctgcgtgacggcaagctctgcctcatgtggcgtgtgggtaacctgcgcaagagccacattgtggaggcccatgtgcgcgcgcagctcatcaagccgcgggtcaccgaggagggcgagtacatcccgctggaccagatcgacatcgatgtgggcttcgacaagggcctggaccgcatctttctggtgtcgcccatcaccatcttgcatgagattgacgaggccagcccgctcttcggcatcagccggcaggacctggagacggacgactttgagatcgtggtcatcctggaaggcatggtggaggccacagccatgaccacccaggcccgcagctcctacctggccaatgagatcctgtggggtcaccgctttgagcccgtgctcttcgaggagaagaaccagtacaagattgactactcgcacttccacaagacctatgaggtgccctctacgccccgctgcagtgcgaaggatctggtagagaacaagttcctgctgcccagcgccaactccttctgctacgagaacgagctggccttcctgagccgtgacgaggaggatgaggcggacggagaccaggacggccgaagccgggacggcctcagcccccaggccaggcatgactttgacagactccaggctggcggcggggtcctggagcagcggccctacagacgggagtcagagatctgagccaaccttggccgacatgcagcatccacccccggctggggagaggccccgcggtcgctcaggggccccgggtttgagcagaacgggcccagtgccctgggttgcagactcagtagcgttttagtcgttttatgtttctttgcaacggcctcagaagtttggccggagagggggcagccagagcggcagcccccggcctcagaggctatcacaggctcagggcaaagaagtggcctcctggggggccaggccacgagggccagggcttctgcctgaagatggagctgcagcctgcggggaagcagctcagctcgatggtgggcccagcctctgctgtccaaggctggctagctgcggtgctccttgctggtttttaacttggggagaaacaccgggtttcagctttcttgaccttagcttgggtgagactgtttacaaaaaaaaaaaa

SEQ ID NO: 59664 - DNA, 1820 bp, Homo sapiens
aggatgggtggagcagggaagagccaggatggggagaagttaggggtcctgatggccattatgggaatagaggctgggggccaactgactggcccgggcaatgattccccaaacccctcaccattgctccccaggagcagcaatgtctgtgcaggtagcggctcctggaagtgcagggctgggcccagagcgcctgagccctgaggagctggtgcggcagacgcggcaagtggtccaggggctggaggcgctgcgggcagagcaccatggcctggctgggcacctggcggaggccctggcgggacagggcccggcagccggcttggagatgctggaggaaaagcagcaggtggtgagccactcgctggaggccatcgagctggggctgggcgaggcccaggtgctgctggccctgtcggcacatgtgggtgcactggaggcagagaagcagcggctgcgctcgcaggcccggcggctggcccaggagaacgtgtggctgcgggaggaactggaggagacgcagcggcggcttcgggccagcgaggagtccgtggcccagctggaggaggagaagcgccacctggagttcctggggcagctgcgacagtacgacccaccggcggagagccagcagtctgagtccccgcctcgccgagacagcctggcctccctgttccccagcgaggaggaggagaggaaaggtcctgaggccgcaggagcagcagctgctcagcagggtggctatgagatccctgcccgccttcggaccctgcataacctcgtgatccagtacgcggggcagggccgctatgaggtggcggtgcctctgtgccgccaggccttggaggacctggagcgcagctcgggccactgccaccctgacgtggccaccatgctcaacatcctggcgctggtgtaccgggaccagaacaagtacaaagaagccacagaccttctccatgatgccctgcagatccgggagcagacgctgggccctgagcaccccgcggtggccgccacgctcaacaacttggctgtcctctatgggaagcgtgggcgttaccgggaggcagagcccctgtgccagcgcgctttggagatccgagagaaggtcctgggtgctgaccacccagatgtggccaagcagctcaacaacctggccctgctgtgccagaaccagggcaagtttgaggacgcggagcggcactatgcccgggccctgagcatctatgaggcactgggcgggccccatgaccccaacgtggccaagaccaagaacaacctggcctcagcctacctgaaacagaacaagtatcaacaagcggaagagctgtacaaagaaatcctccacaaggaggacctacccgcccctctcggtgcccccaacacaggcacagctggtgacgcagaacaggcccttcgccgcagcagctcactctccaagatccgtgagtctatcaggcgaggaagtgagaagctggtctcccggctccgaggcgaggcggcggcaggagcagccggaatgaagagagccatgtcactcaacacactgaacgtggatgctccaagggctcctgggactcagtttcccagctggcacctggacaaggcccctcggaccctcagcgccagcacccaggacctgagcccccactaacgtccagtgaactgcgctggccgcagcttcttgggaacagtgcaggagggatgggctggtggggtgagagggggtctatcatctcctggcccccccttgcctctgggtacctggtggatagctgccttctcctgcgattaaaggctgtggacgtgacagtgag

SEQ ID NO: 59665 - DNA, 1528 bp, Homo sapiens
ggaaggcacaggcctgagaagtctgcggctgagctgggagcaaatcccccaccccctacctgggggacagggcaagtgagacctggtgagggtggctcagcaggaagggaaggagaggtgtctgtgcgtcctgcacccacatctttctctgtcccctccttgccctgtctggaggctgctagactcctatcttctgaattctatagtgcctgggtctcagcgcagtgccgatggtggcccgtccttgtggttcctctctacctggggaaataaggtgcagcggccatggctacagcaagacccccctggatgtgggtgctctgtgctctgatcacagccttgcttctgggggtcacagagcatgttctcgccaacaatgatgtttcctgtgaccacccctctaacaccgtgccctctgggagcaaccaggacctgggagctggggccggggaagacgcccggtcggatgacagcagcagccgcatcatcaatggatccgactgcgatatgcacacccagccgtggcaggccgcgctgttgctaaggcccaaccagctctactgcggggcggtgttggtgcatccacagtggctgctcacggccgcccactgcaggaagaaagttttcagagtccgtctcggccactactccctgtcaccagtttatgaatctgggcagcagatgttccagggggtcaaatccatcccccaccctggctactcccaccctggccactctaacgacctcatgctcatcaaactgaacagaagaattcgtcccactaaagatgtcagacccatcaacgtctcctctcattgtccctctgctgggacaaagtgcttggtgtctggctgggggacaaccaagagcccccaagtgcacttccctaaggtcctccagtgcttgaatatcagcgtgctaagtcagaaaaggtgcgaggatgcttacccgagacagatagatgacaccatgttctgcgccggtgacaaagcaggtagagactcctgccagggtgattctggggggcctgtggtctgcaatggctccctgcagggactcgtgtcctggggagattacccttgtgcccggcccaacagaccgggtgtctacacgaacctctgcaagttcaccaagtggatccaggaaaccatccaggccaactcctgagtcatcccaggactcagcacaccggcatccccacctgctgcagggacagccctgacactcctttcagaccctcattccttcccagagatgttgagaatgttcatctctccagcccctgaccccatgtctcctggactcagggtctgcttcccccacattgggctgaccgtgtctctctagttgaaccctgggaacaatttccaaaactgtccagggcgggggttgcgtctcaatctccctggggcactttcatcctcaagctcagggcccatcccttctctgcagctctgacccaaatttagtcccagaaataaactgagaagtggaaaaaaaaaaaaaaaaaaaaaaaaaaaaaaaaaaa

SEQ ID NO: 59666 - DNA, 1927 bp, Homo sapiens
tgccagcccaagtcggaacttggatcacatcagatcctctcgagctccagcaggagaggcccttcctcgcctggcagcccctgagcggctcagcagggcaccatggcaagatcccttctcctgcccctgcagatcttactgctatccttagccttggaaactgcaggagaagaagcccagggtgacaagattattgatggcgccccatgtgcaagaggctcccacccatggcaggtggccctgctcagtggcaatcagctccactgcggaggcgtcctggtcaatgagcgctgggtgctcactgccgcccactgcaagatgaatgagtacaccgtgcacctgggcagtgatacgctgggcgacaggagagctcagaggatcaaggcctcgaagtcattccgccaccccggctactccacacagacccatgttaatgacctcatgctcgtgaagctcaatagccaggccaggctgtcatccatggtgaagaaagtcaggctgccctcccgctgcgaaccccctggaaccacctgtactgtctccggctggggcactaccacgagcccagatgtgacctttccctctgacctcatgtgcgtggatgtcaagctcatctccccccaggactgcacgaaggtttacaaggacttactggaaaattccatgctgtgcgctggcatccccgactccaagaaaaacgcctgcaatggtgactcagggggaccgttggtgtgcagaggtaccctgcaaggtctggtgtcctggggaactttcccttgcggccaacccaatgacccaggagtctacactcaagtgtgcaagttcaccaagtggataaatgacaccatgaaaaagcatcgctaacgccacactgagttaattaactgtgtgcttccaacagaaaatgcacaggagtgaggacgccgatgacctatgaagtcaaatttgactttacctttcctcaaagatatatttaaaccaacctcatgccctgttgataaaccaatcaaattggtaaagacctaaaaccaaaacaaataaagaaacacaaaaccctcagtgctggagaagagtcagtgagaccagcactctcaaacactggaactggacgttcgtacagtctttacggaagacacttggtcaacgtacaccgagacccttattcaccacctttgacccagtaactctaatcttaggaagaacctactgaaacaaaaaaaatccaaaatgtagaacaagacttgaatttaccatgatattatttatcacagaaatgaagtgaaaccatcaaacatgttccaaaagtaccagatggcttaaataatagtctggcttggcacaacgatgttttttttctttgagacagagtctctgttgcttgggctgcaatgcagtgatgcaatcttggctcactgcaacctccgcctcctgggttcaagtgattctcgtgcttcagcctcccaagtacctgggactacaggtgtgcaccaccacaccaggctaattttttgtgtatttttactagagacagggtttcaccatgttggccagcgtggtcttgaacgcctgacctcagatgatccacccaccttggcctcccaaagtgctgggattacaggcatgagccaccacggccagcccacaatgatattacaaacctattaaaaatgatacttagacagaattgtcagtattattcaagaacatttaggctataggatgttaaatgacaaaaggaaggacaaaaatatatatgtatgtgaccctacccataaaaaatgaaatattcacagaatcagatctgaaaacacatgtcccagactgcatactggggtcgtcatgaggtgtctccttccttctgtgtacttttccttgaatgtgcacttttataacatgaaaaataaaggtggggaaaaaagtctgaaga

SEQ ID NO: 59667 - DNA, 1927 bp, Homo sapiens
ggagagggtgatgctggctccaagcctgactctgctctcgagagctccagcaggagaggcccttcctcgcctggcagcccctgagcggctcagcagggcaccatggcaagatcccttctcctgcccctgcagatcttactgctatccttagccttggaaactgcaggagaagaagcccagggtgacaagattattgatggcgccccatgtgcaagaggctcccacccatggcaggtggccctgctcagtggcaatcagctccactgcggaggcgtcctggtcaatgagcgctgggtgctcactgccgcccactgcaagatgaatgagtacaccgtgcacctgggcagtgatacgctgggcgacaggagagctcagaggatcaaggcctcgaagtcattccgccaccccggctactccacacagacccatgttaatgacctcatgctcgtgaagctcaatagccaggccaggctgtcatccatggtgaagaaagtcaggctgccctcccgctgcgaaccccctggaaccacctgtactgtctccggctggggcactaccacgagcccagatgtgacctttccctctgacctcatgtgcgtggatgtcaagctcatctccccccaggactgcacgaaggtttacaaggacttactggaaaattccatgctgtgcgctggcatccccgactccaagaaaaacgcctgcaatggtgactcagggggaccgttggtgtgcagaggtaccctgcaaggtctggtgtcctggggaactttcccttgcggccaacccaatgacccaggagtctacactcaagtgtgcaagttcaccaagtggataaatgacaccatgaaaaagcatcgctaacgccacactgagttaattaactgtgtgcttccaacagaaaatgcacaggagtgaggacgccgatgacctatgaagtcaaatttgactttacctttcctcaaagatatatttaaaccaacctcatgccctgttgataaaccaatcaaattggtaaagacctaaaaccaaaacaaataaagaaacacaaaaccctcagtgctggagaagagtcagtgagaccagcactctcaaacactggaactggacgttcgtacagtctttacggaagacacttggtcaacgtacaccgagacccttattcaccacctttgacccagtaactctaatcttaggaagaacctactgaaacaaaaaaaatccaaaatgtagaacaagacttgaatttaccatgatattatttatcacagaaatgaagtgaaaccatcaaacatgttccaaaagtaccagatggcttaaataatagtctggcttggcacaacgatgttttttttctttgagacagagtctctgttgcttgggctgcaatgcagtgatgcaatcttggctcactgcaacctccgcctcctgggttcaagtgattctcgtgcttcagcctcccaagtacctgggactacaggtgtgcaccaccacaccaggctaattttttgtgtatttttactagagacagggtttcaccatgttggccagcgtggtcttgaacgcctgacctcagatgatccacccaccttggcctcccaaagtgctgggattacaggcatgagccaccacggccagcccacaatgatattacaaacctattaaaaatgatacttagacagaattgtcagtattattcaagaacatttaggctataggatgttaaatgacaaaaggaaggacaaaaatatatatgtatgtgaccctacccataaaaaatgaaatattcacagaatcagatctgaaaacacatgtcccagactgcatactggggtcgtcatgaggtgtctccttccttctgtgtacttttccttgaatgtgcacttttataacatgaaaaataaaggtggggaaaaaagtctgaaga

SEQ ID NO: 59668 - DNA, 1013 bp, Homo sapiens
gttcccagaagctccccaggctctagtgcaggaggagaaggaggaggagcaggaggtggagattcccagttaaaaggctccagaatcgtgtaccaggcagagaactgaagtactggggcctcctccactgggtccgaatcagtaggtgaccccgcccctggattctggaagacctcaccatgggacgcccccgacctcgtgcggccaagacgtggatgttcctgctcttgctggggggagcctgggcaggacactccagggcacaggaggacaaggtgctggggggtcatgagtgccaaccccattcgcagccttggcaggcggccttgttccagggccagcaactactctgtggcggtgtccttgtaggtggcaactgggtccttacagctgcccactgtaaaaaaccgaaatacacagtacgcctgggagaccacagcctacagaataaagatggcccagagcaagaaatacctgtggttcagtccatcccacacccctgctacaacagcagcgatgtggaggaccacaaccatgatctgatgcttcttcaactgcgtgaccaggcatccctggggtccaaagtgaagcccatcagcctggcagatcattgcacccagcctggccagaagtgcaccgtctcaggctggggcactgtcaccagtccccgagagaattttcctgacactctcaactgtgcagaagtaaaaatctttccccagaagaagtgtgaggatgcttacccggggcagatcacagatggcatggtctgtgcaggcagcagcaaaggggctgacacgtgccagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaactctctggttc

SEQ ID NO: 59669 - DNA, 1148 bp, Homo sapiens
gttcccagaagctccccaggctctagtgcaggaggagaaggaggaggagcaggaggtggagattcccagttaaaaggctccagaatcgtgtaccaggcagagaactgaagtactggggcctcctccactgggtccgaatcagtaggtgaccccgcccctggattctggaagacctcaccatgggacgcccccgacctcgtgcggccaagacgtggatgttcctgctcttgctggggggagcctgggcagcgtgtggaagcctggacctcctcactaagttgtatgcggagaacttgccgtgtgtccatttgaacccacagtggccttcccagccctcgcactgccccagagggtggcgatccaaccctctccctcctgctgcaggacactccagggcacaggaggacaaggtgctggggggtcatgagtgccaaccccattcgcagccttggcaggcggccttgttccagggccagcaactactctgtggcggtgtccttgtaggtggcaactgggtccttacagctgcccactgtaaaaaaccgaaatacacagtacgcctgggagaccacagcctacagaataaagatggcccagagcaagaaatacctgtggttcagtccatcccacacccctgctacaacagcagcgatgtggaggaccacaaccatgatctgatgcttcttcaactgcgtgaccaggcatccctggggtccaaagtgaagcccatcagcctggcagatcattgcacccagcctggccagaagtgcaccgtctcaggctggggcactgtcaccagtccccgagagaattttcctgacactctcaactgtgcagaagtaaaaatctttccccagaagaagtgtgaggatgcttacccggggcagatcacagatggcatggtctgtgcaggcagcagcaaaggggctgacacgtgccagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaactctctggttc

SEQ ID NO: 59670 - DNA, 590 bp, Homo sapiens
gttcccagaagctccccaggctctagtgcaggaggagaaggaggaggagcaggaggtggagattcccagttaaaaggctccagaatcgtgtaccaggcagagaactgaagtactggggcctcctccactgggtccgaatcagtaggtgaccccgcccctggattctggaagacctcaccatgggacgcccccgacctcgtgcggccaagacgtggatgttcctgctcttgctggggggagcctgggcagagaattttcctgacactctcaactgtgcagaagtaaaaatctttccccagaagaagtgtgaggatgcttacccggggcagatcacagatggcatggtctgtgcaggcagcagcaaaggggctgacacgtgccagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaactctctggttc

SEQ ID NO: 59671 - DNA, 456 bp, Homo sapiens
gttcccagaagctccccaggctctagtgcaggaggagaaggaggaggagcaggaggtggagattcccagttaaaaggctccagaatcgtgtaccaggcagagaactgaagtactggggcctcctccactgggtccgaatcagtaggtgaccccgcccctggattctggaagacctcaccatgggacgcccccgacctcgtgcggccaagacgtggatgttcctgctcttgctggggggagcctgggcagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaactctctggttc

SEQ ID NO: 59672 - DNA, 1438 bp, Homo sapiens
catggaggaggaaggagatggcatggcttaccataaagaagcactggacgccgggtgcacgttccaggatccaggtgcccaggggtcatgaagctgggactcctctgtgctctgctctctctgctggcagggcatggctgggcagacacccgtgccatcggggccgaggaatgtcgccccaactcccagccttggcaggccggcctcttccaccttactcggctcttctgtggggcgaccctcatcagtgaccgctggctgctcacagctgcccactgccgcaagccgtatctgtgggtccgccttggagagcaccacctctggaaatgggagggtccggagcagctgttccgggttacggacttcttcccccaccctggcttcaacaaggacctcagcgccaatgaccacaatgatgacatcatgctgatccgcctgcccaggcaggcacgtctgagtcctgctgtgcagcccctcaacctcagccagacctgtgtctccccaggcatgcagtgtctcatctcaggctggggggccgtgtccagccccaaggcgctgtttccagtcacactgcagtgtgccaacatcagcatcctggagaacaaactctgtcactgggcataccctggacacatctcggacagcatgctctgtgcgggcctgtgggaggggggccgaggttcctgccagggtgactctgggggccccctggtttgcaatggaaccttggcaggcgtggtgtctgggggtgctgagccctgctccagaccccggcgccccgcagtctacaccagcgtatgccactaccttgactggatccaagaaatcatggagaactgagcccgcgcgccacgggggcaccttggaagaccaagagaggccgaagggcacggggtagggggttctcgtagggtcccagcctcaatggttcccgccctggacctccagctgccctgactcccctctggacactaagactccgcccctgaggctccgccccctcacgaggtcaagcaagacacagtcgcgccccctcggaacggagcagggacacgcccttcagagcccgtctctatgacgtcaccgacagccatcacctccttcttggaacagcacagcctgtggctccgccccaaggaaccacttacacaaaatagctccgcccctcggaactttgcccagtgggacttcccctcgggactccaccccttgtggccccgcctccttcaccagagatctcgcccctcgtgatgtcaggggcgcagtagctccgcccacgtggagctcgggcggtgtagagctcagccccttgtggccccgtcctgggcgtgtgctgggtttgaatcctggcggagacctggggggaaattgagggagggtctggatacctttagagccaatgcaacggatgatttttcagtaaacgcgggaaacctca

SEQ ID NO: 59673 - DNA, 2507 bp, Homo sapiens
agctccttcccttactctaccttgctcctacttttctctaagtcaacatgagtcgacagtttagttccaggtctgggtaccgaagtggagggggcttcagctctggctctgctgggatcatcaactaccagcgcaggaccaccagcagctccacacgccgcagtggaggaggtggtgggagattttcaagctgtggtggtggtggtggtagctttggtgctggtggtggatttggaagtcggagtcttgttaaccttggtggcagtaaaagcatctccataagtgtggctagaggaggtggacgtggtagtggctttggtggtggttatggtggtggtggctttggtggtggtggctttggtggtggtggctttggtggaggtggcattgggggtggtggctttggtggttttggcagtggtggtggtggttttggtggaggtggctttgggggtggtggatatgggggtggttatggtcctgtctgccctcctggtggcatacaagaagtcactatcaaccagagccttcttcagcccctcaatgtggagattgaccctgagatccaaaaggtgaagtctcgagaaagggagcaaatcaagtcactcaacaaccaatttgcctccttcattgacaaggtgaggttcctggagcagcagaaccaggtactgcaaacaaaatgggagctgctgcagcaggtagatacctccactagaacccataatttagagccctactttgagtcattcatcaacaatctccgaaggagagtggaccaactgaagagtgatcaatctcggttggattcggaactgaagaacatgcaggacatggtggaggattaccggaacaagtatgaggatgaaatcaacaagcggacaaatgcagagaatgaatttgtgaccatcaagaaggatgtggatggtgcttatatgaccaaggtggaccttcaggccaaacttgacaacttgcagcaggaaattgatttccttacagcactctaccaagcagagttgtctcagatgcagactcaaatcagtgaaactaatgtcatcctctctatggacaacaaccgcagtctcgacctggacagcatcattgctgaggtcaaggcccagtacgaggatatagcccagaagagcaaagctgaggccgagtccttgtaccagagcaagtatgaagagctgcagatcactgctggcagacatggggatagtgtgagaaattcaaagatagaaatttctgagctgaatcgtgtgatccagagacttagatctgaaatcgacaatgtcaagaagcagatctccaacttgcagcagtccatcagtgatgcagagcagcgtggcgagaatgccctcaaggatgccaagaacaagctgaatgacctggaggatgccctgcagcaggccaaggaagacctggcccgcctgctgcgcgactaccaggagctgatgaacaccaagctggccctggatctggagattgccacctacaggaccctcctggagggagaagaaagcaggatgtctggagaatgtgccccgaacgtgagtgtgtctgtgagcacaagccacaccaccatcagtggaggtggcagccgaggaggtggcggcggtggctacggctctggaggtagcagctatggctccggaggtggtagctatggttctggaggtggcggcggcggcggccgtggcagctatggctccggaggtagcagctacggctccggaggtggcagctatggctctggaggtggcggcggcggccatggcagctacggctccggaagcagcagtgggggctacagaggtggctctggaggcggcggcggcggcagctctggcggccggggctctggcggcgggagctctggaggctccataggaggccggggatccagctctgggggtgtcaagtcctctggtggcagttccagcgtgaggtttgtttctaccacttattccggagtaaccagataaagagatgccctctgtttcattagctctagttctcccccagcatcactaacaaatatgcttggcaagaccgaggtcgatttgtcccagccttaccggagaaaagagctatggttagttacactagctcatcctattcccccagctctttcttttctgctgtttcccaatgaagttttcagatcagtggcaatctcagtcccctggctatgaccctgctttgttctttccctgagaaacagttcagcagtgaccaccacccacatgacatttcaaagcacctccttaagccagccagagtaggaccagttagacccagggtgtggacagctccttagcatcttatctctgtgctgttttggttttgtacataaggtgtaagcaagttgtttttcttttgtggagaggtcttaaactccccatttccttgttttgctgcaataaactgcatttgaaattctccatgtctcgatcgcccttgtttacggctctgtctaacctggatgggtgttttgtgaggtaaaagaa

SEQ ID NO: 59674 - DNA, 2145 bp, Homo sapiens
cagcatcaccatgtctgttcgatacagctcaagcaagcactactcttcctcccgcagtggaggaggaggaggaggaggaggatgtggaggaggaggaggagtgtcatccctaagaatttctagcagcaaaggctcccttggtggaggatttagctcaggggggttcagtggtggctcttttagccgtgggagctctggtgggggctgctttgggggctcatcaggtggctatggaggattaggaggttttggtggaggtagctttcgtggaagctatggaagtagcagctttggtgggagttatggaggcagctttggagggggcagtttcggaggtggcagctttggtgggggcagctttggtggaggcggctttggtggaggcggctttggaggaggctttggtggtggatttggaggagatggtggccttctctctggaaatgaaaaagtaaccatgcagaatctgaatgaccgcctggcttcctacttggacaaagttcgggctctggaagaatcaaactatgagctggaaggcaaaatcaaggagtggtatgaaaagcatggcaactcacatcagggggagcctcgtgactacagcaaatactacaaaaccatcgatgaccttaaaaatcagattctcaacctaacaactgataatgccaacatcctgcttcagatcgacaatgccaggctggcagctgatgacttcaggctgaagtatgagaatgaggtagctctgcgccagagcgtggaggctgacatcaacggcctgcgtagggtgctggatgagctgaccctgaccaaggctgacctggagatgcaaattgagagcctgactgaagagctggcctatctgaagaagaaccacgaggaggaaatgaaagaccttcgaaatgtgtccactggtgatgtgaatgtggaaatgaatgctgccccgggtgttgatctgactcaacttctgaataacatgagaagccaatatgaacaacttgctgaacaaaaccgcaaagatgctgaagcctggttcaatgaaaagagcaaggaactgactacagaaattgataataacattgaacagatatccagctataaatctgagattactgaattgagacgtaatgtacaagctctggagatagaactacagtcccaactggccttgaaacaatccctggaagcctccttggcagaaacagaaggtcgctactgtgtgcagctctcacagattcaggcccagatatccgctctggaagaacagttgcaacagattcgagctgaaaccgagtgccagaatactgaataccaacaactcctggatattaagatccgactggagaatgaaattcaaacctaccgcagcctgctagaaggagagggaagttccggaggcggcggacgcggcggcggaagtttcggcggcggctacggcggcggaagctccggcggcggaagctccggcggcggctacggcggcggccacggcggcagttccggcggcggctacggaggcggaagctccggcggcggaagctccggcggcggctacgggggcggaagctccagcggcggccacggcggcagttccagcggcggctacggtggtggcagttccggcggcggcggcggcggctacgggggcggcagctccggcggcggcagcagctccggcggcggatacggcggcggcagctccagcggaggccacaagtcctcctcttccgggtccgtgggcgagtcttcatctaagggaccaagatactaacaaaaccagagtaatcaagacaattattgaagaggtggcgcccgacggtagagttctttcatctatggttgaatcagaaaccaagaaacactactattaaactgcatcaagaggaaagagtctcccttcacacagaccattatttacagatgcatggaaaacaaagtctccaagaaaacacttctgtcttgatggtctatggaaatagaccttgaaaataaggtgtctacaaggtgttttgtggtttctgtatttcttcttttcactttaccagaaagtgttctttaatggaaagaaaaacaactttctgttctcatttactaatgaatttcaataaactttcttactgatgcaaactaaaaaaaaaaaaaaaaaaaaaa

SEQ ID NO: 59675 - DNA, 1709 bp, Homo sapiens
ggtacctcctgccagcatctcttgggtttgctgagaactcacgggctccagctacctggccatgaccaccacatttctgcaaacttcttcctccacctttgggggtggctcaacccgagggggttccctcctggctgggggaggtggctttggtggggggagtctctctgggggaggtggaagccgaagtatctcagcttcttctgctaggtttgtctcttcagggtcaggaggaggatatgggggtggcatgagggtctgtggctttggtggaggggctggtagtgttttcggtggaggctttggagggggcgttggtgggggttttggtggtggctttggtggtggcgatggtggtctcctctctggcaatgagaaaattaccatgcagaacctcaatgaccgcctggcctcctacctggacaaggtacgtgccctggaggaggccaatgctgacctggaggtgaagatccatgactggtaccagaagcagaccccaaccagcccagaatgcgactacagccaatacttcaagaccattgaagagctccgggacaagatcatggccaccaccatcgacaactcccgggtcatcctggagatcgacaatgccaggctggctgcggacgacttcaggctcaagtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagaggagatgaaggagttcagcagccagctggccggccaggtcaatgtggagatggacgcagcaccgggtgtggacctgacccgtgtgctggcagagatgagggagcagtacgaggccatggcggagaagaaccgccgggatgtcgaggcctggttcttcagcaagactgaggagctgaacaaagaggtggcctccaacacagaaatgatccagaccagcaagacggagatcacagacctgagacgcacgatgcaggagctggagatcgagctgcagtcccagctcagcatgaaagctgggctggagaactcactggccgagacagagtgccgctatgccacgcagctgcagcagatccaggggctcattggtggcctggaggcccagctgagtgagctccgatgcgagatggaggctcagaaccaggagtacaagatgctgcttgacataaagacacggctggagcaggagatcgctacttaccgcagcctgctcgagggccaggatgccaagatggctggcattggcatcagggaagcctcttcaggaggtggtggtagcagcagcaatttccacatcaatgtagaagagtcagtggatggacaggtggtttcttcccacaagagagaaatctaagtgtctattgcaggagaaacgtcccttgccactccccactctcatcaggccaagtggaggactggccagagggcctgcacatgcaaactccagtccctgccttcagagagctgaaaagggtccctcggtcttttatttcagggctttgcatgcgctctattccccctctgcctctccccaccttctttggagcaaggagatgcagctgtattgtgtaacaagctcatttgtacagtgtctgttcatgtaataaagaattacttttccttttgcaaat

SEQ ID NO: 59676 - DNA, 1688 bp, Homo sapiens
acagcacgctctcagccttcctgagcacctttccttctttcagccaactgctcactcgctcacctccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagcacgaactggccctgcggcagactgtggaggccgacgtcaatggcctgcgccgggtgttggatgagctgaccctggccaggactgacctggagatgcagatcgaaggcctgaaggaggagctggcctacctgaggaagaaccacgaggaggagatgcttgctctgagaggtcagaccggcggagatgtgaacgtggagatggatgctgcacctggcgtggacctgagccgcatcctgaatgagatgcgtgaccagtacgagcagatggcagagaaaaaccgcagagacgctgagacctggttcctgagcaagaccgaggagctgaacaaagaagtggcctccaacagcgaactggtacagagcagccgcagtgaggtgacggagctccggagggtgctccagggcctggagattgagctgcagtcccagctcagcatgaaagcatccctggagaacagcctggaggagaccaaaggccgctactgcatgcagctgtcccagatccagggactgattggcagtgtggaggagcagctggcccagctacgctgtgagatggagcagcagagccaggagtaccagatcttgctggatgtgaagacgcggctggagcaggagattgccacctaccgccgcctgctggagggcgaggatgcccacctttcctcccagcaagcatctggccaatcctattcttcccgcgaggtcttcacctcctcctcgtcctcttcgagccgtcagacccggcccatcctcaaggagcagagctcatccagcttcagccagggccagagctcctagaactgagctgcctctaccacagcctcctgcccaccagctggcctcacctcctgaaggcccgggtcaggaccctgctctcctggcgcagttcccagctatctcccctgctcctctgctggtggtgggctaataaagctgactttctggttgatgcaaaaaaaaaaaaaaaaaaaaaaaaaaaaaaaaa

SEQ ID NO: 59677 - DNA, 1512 bp, Homo sapiens
ctcctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggagcagccgccccatctgccccacagtctccggcctctccagcctcagccccctgcttcagtcccttccccatgcttccttgcctgatgacaataaagcttgttgactcagctaaaaaaaaaaaaaaa

SEQ ID NO: 59678 - DNA, 1684 bp, Homo sapiens
gctttcacaaatacagctctgcaacgcgtttgccctgataccatgtctcttcgactttccagtgcatccaggaggtcctgtcctcgtcccaccactggatcactcagactctatggtgggggaaccagctttggtactggaaattcttgtggcatttcagggattggaagtggcttctctagtgccttcggaggcagctcatcgggaggaaacacagggggaggtaatccctgtgctggcttcactgtgaatgagcgggggctcctttctggcaatgagaaggtgaccatgcagaacctcaatgaccgcctggcatcctacctggacagtgtgcatgctctggaggaggccaacgctgacctggagcagaagatcaagggctggtatgagaaatttgggcctggctcttgccgtggtcttgatcatgactatagcagatatttcccaataattgatgaccttaaaaatcagatcatcgcatccaccaccagcaatgctaatgctgttctgcagatcgataatgccaggcttacagctgatgatttcagactcaagtatgaaaatgagctggctcttcaccagagtgtagaggctgatgtcaatgggttacgaagagttttggatgaaataaccctgtgcagaacagatctggagattcagtatgaaaccctgagtgaggagatgacttacctcaaaaagaaccataaagaggaaatgcaagttctgcagtgcgcagctggaggcaacgtgaacgtggagatgaacgcagcccccggggtggacctcacagttctgctgaacaacatgcgagctgagtacgaagcccttgcagagcagaaccgcagggacgcggaggcctggttcaacgagaagagcgcctccctgcagcagcagatctctgaggatgtcggagccacaacctcagcccggaatgagctgactgaaatgaagcgcactcttcaaaccctggaaattgaacttcagtctctcctagccacgaaacactccctggagtgctccttgacagagaccgagagcaactactgtgcgcagctggcgcagatccaggctcagatcggggccctggaggagcagctgcaccaggtcagaaccgagaccgagggccagaagctggagtatgagcagctcctggacatcaagctccacctggaaaaagaaattgagacctactgtctccttataggaggagatgatggagcctgtaagtctgggggttacaagtctaaagattatggatctggaaatgtgggaagtcaagtcaaagacccagccaaagccatagtggttaagaaagttcttgaggaggtagaccaacgcagcaaaatacttaccaccaggctccactccctggaagagaaatctcaaagcaattaatttgagatgcaacagagaacgtatgccacatagcccctgcgaagaaaaggcattatgtatctgtccagaaaaatgtgcatgtctaagaaaaatgtctaacctgttgtctttctgttactttctttctgggcaatcaatgacagcatctccccattcatctagaagaatgccacacacaaatatgactcatttgattatcctacagaaatctgttgtcaattctttgtattcaataaacctcttctttagcaagttaaaaaaaaaaaaaaaaaaaaaaaaaaaaaaaaaa

SEQ ID NO: 59679 - DNA, 1635 bp, Homo sapiens
gagcatcaccgcagaaacaaaggctccagcctccggacaccatgtctgtgcgcttttcttctacctccaggagacttggctcttgcgggggcactggctctgtgaggctctctagtgggggagcaggctttggggctggaaacacatgcggtgtgccaggcattggaagtggcttctcttgtgcttttgggggcacctcatctgcaggaggctatggcggaggtctgggcgggggaagtgcttcctgtgctgccttcacagggaatgagcacggcctcctctctggcaatgagaaggtgaccatgcagaacctcaacgaccgcttggcctcctacctggagaatgttcgagccctagaggaggccaacgctgacttggagcagaagatcaaggggtggtatgagaaatttggacctggttcttgccgtggccttgatcatgattacagcagatatttcccaattattgacaaacttaagaaccagataatttctgcaactaccagtaatgcccatgttgtcctgcaaaatgataatgcaagactaacagctgatgacttcagactaaagtttgaaaacgagctagcgcttcaccagagcgtggaggcggacatcaatggtttgcgaagagtcctggatgagctgaccttgtgcagaacggacctggagatccagctggaaactctcagtgaggagctcgcttacctcaagaagaatcatgaggaggaaatgaaagctcttcagtgcgcggctggaggcaacgtgaacgtggagatgaacgcggcccccggggtagacctcacggttctgctgaacaatatgcgagctgagtacgaagccctcgcagagcagaaccgcagggacgcggaggcctggttcaacgaaaagagcgcctcgctgcagcagcagatctctgacgacgctggcgccaccacctcagcccggaatgagcttaccgagatgaaacgcactcttcaaacccttgagattgaacttcagtccctcttagcaacgaaacactccctggagtgctccttgacagagaccgagagtaactactgtgcacagctggcacagatccaggctcagatcggggccctggaggagcagctgcaccaggtcagaaccgagaccgagggccagaagctcgagtatgagcagctccttgacatcaaggtccacctggaaaaagaaattgagacctactgcctcctgatagatggagaagatggctcctgttctaaatcaaaaggctatggaggcccaggaaatcaaacaaaagattcatctaaaaccaccattgtcaaaacagttgttgaagagatagatcctcgtggcaaagttctctcatccagagttcacactgtggaagagaaatccaccaaagtcaacaacaagaatgaacagagggtgtcttcctgaactccagcctctgagacagaatggcccccaaattaaaataccaaaatgaagctagtttcctaaataagggtccccttatttttctgcttttcttccaatgaattaagacaagttatttttagaatagtaccatttctttggctttttctctatggtggtgtttcaataaaagttcttcctgttgcaagtcaaaaaaaaaaaaaaaaaaaaaaaa

SEQ ID NO: 59680 - DNA, 2459 bp, Homo sapiens
agcctgtgactttcctccctggacaaaggcatcatgagttgtcagatctcttgcaaatctcgaggaagaggaggaggtggaggaggattccggggcttcagcagcggctcagctgtggtgtctggtggaagccggagatcaacttccagcttctcctgcttgagccgccatggtggtggtggcgggggcttcggtggaggcggctttggcagtcggagtcttgttggccttggagggaccaagagcatctccattagtgtggctggaggaggtggtggctttggcgccgctggtggatttggtggcagaggaggtggttttggaggcggcagcagctttggaggtggcagcggcttcagtggtggtggtttcggtggaggcggctttggtggaggccgctttggaggttttgggggccctggtggtgttggaggtttagggggtcctggtggctttgggcctggaggataccctggtggcatccacgaagtctctgtcaaccagagcctcctgcagcctctcaacgtgaaagttgacccagagatccagaatgtgaaggcccaagagcgtgagcagatcaaaactctcaacaacaaatttgcctccttcattgacaaggtgcggttcttggagcagcagaaccaggtgttacagaccaaatgggagctgctacaacaaatgaatgttggcacccgccccatcaacctggagcccatcttccaggggtatatcgacagcctcaagagatatctggatgggctcactgcagaaagaacatcacagaattcagagctgaataacatgcaggatcttgtggaggattataagaagaagtatgaggatgaaatcaataagcgcacagctgctgagaatgattttgtgacgcttaaaaaggacgtggacaatgcctacatgataaaggtggagttgcagtccaaggtggacctgctgaaccaggaaattgagtttctgaaagttctctatgatgcggagatatcccagatacatcagagtgtcactgacaccaacgtcatcctctccatggacaacagccgcaacctggacttggatagcatcatcgccgaggtcaaggcccagtatgaggagatcgcccagaggagcaaggaagaagcggaggccctgtaccacagcaagtatgaggagctccaggtgactgtcgggagacatggagacagcctgaaagagatcaagatagagatcagcgagctgaaccgcgtgatccagaggctgcagggggagatcgcacatgtgaagaagcagtgtaagaatgtgcaagatgccatcgcagatgccgagcagcgtggggagcatgccctcaaggatgccaggaacaagttgaatgacctggaggaggccctgcagcaggccaaggaggacttggcgcggctgctgcgtgactaccaggagctgatgaacgtgaagctggccctagatgtggagatcgccacctaccgcaaactgctggagggcgaggagtgcaggatgtctggagacctcagcagcaatgtgactgtgtctgtgacaagcagcaccatttcatcaaatgtggcatccaaggctgcctttggaggttctggaggtagagggtccagttccggaggaggatacagctctggaagcagcagttatggctctggaggccgacagtctggctccagaggcggtagtggaggaggaggttctatctctggaggaggatatggctctggcggtggttctggaggaagatacggatctggtggtggctctaagggagggtccatctctggaggaggatatggctctggaggtggaaaacacagctctggaggtggctctagaggaggctccagctctggaggaggatatggctctggaggtgggggttctagctctgtaaagggtagctcaggtgaagcttttggttccagcgtgaccttctcttttagataaagatgagcccccaccaccaccgactctcccaacccagactctcccactccagaatgtagaagcctgtctctgtacctctaactggcagcaagttaaatttttgtcatttatctctgatggcactttgagggaaaagaatgtccacatacagtttttgaaagatcttctctccaaaccagttagttagagccagtgacgcctctgtgttctggggcggaatctgtgctgtctaggtttgtgcttctagccatgcccattcccgcccccaccatgcctctttgcattgcccattttccagatgtgtattctgttgaggacccaggcccatccagggatttcatctctaagcctggcagtgctggggggaaatgtgtttctgtgtatatagctcctcttgtccactctgctttcggaagtgctgtggtctgggggtcttcataataaacctcatttgcaattcaaaaaaaaaaaaaaaaaaaaaaaaaaaaaaaaaaaaaaaaaaaaaa

SEQ ID NO: 59681 - DNA, 2617 bp, Homo sapiens
gacttgctccggtttgcagagctaggaggtggcaggctgtgcgctcaaactcaggctgtctaactccacattctgtggggtgagaggatgggtgatggggtgtcttttctggaggagggaggtgctgtgagcctagcgagatggaggtacagtgggtgtgggcctggagcgctgggcccaggcaggggcttctgattaggaagccctggggcaccagttcaggttctcccagagagtagtgtgatgggatccagtaacctgtgccctccagatgacttctgtaggtgtgtttagtgacatgctcaacgggtgcgggaaggatgggcttgtgccaagggccaagcccagagatgtttcagatttttccctttatgcccctgcaaccaagccctgctgctccaggacatataagagacgaaggctgagggctccagcactcaccggcctgggccctgtcacttctctgatagctcccagctcgctctctgcagccatgattgccagacagcagtgtgtccgaggcgggccccggggcttcagctgtggctcggccattgtaggcggtggcaagagaggtgccttcagctcagtctccatgtctggaggtgctggccgatgctcttctgggggatttggcagcagaagcctctacaacctcagggggaacaaaagcatctccatgagtgtggctgggtcacgacaaggtgcctgctttgggggtgctggaggctttggcactggtggctttggtgccggcggcttcggagctggtttcggcactggtggctttggtggtggatttgggggctccttcagtggtaagggtggccctggcttccccgtctgccccgctgggggaattcaggaggtcaccatcaaccagagcttgctcacccccctccacgtggagattgaccctgagatccagaaagtccggacggaagagcgcgaacagatcaagctcctcaacaacaagtttgcctccttcatcgacaaggtgcagttcttagagcaacagaataaggtcctggagaccaaatggaacctgctccagcagcagacgaccaccacctccagcaaaaaccttgagcccctctttgagacctacctcagtgtcctgaggaagcagctagataccttgggcaatgacaaagggcgcctgcagtctgagctgaagaccatgcaggacagcgtggaggacttcaagactaagtatgaagaggagatcaacaaacgcacagcagccgagaatgactttgtggtcctaaagaaggacgtggatgctgcctacctgaacaaggtggagttggaggccaaggtggacagtcttaatgacgagatcaacttcctgaaggtcctctatgatgcggagctgtcccagatgcagacccatgtcagcgacacgtccgtggtcctttccatggacaacaaccgcaacctggacctggacagcattattgccgaggtccgtgcccagtacgaggagattgcccagaggagcaaggctgaggctgaagccctgtaccagaccaaggtccagcagctccagatctcggttgaccaacatggtgacaacctgaagaacaccaagagtgaaattgcagagctcaacaggatgatccagaggctgcgggcagagatcgagaacatcaagaagcagtgccagactcttcaggtatccgtggctgatgcagagcagcgaggtgagaatgcccttaaagatgcccacagcaagcgcgtagagctggaggctgccctgcagcaggccaaggaggagctggcacgaatgctgcgtgagtaccaggagctcatgagtgtgaagctggccttggacatcgagatcgccacctaccgcaaactgctggagggcgaggagtacagaatgtctggagaatgccagagtgccgtgagcatctctgtggtcagcggtagcaccagcactggaggcatcagcggaggattaggaagtggctccgggtttggcctgagtagtggctttggctccggctctggaagtggctttgggtttggtggcagtgtctctggcagttccagcagcaagatcatctctaccaccaccctgaacaagagacgatagaggagacgaggtccctgcagctcactgtgtccagctgggcccagcactggtgtctctgtgcttccttcacttcacctccatcctctgtctctggggctcatcttactagtatcccctccactatcccatgggctctctctgccccaggatgatcttctgtgctgggacagggactctgcctcttggagtttggtagctacttcttgatttgggcctggtgacccacctggaatgggaaggatgtcagctgacctctcacctcccatgggcagagaagaaaatgaccaggagtgtcatctccagaattattggggtcacatatgtcccttcccagtccaatgccatctcccactagatcctgtattatccatctacatcagaaccaaactacttctccaacacccggcagcacttggccctgcaagcttaggatgagaaccacttagtgtcccattctactcctctcattccctcttatccatctgcaggtgaatcttcaataaaatgcttttgtcattc

SEQ ID NO: 59682 - DNA, 2301 bp, Homo sapiens
tcgacagctctctcgcccagcccagttctggaagggataaaaagggggcatcaccgttcctgggtaacagagccaccttctgcgtcctgctgagctctgttctctccagcacctcccaacccactagtgcctggttctcttgctccaccaggaacaagccaccatgtctcgccagtcaagtgtgtccttccggagcgggggcagtcgtagcttcagcaccgcctctgccatcaccccgtctgtctcccgcaccagcttcacctccgtgtcccggtccgggggtggcggtggtggtggcttcggcagggtcagccttgcgggtgcttgtggagtgggtggctatggcagccggagcctctacaacctggggggctccaagaggatatccatcagcactagaggaggcagcttcaggaaccggtttggtgctggtgctggaggcggctatggctttggaggtggtgccggtagtggatttggtttcggcggtggagctggtggtggctttgggctcggtggcggagctggctttggaggtggcttcggtggccctggctttcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgtgggggaacggggccgcctggactcagagctgagaaacatgcaggacctggtggaagacttcaagaacaagtatgaggatgaaatcaacaagcgtaccactgctgagaatgagtttgtgatgctgaagaaggatgtagatgctgcctacatgaacaaggtggagctggaggccaaggttgatgcactgatggatgagattaacttcatgaagatgttctttgatgcggagctgtcccagatgcagacgcatgtctctgacacctcagtggtcctctccatggacaacaaccgcaacctggacctggatagcatcatcgctgaggtcaaggcccagtatgaggagattgccaaccgcagccggacagaagccgagtcctggtatcagaccaagtatgaggagctgcagcagacagctggccggcatggcgatgacctccgcaacaccaagcatgagatcacagagatgaaccggatgatccagaggctgagagccgagattgacaatgtcaagaaacagtgcgccaatctgcagaacgccattgcggatgccgagcagcgtggggagctggccctcaaggatgccaggaacaagctggccgagctggaggaggccctgcagaaggccaagcaggacatggcccggctgctgcgtgagtaccaggagctcatgaacaccaagctggccctggacgtggagatcgccacttaccgcaagctgctggagggcgaggaatgcagactcagtggagaaggagttggaccagtcaacatctctgttgtcacaagcagtgtttcctctggatatggcagtggcagtggctatggcggtggcctcggtggaggtcttggcggcggcctcggtggaggtcttgccggaggtagcagtggaagctactactccagcagcagtgggggtgtcggcctaggtggtgggctcagtgtggggggctctggcttcagtgcaagcagtggccgagggctgggggtgggctttggcagtggcgggggtagcagctccagcgtcaaatttgtctccaccacctcctcctcccggaagagcttcaagagctaagaacctgctgcaagtcactgccttccaagtgcagcaacccagcccatggagattgcctcttctaggcagttgctcaagccatgttttatccttttctggagagtagtctagaccaagccaattgcagaaccacattctttggttcccaggagagccccattcccagcccctggtctcccgtgccgcagttctatattctgcttcaaatcagccttcaggtttcccacagcatggcccctgctgacacgagaacccaaagttttcccaaatctaaatcatcaaaacagaatccccaccccaatcccaaattttgttttggttctaactacctccagaatgtgttcaataaaatgcttttataatat

SEQ ID NO: 59683 - DNA, 2255 bp, Homo sapiens
ccttcctccctcctgcatctgagctttgtctccaccagcaacatgagccgccaattcacctgcaagtcgggagctgccgccaaggggggcttcagtggctgctcagctgtgctctcagggggcagctcatcctccttccgggcagggagcaaagggctcagtgggggctttggcagccggagcctctacagcctggggggtgtccggagcctcaatgtggccagtggcagcgggaagagtggaggctatggatttggccggggccgggccagtggctttgctggaagcatgtttggcagtgtggccctggggcctgtgtgcccaactgtatgcccacctggaggcatccaccaggttaccgtcaatgagagcctcctggcccccctcaacgtggagctggaccccgagatccagaaagtgcgtgcccaggagcgagagcagatcaaggctctgaacaacaagttcgcctccttcatcgacaaggtgcggttcctggagcagcagaaccaggtactggagaccaagtgggagctgctgcagcagctggacctgaacaactgcaagaacaacctggagcccatcctcgagggctacatcagcaacctgcggaagcagctggagacgctgtctggggacagggtgaggctggactcggagctgaggaatgtgcgggacgtagtggaggactacaagaagaggtatgaggaggaaatcaacaagcggacagcagcagagaacgagtttgtgctgctcaagaaggatgtggatgctgcttacgccaataaggtggaactgcaggccaaggtggaatccatggaccaggagatcaagttcttcaggtgtctctttgaagccgagatcactcagatccagtcccacatcagtgacatgtctgtcatcctgtccatggacaacaaccggaacctagacctggacagcatcattgacgaagtccgcacccagtatgaggagattgccttgaagagtaaggccgaggctgaggccctgtaccagaccaagttccaagagcttcagctggcagctggcaggcatggggacgacctcaaaaacaccaagaatgaaatctcggagctcactcggctcatccagagaatccgctcagagatcgagaacgtgaagaagcaggcttccaacctggagacagccatcgctgatgctgagcagcggggagacaacgccctgaaggatgcccgggccaagctggacgagctggagggcgccctgcaccaggccaaggaggagctggcgcggatgctgcgcgagtaccaggagctcatgagcctgaagctggccctggacatggagatcgccacctatcgcaagctactggagagcgaggagtgcaggatgtcaggagaatttccctcccctgtcagcatctccatcatcagcagcaccagtggcggcagtgtctatggcttccggcccagcatggtcagcggtggctatgtggccaacagcagcaactgcatctctggagtgtgcagcgtgagaggcggggagggcaggagccggggcagtgccaacgattacaaagacaccctagggaagggttccagcctgagtgcaccctccaagaaaaccagtcggtagagaagactgccccgggccccgcctcattccatgacccggctctggatcccacactgtacttcccacagcccactctcagctccatctccaccctgctggtcctgctcccatacacctggcactggccttggccacccacttctcccagcctgtgtcttcctgatcctgggaaggcctggatgaccaagcttggtgaaattcctccctgtacacaccctattaactccttggctgtggtcccccagctacaccaccagcccaggtcctggctgccagctttcctcctctgcccggcctctagcgcagtcgctaactactctgctgggctccctgggtctctgcccaaggccccgcacacactgggacctagcatagttcctgcctatgccaggagctggctctgtgtttaagaaaaggaggactgaaggacaaacaaccaagagtggcccagtccccacccccacatctagctcagtctcaaatctgagtgggaccaagtgcaattcagggcctttttctccactcacctgcacccagaagcagagaaaagcaggcactgttcacttttcctttattcttaatggccttcctctgttgcaacctcaataaacagcacaatctcaaaaaaaaaaaaaaaaaaa

SEQ ID NO: 59684 - DNA, 2144 bp, Homo sapiens
cctctcatcctgccctccggcccctctgcagctatgaggtcctccgtctctcggcaaacatactccacaaaagggggcttcagctccaactctgccagcggagggagtgggtcccaggcccgcaccagcttcagctcagtgacggtgtctcggagcagtggcagtggtggcggggcccactgtggccccggcacaggtggctttggcagccgaagcctctataacttggggggccacaagagtatctctgtcagtgtggccggaggggccttgttggggcgggctctggggggctttggctttggcagcagggcatttatgggacagggggctggcaggcagacgtttgggcctgcttgtcctcctggggggatccaggaggtcactgtcaaccagagcctgctgacccccctccatgtggagattgaccccgagatccagcgagtgcgcactcaggagcgggagcagatcaagaccctcaacaacaagttcgcctccttcatcgacaaggtgcggttcctggagcaacagaataaggtgctggagaccaagtgggcactgctgcaggagcagggccagaacttgggtgtcaccaggaacaacctggagcccctctttgaggcctacctgggtagcatgcggagcacgctggacagacttcagagcgagcgggggaggctggactcagagctcaggaacgtgcaggaccttgtggaggacttcaagaacaagtacgaggatgaaatcaacaagcacactgctgcagagaacgagtttgtggtgctcaagaaggatgtggatgcagcatacatgggccggatggatctgcatggcaaagtgggcaccttgacccaggagattgacttcctgcagcaactctatgaaatggagctgagccaagtgcagacccacgtgtctaacaccaatgtggtgctgtccatggacaacaaccgcaacctggacctggacagcatcatcgccgaggtcaaggcccagtatgagctgattgcccagaggagccgggctgaggccgaggcctggtaccagaccaagtatgaggagctgcaggtgactgctgggaagcatggggacaacctgcgggacaccaagaacgagattgctgagctcacccgcactatccagaggctgcagggggaggctgatgcagccaagaagcagtgtcagcagctgcagacggccattgcggaagcggagcagcgtggggagctggcactcaaggatgctcagaagaagcttggggatctggatgtggccctgcaccaggccaaggaggacctgacacggctgctgcgtgactaccaggagctgatgaatgtcaagctggccctggacgtggagattgccacctaccgcaagcttctggagagcgaggagagcaggatgtctggagaatgtcccagtgcagtcagcatttctgtgactggcaactccaccactgtgtgcggaggtggcgcagccagctttggaggtggcatctccctgggtgggagtgggggggccaccaagggtggattcagcacaaatgtgggctatagcaccgtcaagggagggccagtctctgcgggcacctccatcctgcggaagaccactacggtcaagacgtccagccagaggtattagctgctgagccctgcaagggcccctgcaatcctgtccctgccctcctcaccccacctctgctgtcctttccagtcacttctcaggagcaggaacagccaggggacctcagacccagggtattttcataccagactatttgcatcttgggaagcgctcaaatctactcaggttttctccttggtcctgcagtaggatgggagggaaggttaaagttgccagcttgagtgatgtgcttgggtgacttgggggtgaccttttgaccaccgagaggaggctgaatttctcaagccattaggagagagagaaattgggagtggtccccaaagacccttcaacctccccagtcccccaccagacccaccctctccctgaatctacccacatcccccttccctgtctgtgtctcaataaatggtgcaactgcaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 59685 - DNA, 903 bp, Homo sapiens
aataggcagccataattcagaaactcctccaagcaacccaaccttcagatcaactcctgacaccatggcctgctgtcagaccagcttctgtggatttcccagctgctccaccagtgggacctgcggctccagctgctgccagccaagctgctgtgagaccagctcctgccagccacgctgctgtgagaccagctgctgccagccaagctgctgccagaccagcttctgtggatttcctagcttctcaaccggtgggacttgtgactctagctgctgccagccaagctgctgtgaaactagctgctgccagccaagctgctaccagaccagctcctgcggaactggctgtggcattggtggtggcattggctatggccaggagggcagcagtggagctgtgagcacccgtatcaggtggtgccgcccagactgccgtgtggagggtacctgcctgcccccctgctgcgtggtgagctgcacacccccatcctgctgccagctgcaccacgccgaggcctcctgctgccgcccatcctactgtggacagtcctgttgccgcccagtctgctgctgctactgctctgagcccacttgttgaaaacctccttctgctggggatcctgataagatggcaccttaaaactagccaaattagaatcctaacaatcttctgaactccagtacctataactgggcttgcaacctctcatcacacagccacataaattccctaggaagtaaattcatttacaatggaagaccaaaaatttttcctagacctggttgtcagccaaagtcctacaatgtgaaaagagttagatactattttactataaatatcacctgaaatatttcaacagttattgggacttaaatttaataaaagttttcatctcttcaatg

SEQ ID NO: 59686 - DNA, 1193 bp, Homo sapiens
cagaaactcctccaagcaacctaactcttaacccaacttctgacaccatgacctgctgccagaccagcttctgtggatatcccagcttctccatcagtgggacctgtggctccagctgctgccagccaagctgctgtgagaccagctgctgccagccacgcagctgccagactagcttctgcggatttcccagcttctcaaccagtgggacctgcagctccagttgctgccagccaagctgctgtgagaccagctgctgccagccaagctgctgtgagaccagctgctgccagccaagctgctgccagatcagctcctgcggaactggctgtggcattggtggtggcatcagctatggccaggagggcagcagtggagctgtgagcacccgtatcaggtggtgccgcccagacagtcgtgtggagggcacctacctacccccctgctgtgtggtgagctgcacgcccccatcctgctgccaactgcaccatgcccaggcctcctgctgccgcccgtcctactgtggacagtcctgctgccgcccagtctgctgctgtgagcccacttgctgaaagccagtttgcttattttcaattgcctaggtcacagtgtctctgaactgttcatcccttgaccacctctggaccactaacaagttctcagactttgcattgcttgtgatggagactactaagtatatgagctcacaattctatctgattccattctacaatgaataccttgacccttcactggggacacagaaatgctacaaagccacctgctgatcatcaatttgcttgggatatactatttctgatatttctgcaggattaaaaattactgacatgttgtggaatttatccatgagaactatccacaagtctaatgtttccatgctttataatctattttatcttgtttacctaaaattttttgcaacatcaaagacaccaaattatagccaagtgacattcctcaagtcaccagagagaatggaagctcatcacccaacattcagcttctaagaagtaggctggactttccacattttaacatctgatccatcccttggtttttggatcataatgatcttgcctgctggatatttcagttatatctgtgatacaatgtcttctgtcatttcttaataaatattatatactaggcaaagaaaaaaaaaaaaaaaaaaa

SEQ ID NO: 59687 - DNA, 928 bp, Homo sapiens
gcaagctacctgcagccctctgtctgacatcatgtccttcaactgctccacaagaaattgctcttccaggcccattggaggacgctgcattgttccagtggcccaagttaccacgacttccaccactgatgctgactgcctgggcggcatctgtttgcccagttccttccagactggctcttggctcctggaccactgtcaagagacctgctgtgagcccactgcttgccagccaacctgttaccggcgaacttcatgtgtctccaacccttgccaggtgacttgctctcgacaaactacctgtatttccaacccctgctcaactacctacagccggccgctcacctttgtctctagtggatgtcagcccctgggaggcatctccagtgtctgccaaccagtgggcggcatctctactgtctgccaaccagtgggaggagtctctactgtctgccagccagcctgtggggtctccaggacgtatcagcagtcctgcgtgtccagctgccgaagaacctgctaagtgtgtaggagccagtgagcgaatcaagactccacgacctgccagctgtttccaggatcttccagcatgctgcttgtccctgaatagctcttcatagctgacccttcttgtgaccgcctgactgctggctactatccatgcacacgctgtctttagcactctaaaatttttctggccagccctaagcttgttttaagggttgctcactggtgctgtgtatgcctctggatgtgtccagaagctttaccatccacaccccagtctctgatgcttttgacatgttttcaccttgctgctgtatctcctggcctctgcttttgtgtctcacaaaaacagagcttgtctcaccatgtatttctcaataaacctgcattagttggcattgcaaaaaaaaaaaaaaaaaaa

SEQ ID NO: 59688 - DNA, 815 bp, Homo sapiens
gaactccggctgcgttaccgacctgcgagctgacgggcccggaccatggggtgctgcccgggggactgcttcacctgctgcacccaggagcaaaactgctgtgaagagtgctgctgtcagccgggctgctgtggctgctgcggctcctgctgtggctgtgggggctctggctgcgggggctctggctgcgggggcagctgctgcggatcgtcttgctgtggatctggctgcggaggctgtggaggctgcggaggctgcgggggtggctgctgtggatccagttgctgtgggtccagttgctgcggctccgggtgctgtgggcctgtgtgctgccagcccacacctatatgcgacacaaaatgaagacctttccctccaccactgatgcagtcccaccgaaagcctccatctgctccagggggacagcccctcgtgtccagaaccttccatacccccaagacagtgtcttgtctttctgtgatttgtagaggagggcttgttctccaacaccttctctggtatttcaaggcaccgagaacaagagccatactctgatgaaacattaaaactcggtcacaactaagtgatcccaagctcaagggtgaatccccaatactttacttattcacatgaagttcaatgtcttgtactataagacatcctcttcttcaaggtgtctttgggactgatcctccgccctggctttctgcagctttgagatgcaaaaaaggtccatcttctttgtgagcctcttaataaatttgagcatgctggcataaaaaaaaaaaaaaaaaaaaaaaaaaaaaaaaaaaaaa

SEQ ID NO: 59689 - DNA, 614 bp, Homo sapiens
agacttctctcaactcaacaaaaacccacctcccattgccatgtattgctgtgctctccgctcctgcagcgtccccaccggccctgccaccaccttctgctcatttgataaaagctgccgctgtggagtctgcctacccagcacctgcccacatgagatcagcctccttcagcccatctgctgtgacacctgccccccaccctgctgcaagcctgatacctatgtgccaacttgctggctgctcaacaactgtcacccgactcccggactgagtgggatcaacctgaccacctatgttcagcctggctgtgagagtccctgtgagccccgctgttaaccagccgagtctgcacaggttccgtgaggtggctgcccaatgtcctctgcaccatctgggcttcagcactcactactgcctacatcaaggctaaggccatcccaatccccggggccaagtcttgatgaatcttcttaattatttgcacatttgggtaccattggagacctcccttctgtcttttaggctatttcatcactctttgagaaataaccattttgaccatttgttaataaactttattctggcttagcaaaaaaaaaaaaaaaaaaaaaaa

SEQ ID NO: 59690 - DNA, 749 bp, Homo sapiens
aagaaactgaaagctaaccagacgcccattgccatggattgctgtgcctctcgcagctgcagtgtccccactgggcctgccaccaccatctgctcctccgacaaatcctgccgctgtggagtctgcctgcccagcacctgcccacacacagtttggttactggagcccatctgctgtgacaactgtcccccaccctgccacattcctcagccctgcgtgcccacctgcttcctgctcaactcctgccagccaactccgggcctggagaccctcaacctcaccaccttcactcagccctgctgtgagccctgcctcccaagaggctgctgatggatggctactttgctcagtgcccgacaacgaagaatccagaagctgtcccttcagtattcacttgcctcagtagtttgccagatgttaaggtagaccagatgacccagatatgaagaacttacctttggttttaatgggggaaaaaaagaaaagtattttttatggttatttagctgaaaaaccatttggttcctgtgggcaggtgaatgagttttattagcaaaatactgtttcaatctttaagacctcagattacatgttcttgatcatattgcttcctggctcttgtttcttgtactgggtattttcatagaagaaaatttcttggtgggttttccaataaactatatttctctggcaaaaaaaaaaaaaaaaaaaaaaaaaaaaaaaaaaaaaaaaaaaaaaaaaaaaaaaaa

SEQ ID NO: 59691 - DNA, 754 bp, Homo sapiens
ctgtcttggaaacctacctagaacctccaccctctgacaccatggttaactcttgttgtggctctgtctgctctgaccagggctgtgatcaaggcctctgccaagagacctgctgccgccccagctgctgccagaccacctgttgctgccccagctgtgttgtatccagctgctgccgcccatcctgctctcagactacctgctgccagaccacttgctgtcgccccagctgctgccgcccagtctgttgtcagaccacctgccgccccagctgtggtgtgtccagctgctgccgtccactctgttgtcagaccacctgccgccccagctgtggtgtgtccagctgctgccgtccactctgctgtcagaccacctgctgccgtacaacttgctgccgccccagctgctgtggatcctcttgttgaacctcatattggactatcaaccatgagccagtcaccatcccatgatatgaaagtgtcatttatatcaatttgtccatgtgttaaatggccatcagctttattatcctgttattccactaagtaactggtgaaagggcatccatctacatttaataccactcatttttcccatggatctcttcccagcattcagacctcagatgcatgatgcagttagactaagcctctaagtctctgactgttatgcttgatttgaccttcaaaattacatattaactgttcttcaataaatattatcttaatatcagtaaaaaaaaaaaaaaaaaaaa

SEQ ID NO: 59692 - DNA, 1077 bp, Homo sapiens
ctcactctcctggaaacccaccgagaacctccaccctctgacaccatggtcaactcctgttgtggctctgtgtgctctgaccagggctgtggcctggagaactgctgccgccccagctgctgccagaccacctgctgcaggaccacctgctgccgccccagctgctgtgtgtccagctgctgcaggccccagtgctgccagtctgtgtgctgtcagcccacctgctgccgccccagctgctgtcagaccacctgctgtaggaccacctgctgccgccccagctgctgtgtgtccagctgctgcagaccccagtgctgccagtctgtgtgctgccagcccacctgctgccgccccagctgctgtcagaccacctgctgcaggaccacttgctgccgccccagctgctgtgtgtccagctgctgcagaccccagtgctgccagtctgtgtgctgccagcccacctgctgccgccccagctgctgcatctccagcagctgctgcccctcttgctgtgaatccagctgctgccgcccctgctgctgcctgcgtccagtctgtggccgagtctcctgccacaccacttgctatcgcccaacctgtgtcatctccacctgcccccgccccttgtgctgtgcctcctcttgctgctaaatctctgctgtgaacacaccacttccttattacgtcctttcctacagatgaaggctctcattgcaaacatgcggactgttcaagagaattgatctgggtcccataagcaaacctcatccttagaaattctgtatttgcattctaccttttgtccaaactcccttccttccaaaggaattcattgacaatctcctaataaattgacaaattgtcctccaacatcctcccacctctttgacttcaggacatttattcatcatgcctaaggaatttgaagattgcctccatcatttgtagggccacagatcttaaagcctccaaccttgaagtccagtgaagtctctctcttaaagtcttttgcaaacatttttgtaccttgttatttccatgtaccaaaataaacctctattctattggcactgaaaa

SEQ ID NO: 59693 - DNA, 942 bp, Homo sapiens
tagaaatccacccagaacctccaccctctgacaccatggtcagctcctgttgtggctctgtcagctctgagcagagctgtggcctggagaactgctgccgccccagctgctgccagaccacctgctgcaggaccacctgctgccgccccagctgctgcaagccccagtgctgccagtctgtgtgctaccagcccacctgctgccaccctagctgctgcatctccagctgctgccacccctattgctgtgaatccagctgctgccgcccctgctgctgccgccccagctgctgccagaccacctgctgcaggaccacctgctgcaggaccacctgctgctgccccagctgctgtgtgtccagctgctgcagaccccagtgctgccagtctgtgtgctgccagcccacttgctgccgtcccagctgctgcatctccagctgctgccacccctcttgctgtgaatccagctgctgccgcccctgctgctgcgtgcgtccagtctgtggccgagtctcctgccacaccacttgctatcgcccaacctgtgtcatctccacctgcccccgccccttgtgctgtgcctcctcttgctgctaatgtctccttgtgatatttgtcatactatgaatgtcttcattagtcatttaaaatgcactgtagccagccagtcactggaaaaatgaacacttccctgccagtttgtctcatgtggcattcagagtggacattcagctcttctaggaaatgacagacaatcacattcattaaaatatgttatgccaggccccaatgcagttatttttagatgagcagtgtcttcattcgaaggggacactaactgtgatgatctcatataatattgttttcatgtattaataaacagccacttccctaaaaaaaaaaaaaaaaaaaaaaaaaaaaaaaaaaaaaaaaaaaaaaaaaa

SEQ ID NO: 59694 - DNA, 1149 bp, Homo sapiens
ctcacctgctcctctacctgctccaccctcaatccaccagaaccatgggctgctgtggctgctccagaggctgtggctccggctgtgggggctgtggctccagctgtgggggttgtggctctggctgtgggggctgtggctccggccgtgggggctgtggctctggctgtgggggctgcagctccagctgtgggggatgtggctccagatgttatgtgcctgtctgctgctgcaagcccgtgtgctcctgggtgccagcctgttcctgcaccagctgtggctcctgtgggggctccaaggggggctgtggctcctgtgggggctccaaggggggctgtggctcctgtgggggttccaaggggggctgtggttcttgtggctgctcccagtccagctgttgtaagccctgttgctgctcctcaggctgtggatcatcctgctgccagtccagctgctgcaagccctgctgctgccagtccagctgctgtgtccccgtgtgctgccagtccagctgctgcaagccctgttgctgccagtccaactgttgtgtccctgtgtgctgccagtgtaagatctgaggctctggacccagaccttcaggtttctcctgtttggtgaaagcatttcttatggttccctgagtcagttcgtcccacacatcctccctgaggcacctgcacctgctctagctcaccatccatgcacacacctccttccatggctcagctctcctctgggccctgccttcagcctcctcactccagaaacgtgtgtttccctgatgcgggaggtgtcctcgcctggacgcaggcacccagccgactgccacgatgttccctgcacttgggtgtggaccatcttcttcttctccctgggctgactgagatgcaaggtctgaccccacaaggccaggccgacgtttctgagtgatcactaagaaccagcttctcaaccaccatcaggaccctggatcctcctgggccgctgcctgttctcctgtggcccaagtgtgaccaggaaggtctctttccttcctgttgtctccatctgtttaaaaaaaaataacaaaataatgaatgaatttccttgcaataaagcctctcatgtctgtaaatcaaaaaaaaaaaaaaaaaaaaaaaaaaaaaaaaa

SEQ ID NO: 59695 - DNA, 1042 bp, Homo sapiens
tgacaccatgacccactgttgctccccttgctgtcagcctacctgctgcaggaccacctgctgcaggaccacctgctggaagcccaccactgtgaccacctgcagcagcacaccctgctgccagcccgcctgctgtgtgtccagctgctgccagccttgctgccgcccaacttgctgtcaaaacacctgctgtaggaccacctgctgccagcccacctgtgtgaccagctgctgccagccttcctgctgcagcacaccctgctgccagcccacctgctgtgggtccagctgctgtggccaaaccagctgtgggtccagctgtggccagagcagctcctgtgcacctgtgtactgcagaagaacctgctactaccccacgactgtctgcctgcctggttgcctaaaccagagctgtggctccaactgctgccagccctgctgccgcccagcctgctgtgagaccacctgctgcaggaccacttgcttccagcccacctgtgtgtccagctgctgccagccttcttgctgctgatcacgttccaagagaaccaccatcctcacacaacaaatttctgctcaactgactcatcttttgggggactaatttaatttgctgctgacagccaccatgctctcacccaaatttttatgaattctctacatgtttaaaatcttggaaatctgcttgagggagggcagaatacttcatcctgattctctttttccttacaccttgtggatcatgtgccagcttcatctgttctcaagtttgagtcatggtctcagctttgactctaaagtcaagagcttcattccctgcttctaaggaatttaggtttctgcaactgatcgatgatctttgcaatcttttttttgttttcaatatcctcctcatcgttcttgtatccttctttcttcttttcatgataaatttgtgttgtgtccctggtagcagaaatccttacctatatgtttctgaataaattctgaaccatcctcatctcaaaaaaaaaaaaaaaaaaaaaaaaaaaaaaaaaaaaaa

SEQ ID NO: 59696 - DNA, 1020 bp, Homo sapiens
tcacctcttaacagaagcccaccctccatccctgacaccatgacccactgttgctccccttgctgtcagcctacctgctgcaggaccacctgctggcagcccaccactgtgaccacctgcagcagcacaccctgctgtcagccctcctgctgtgtttccagctgctgccagccttgctgccacccaacttgctgtcaaaacacctgctgtaggaccacctgctgccagcccatctgtgtgaccagctgctgccagccttcctgctgtagcacaccctgctgccagcccacatgctgtgggtccagctgtggtcagagcagctcctgtgcacctgtgtactgcagaagaacctgctaccaccccacaagtgtttgtctgcctggttgcctaaaccagagctgtggctccaactgctgccagccctgctgccgcccagcctgctgtgagaccacctgctgcaggaccacttgtttccagcccacctgtgtgtacagctgctgccagccttcttgctgctaatcaactcccaagagaactaccatcctcacacaacaaccttcagctcaactgacttgtcttttgagggactaatttactttgctgctgacagccaccatgctctcacccaaatttttatgaattctctacatgtttaaaatcttgggaatctgcttgagggagggcagaatacttcatcctcattccctctttccttacaccttgtggatcatgtgccagcttcgtctgttcttaatttggagtcatgatctcagctttgtctcaaaaatcaagagcttcattctttgcttctaaggaatttaggtttctgcaactgatcaatcatctttgcaattatattttcattttaaatatccttctcatggttcttgtatccttctttcttcttttcacgataactttgggttatgtctctggtagcagagattcttacctatatgtttctgaataaactctgaaccatcttcatctcaaaaaaaaaaaaaaaaaaaaaaaaaaaaa

SEQ ID NO: 59697 - DNA, 990 bp, Homo sapiens
tctgaacagaagcccaccctctacccctgacaccatgacccactgttgctccccttgctgtcagcctacatgctgcaggaccacctgctgcaggaccacctgctggaagcccaccactgtgaccacctgcagcagcacaccctgctgccagccctcctgctgtgtttccagctgctgccagccttgctgccgcccaacttgctgtcaaaacacctgctgccagcccacctgtgtgaccagctgctgccagccttcctgctgcagcacaccctgctgccagcccacctgctgtgggtccagctgtgaccagagcagctcctgtgcacctgtgtactgcagaagaacctgctactaccccacaactgtctgcctgcctggttgcctaaaccagagctgtggctccaactgctgccagccctgctgccgcccagcctgctgtgagaccacttgcttccagcccacctgtgtgtccagctgctgtcagcctttttgctgctgatcaagtcccaagagaaccaccatcctcacacaacaactttctgctcaactgacttatcttttgggggactaatttaatttgctgctgacagccaccatgctctcacccaaatttttatgaattctctacctgtttaaaatcttgggaatctacttgagggagggcagaatacttcatcctgattctctttttccttacactttgtggatcatgtgccagcttcgtgtgttctcaattttgagtcatggtctcagctttgactcaaaagtcaagagcttcattctctgcttctaaggaatttaggtttctgcaactgatcaataatctttgcaatcatatttttgttttcaatatcctcctcatggttcttgtatccttctttcttcttttcataactttgggttatgtttctgctaccagcagagattcttagctatatgtttctgaataaactctgaaccatcctcaaaaaaaaaaaaaaaaaaaaaaaa

SEQ ID NO: 59698 - DNA, 975 bp, Homo sapiens
cagaactccaccctctacccctgacaccatgacccactgttgttccccttgctgtcagcctacgtgctgcaggaccacctgctggaagcccaccactgtgaccacctgcagcagcacaccctgctgccagccctcctgctgtgtgtccagctgctgccagccttgctgccgcccaacttgctgtcaaaacacctgctgccagcccatctgtgtgaccagctgctgccagccttcctgctgcagcacaccctgctgtcagcccacctgctgtggccaaaccagctgtgggtccagctgtggtcagagcagctcctgtgcacctgtgtactgcagaagaacctgctaccaccccacgactgtctgcctgcctggttgcctaaaccagagctgtggctccagctgctgccagccctgctgccgcccagcctgctgtgagaccacctgctgcaggacaacttgcttccagcccacctgtgtgtacagctgctgccagccttcttgctgctgatcaagtcccaagagaaccaccatactcacacaacaaatttctgctcaactgactcatcttttgggggactaatttaatttgctgctgacagccaccatgctttcacccaaatttttatgaattctctgcatgtttaaaatcttgtgaatcagcctgagggagggcagaatacttcatcttgattctctttttccttacaccttgtggatcatgtgccagcttcgtctgttctcaatttggaatcatgatctcaactttgactcaaaagtcaagaggttcattctctgcttctaaggaatataggtttctgcaaccgaccaataatttttgcaatcacatttttgttttcaatatcctcctcatggttcttgtattcttctttattcttttcatgataactttgagttatgtccttggtaacagagattcttacctatatatttctgaataaactcttaaccatcctc

SEQ ID NO: 59699 - DNA, 1616 bp, Homo sapiens
gagaatttagactctgtcttcagccaggcactccctccctccctcccagcactatgccctacaacttctgcctgcccagcctgagctgccgcaccagctgctcctcccggccctgcgtgccccccagctgccacagctgcaccctgcccggggcctgcaacatccccgccaatgtgagcaactgcaactggttctgcgagggctccttcaatggtagcgagaaggagactatgcagttcctgaacgaccgcctggccagctacctggagaaagtgcgtcagctggagcgggacaacgcggagctggagaacctcatccgggagcggtctcagcagcaggagcccttgctgtgccccagttaccagtcctattttaagaccattgaggagctccagcagaagatcctgtgtaccaagtctgagaatgccaggcttgtggtgcagatcgacaacgccaagctggctgcggatgatttcagaaccaagtaccagaccgagctgtccctgcggcagctggtggagtcggacatcaacggtctgcgcaggatcctggatgagctgaccctgtgcaagtccgacctggaggcccaggtggagtccctgaaggaggagctgctctgcctcaagagcaaccatgagcaggaggtcaataccctgcgctgccagcttggagaccgcctcaatgtggaggtggatgctgctcccactgtggacctgaatcgggtgctgaacgagaccaggagtcagtatgaggccctggtggaaaccaaccgcagggaagtggagcaatggttcaccacgcagaccgaggagctgaacaagcaggtggtatccagctcagagcagctgcagtcctaccaggcggagatcatcgagctgagacgcacagtcaacgccctggagatcgagctgcaggcccagcacaacctgcgagactctctggaaaacacgctgacagagagtgaggcccgctacagctcccagctgtcccaggtgcagagcctgatcaccaacgtggagtcccagctggcggagatccgcagtgacctggagcggcagaaccaggagtaccaggtgctgctggatgtgcgtgcccggctggagtgtgagatcaacacataccggagcctgctggagagcgaggactgcaatctgcccagcaatccctgtgccacgaccaacgcgtgcagcaagcccatcggaccctgtctctccaatccctgtacctcttgtgtccctcctgccccctgcacaccctgtgccccacgcccccgctgtgggccctgcaattccttcgtgcgctagaacctagggaatgccagaggagcaaggatgcagggcccaggactccagagctgtgacctggctctggttcaacaaaaggggcctgaaaacatcatttgcatggctggagttgcccgcgtaaggcagccaagaaactcacccaaagcctgtagcctccccaactactccagactgtcctgctcaccctttccttcctgggggtctgttccttcctatgctcacccagagaactctctgatgtgccagtgggcctcccttttaacctcctaataaatatcatttccttggcaaaaaaaaaaaaaaaaaaaaaaa

SEQ ID NO: 59700 - DNA, 1708 bp, Homo sapiens
ggcggcatggggtctgtagacatccaggtagctgtggctgaggagaaagggcctctccaacatgacatcctcctgctgtgtcaccaacaacttgcaagcctctctcaagagctgcccccggcctgcctcggtctgttccagcggcgtgaactgccggcctgagctgtgcctgggctatgtctgccagcccatggcatgcctgccttcggtctgcctgcccaccaccttccggccagccagctgcctctccaaaacctatctatccagttcctgccaggcagccagtggcatctccggctccatgggccccggcagctggtacagcgaaggggccttcaatggcaatgagaaggaaaccatgcagttccttaacgaccgcctggccagctacctgacgagggtgcggcagctggagcaggagaatgcggagctggagagcaggatccaagaggcctctcactcccaggtgctcaccatgactcctgactaccagtctcatttcaggaccattgaggagctccagcagaagattctgtgtaccaaggcagagaatgccaggatggttgtgaacattgataatgccaaactggctgccgatgacttcagggccaagtacgaggcagagctggccatgcggcagctggtggaggccgacatcaatggcctgcgcaggatcctggatgatctcactctgtgcaaggctgacctggaggcccaggttgagtccctgaaggaggagctgatgtgcctcaaaaagaaccatgaggaggaagtcggttcccttcgatgccagcttggggaccgccttaacatcgaggtggacgctgcacccccggtggacctgaccagggtgctggaggagatgcggtgtcagtacgaggccatggtggaggccaaccgcagggacgtggaggaatggttcaatatgcagatggaggagcttaaccaacaggtggccacaagctctgagcagcttcagaactaccagtcagacatcattgacctgagacgcacggtcaacacgctggagatcgagctgcaggcccagcacagcctgagggactccctggaaaacacgctgacggagagtgaggcccgctacagctcccagctggcccagatgcagtgcatgatcaccaacgttgaggcccagctggctgagatccgggctgacctggagcggcagaaccaggagtaccaggtgctgctggacgtccgggcccggctggagggcgagatcaacacgtaccggagcctgctggagagcgaggactgcaagctgccctgtaacccatgctccactccttcctgcaccacctgtgtgccctccccatgcgtgacccgcaccgtctgtgtgccacgcactgttggcatgccttgctcaccctgcccccagggccgctactgaagtccctttgtgccagtggatcctggagggcctggggctgggcagcctggtattcagtggccaccagaagagcagggccagccccggtcagcaaggaagaccctgagcaggaccgtggatcacctgcaacaagctctgatactccaggggatacttaagccctcatcacttcaaaactgcctcttttttccatgggtgaactgttctctttggtgatgtttctggttgtctgtgctgcctcaaagagcgtgtgttcttagttaactggcaaatagagctgtactcagtggccttgcaaac

SEQ ID NO: 59701 - DNA, 2054 bp, Homo sapiens
tgggctcaaatgacaggtccctttgaagaactgacagggacttggtcttcccagtgatgtggggtggtggagatgagtcttgacatagtaatggggctcctattttatgagactggtaaattttcacaggaaactaaataacaggttaatgaggggttttaatagaaagtggtgttaactttaatgaggagaaaacactttgtaaaggccaaccaatgcccactggggcagagatataaatctggggtaaggagctgcttctctgctttggggtgtctggcctcagagacctatcaattgcatctgagttgcaggggccatggcttccaaatgcctcaaggccggcttctcttctgggtctctcaagagcccaggaggggccagtgggggctccactcgtgtgtccgcaatgtactccagcagctcttgcaagcttccaagtctctcccctgtggccagaagtttctctgcctgctcagtgggtctgggcagaagcagctacagggccaccagctgcctccctgctctctgcctccctgctggaggcttcgctaccagctacagtgggggtgggggctggtttggggagggcatcctcactggcaatgagaaggagaccatgcaatccctgaacgaccgcctggccggctacctggagaaggtgcgtcagctggagcaggagaacgccagcctggagagccgcatccgtgagtggtgtgagcagcaggtcccctacatgtgccctgactaccagtcctacttccggaccatcgaggagctccagaagaagactctatgcagcaaggctgagaatgccaggctggtggtggagattgacaatgccaaattggctgcagatgacttcaggaccaagtatgagacggaggtgtccctgcggcagctggtggagtcagacatcaacggcctgcgcaggatcctggatgacctgaccctgtgcaagtctgacctggaggcccaggtggagtccctgaaggaggagctgctctgcctgaagaagaaccatgaggaggaagtgaactcactgcgctgccaacttggtgaccgcctcaatgttgaggtggacgctgccccacctgttgacctgaaccgagttctggaggagatgaggtgccagtatgaaaccctggtggagaataaccgccgggatgctgaagactggttggacacccagagtgaggagctgaaccagcaggtggtgtccagctcagagcagttgcagtcctgccaggcagagatcatcgagctgagacgcacggtcaacgccctggagattgagctgcaggctcagcacagcatgagagatgctttggaatccaccctggcagagacggaggcccgctatagctcccagctggcccagatgcagtgcatgatcaccaacgtggaggcccagctggccgagatccgggctgacctggagcggcagaaccaggagtaccaggtgctgctggacgtccgggcccggctggagtgtgagatcaacacgtaccggggcctgctggagagtgaggacagcaagctcccctgtaacccatgtgcacctgactactcaccctccaagtcatgccttccctgtcttcctgcggcctcctgcggtcctagtgcagcccgcacaaactgcagcccccgccccatttgtgtgccctgcccagggggtcggttctgagagcgggtgacccagatggccatggctattgtctccagggcttgaacttggcctctacccaaacttaacccttgtagcccaatcccctctcttcgcgcagagcccaggcccagggtctggctgaaaaggctttctgcaaatacatgccctaaagtttctcagagcctgtcacaaaggccggctgcccccaaaggtctcaactcctcatcatttcaatgggtgccagggtctctgttctcaggctgcctcctgggtcaggttttccttctaggtgctgttccggtggattctgaaatgcagtagagggcttttgttggcagaacaataaagtgcatttgctcaggcccctgatgcctaacttgcacca

SEQ ID NO: 59702 - DNA, 3965 bp, Homo sapiens
agcgggatgcaccgctgcggggaccccccgcccggcctcgcggacccgcctcggcccaggacggaggaggaggtggtgaaacaggaagcaacatcccatcaggaagaacctgagggtgccatccagtagcttcgcctcacgtcactgactgccctcagtcagaaatcttgactcgcaactttggagggtgggtctctgaaggaatttcaggtcttacacagagatgagttgtgctgctctctgaggagaacgaagctggttggaacgttggaagctgctctctgactacacttcacaagcaaggggcaccttttgtggactgacatttcagaaagggatgttgtgaaacaaaagctgacatttatatatatatacatatatacagtatttgagttcctcagtagaaagctatcatatatactcagaatgttttggacgtttaaagaatggttctggttggaaagattctggcttcctccaacaataaagtggtcagatcttgaggatcacgatggactcgtctttgtaaaaccttctcatttatacgtgacaattccatatgcttttctcttgctgattatcaggcgtgtatttgaaaaatttgttgcttcacctctagcaaaatcatttggcattaaagagacagttcgaaaggttacaccaaatactgtcttagagaattttttcaaacattccacaaggcaaccattgcaaactgatatttatggactggcaaagaagtgtaacttgacggagcgccaggtggaaagatggtttaggagtcggcggaatcaagagaggccttccaggctgaagaaattccaggaagcttgctggagatttgcattttacttaatgatcactgttgctggaattgcgtttctttatgataaaccttggctatatgacttatgggaggtttggaatggctatcccaaacagcccctgctgccatcccagtactggtactacattttagaaatgagtttttattggtctctgttatttagacttggctttgatgtcaagagaaaggattttctagctcatatcatccaccacctggctgctattagtctgatgagcttctcttggtgtgctaattatattcgcagtgggaccctcgtgatgattgtacacgatgtggctgacatttggctggagtctgctaagatgttttcttatgctggatggacgcagacctgtaacaccctgtttttcatcttctccaccatatttttcatcagccgcctcattgtttttcctttctggattttatattgcacgctgatcttgcctatgtatcacctcgagcctttcttttcatacatcttcctcaacctacagctcatgatcttgcaggtccttcacctttactggggttattacatcttgaagatgctcaacagatgtatattcatgaagagcatccaggatgtgaggagtgatgacgaggattatgaagaggaagaggaagaggaagaagaagaggctaccaaaggcaaagagatggattgtttaaagaacggcctcggggctgagaggcacctcattcccaatggccagcatggccattagctggaagcctacaggactcccatggcacagcatgctgcaagtactgttggcagcctggcttccaggccccacacagaccccacattctgcccttccctctttctcaccaccgccttccctcccacctaagatgtgtttaccaaaatgttgttaacttgtgttaaaatgttaaatataagcatgcccatggatttttactgcagttaggactcagactggtcaaagatttcaaagatttctccacagaaccgtctcagttctaattgcactccctcatgcatgtcactttctcaggggctcgctttgttatagaccctttcgcctcgccaccttgcctgtcctcaggacgctttcacaggtgctaagtgatctcatttttcccaggtgtgtttggccacaaagagcagcttctttctcaaaatgagttagaagtggcagtgggacaggagcggaaggaccacaccaggagacacttccatcctgaagcttaggtgcctcatctccacagggcggtggcagtccctgcctgccaccccacagggttgcagcaaggattaagtgagatcacagaagtttaagtacacactgtcaaccgtggggtcatcgtgaaccaacccactttgcactgtttgggagacagaaacctggctaaacatggcactgcaatgggcctgaacaaaaggcagaatctttaaaaattcctcttaaatgactctggagatacctggaaatgaaagtgccaagaaaggtgttccattttatttgctaactatttatgcattagctccccaagggtcattctcagattctcctggaattcttctccctcaggacccatggttcaaggaaggaagcttaggccctgttccttcctgtcctttgctggtctttcccttttttcctttctaggagggaagcttctgtgctgctgccctgagcccttccttcaggccagcacagtacctggggacctccacgggggaatgggatccaggccaggttgcttgctgagcctcatcacccaggaggcctgagcctctggggagggcacgcatgtacactgccagacccaggggagatcttgggaacagaggatgctacgtgatttcctctggcttccaacccaatcagcctgcatcacagtgaaacacaacacaaaaggccataaaaggcatacccctgagaaatgtttaagggcaggtgctagagtcagtgccagctccctgggaggagggatagggacgggcagatcagtagccagcttgtcctcaccctcaggaagggagcaccggagaagacttgcacacgtccctgcctcccttgcggccttgtcaccagagggacacatctcctgggcacaatgtgcagggctgacctgggagacttctcaggtggctgctggctgaggagaggccaggccttcccaaggaagaccctgagtaaaatctgcatctgtcctcaccacctggcacagtctctcataacggtcagattttgtatgttcatcctatttattcaggggctcgtactagaaagccacaggagaggtcggcttgtagggactggaaaatcagccccaagcagagcagctgcagggcccctggagccggaaggacactgcacagaacagactgcgttattgttatttttaaataaaaatatacatttgaaaccttaaggctaaacaaaaataaacaaaaaatcctttagaattctttccacaacaatatctctttctgagaaattgttacaaacaaggtcagattttctctgtataacatttgcttttatgaggacaatatcatatgcattatatgcataatatgatattataaatcaaaatgcctgcacccactttagggtatagctattgacttattattaatattatattattattattttgctggaagaaggtcacactaagatataattttttatgttttcagttaacggtatgttttcttctttgcttatttggtttttgtctctgtaccaaatatcttcttgcttaaggtagaaaagtatttgtttacctctatctccagttttttttcttatttgaatgttgaaggtaaaattgatataccaattttaactatttctgatacagctgaaagcactaaactacttcataagaagtagatactcatttttgtaacactatttagggcttttgtggttaattttaaaggaaaccactctttctacaggaaacaagggctcaggattcttcagatgaccttataaaaatgcagtccacagtgctatcaatattgtaacagtaatgactacaataaagccaaaagtccagtgtaaaaaaaaaaaaaaaaaaaaaaaaaaaaaaaaaaaaaaaaaaaaaaaaaaaaagaaaaaaaaaaaaaaaa

SEQ ID NO: 59703 - DNA, 1197 bp, Homo sapiens
gttctgaacttctatgtccttacaacaaggtaatctagaaaattcttccaagagagaatgactgtttccccttgagaaacaattttatttccaaacccctttctagattgttttcatgattcaggtgtgtagttgaagcagaatgtctcctctacatactacatgcttgattttgagaatactttcttaatatcttttggcttcggttttctaattataaaatagttgaaaatgctttatgattttataagtatataaaaagcattaggttcaaaacagaggctataagtgtgtttagccaactattagacacaatgaaacttcccgtgattaattagctacaactacactaagcagttcatcaaaatgtagggattagaaatgatgctgaaagggcaagaataggccggggtggcctctacctgggtctaacttgctgtctgactctctctcagctcctgaacacccgcaccaagatgtcctgccagcagaaccagcagcagtgccagccccctcccaagtgcatccccaagtgccctcccaagtgcctcacccctagatgccccccaaagtgtccccctaagtgtcctccagtctcttcctgctgcagtgtcagctccggaggctgctgtggctccagctctgggggaagctgtggctccagctctgggggttgctgcagttctgggggaggtggctgctgcctgagccaccacaggcgccgtaggtcccactgccacagaccccagagctctggctgctgcagccagccctccgggggctccagctgctgtggaggagggagtggccagcactctggaggctgctgctaaagtggatcctgagcctagaagaacacaaatggccaaatatttcccttccgtcttccttctccttctgggcctgcccatgttgttgagaggtcttggtgagggctcaactcaagcatagaggattcttctgtcttggagttcagaggcccaaaacttctcccccaaagccaagccatttaatgacctcagtttgcgtatgtgtggttgctctgggaagcccaaagcacagacctatatccctttgcagcttgtctttttgcatagctcagcctgatgtgaaacaataaaaccagaaatatgcattccaaaaaaaaaaaaaaaaaaaaaaaaaaaaaaaaaaaaaaaaaaaaaaaaaaaaaaaaaa

SEQ ID NO: 59704 - DNA, 695 bp, Homo sapiens
gctgaaggaccctgtgctgcctgtgaccccgctcctgaatccgccaccaagatgtcctgccagcagagccagcagcagtgccagccccctcccaagtgcacccccaagtgccctcccaagtgccccaccccaaagtgtcccccaaagtgtccccctaagtgccctcctgtctcttcctgctgcagtgtcagctccggaggctgctgtggctccagctctgggggcagctgtggctccagctctgggggatgctgcagttctgggggaggtggctgctgcctgagccaccacaggcgccgtaggtcccactgccacagaccccagagctctggctgctgcagccagccctcggggggctccagctgctgtggcggggggagtggccagcactctggaggctgctgctgaagtggaccctgagcctagaagagcagaatccaggaccgcaaactgccaaggacatcccccttctcctactaggcctgcctgagaggctcacaggtccaagggaaagctctgaacttgccaagagcatatcttttccctggagtccagaaactcagatcctctcctggatctccattcactggccttggacctcacctttgtggctaccctcccacgctctgtctaagcccctagcttactcaatgtcatttgcagcgtgcatctgctgattaaaggactaaaacaag

SEQ ID NO: 59705 - DNA, 1210 bp, Homo sapiens
gccgaaggaccctgtgctgcctgtgactttgctcctaagtacctactgccgagatgtcctgccagcagagccagcagcagtgccagccccctcccaagtgcactcccaagtgccctcccaagtgtcccacccccaaatgccctccaaagtgtccccctaagtgccctccagtctcttcctgctgcagtgtcagctccggaggctgctgtggctccagctctgggggcagctgtggctccagctctgggggctgctgcagctctgggggaggtggctgctgcctgagccaccacaggcaccacaggtcccaccgtcacagaccccagagctctgactgctgcagccagccctcagggggctccagctgctgtggagggggcagcggccagcactctggaggctgctgctgaagtggaccttgacttcctcttccttctgattctgcctgaatagctgagaggttccagcaaaagcttgaagtcttgcctggagaatccctctgctctggtgtcaggaaacccaaaatctttctccttaatggcatttagagactttcttctgcagatccatggctgccctgggaactccaaagcacacacctacttcctccccagctcacgctgctgtattctgtgctgcctgaactgaagaaataaaatccagaatctgccccccaacttgctaccagcctgcttgattttcctgtttgtgtcatccttgttctgctcccctgtgtctgctggtggctgctgaggccttggtggacagaggatggggaaaggggtcaggaggaaaaagcttgcatttctgtgtgttttgtgttttttcttctttcggtgttttccttttaaaccaagggactgaaatagcattgagaaatatttttctttcaaattctggttcctttcacctatgtaaccgcatccctcaggcatggccaggaggccgacttcatcctccttcccactatcacctcttcattcttgtgttcctcgttccccactccttccactaacaatctccctggactcctcctccatactgtatgtgcatgcattcacacacacatatgtacatgcacatagatgagatgaatctgcattgtaaaaaaattaaatcacatttagtgctgtataatttgcatgcaataaaattcaataaaattaaatgtaaaattaaaaaaaaaaaaaaaaaaaaaaaaaaaaaaaaa

SEQ ID NO: 59706 - DNA, 592 bp, Homo sapiens
ggacgtgtctgtgctcctgtgtgtgaccagggttgaaaaagtcgcactgagatgtcctgccagcaaaaccagcagcagtgccagccccctcccaagtgccccccaaaatgcccacccaagtgtcctccaaagtgccgacctcagtgcccagccccatgcccacctccagtctcttcctgctgtggtcccagctctgggggctgctgcggctccagctctgggggctgctgcagctctgggggtggcggctgctgcctgagccaccacaggccccgtctcttccaccggcaccggcaccagagccccgattgttgtgagtgtgaaccttctgggggctctggctgctgccacagctctggggactgctgctgaccagacctcgaacatcacagagcaacccttatggagaaacttgcaaccaggacctgtcccagagtgatgcttctcctgcccctttttctcctttccttgggctgacacaccttgtgaggtgttttgtctgttgtcatggcccaagagcccatcctggatcctgatcttaccttcccactttacctcatacaacaataaagctcttttgcctcttcgtgaa

SEQ ID NO: 59707 - DNA, 614 bp, Homo sapiens
cagggacgtgtctgtgctcctgcgtgtgaccagggttgactaaactcctgccagcatgtcttgccagcaaaaccagcagcagtgccagccccctcccaagtgtcctcccaagtgtaccccaaaatgtccacctaagtgtccccccaaatgcccaccacagtgcccagctccatgtttccctgcagtctcttcttgctgtggtcccagctctgggagctgctgtggtcccagctctgggggctgctgcagctctggggctggtggctgctccctgagccaccacaggccccgtctcttccaccggcgccggcaccagagccccgactgctgtgagagtgaaccttctgggggctctggctgctgccacagctctgggggctgctgctgacctgggctacagaagagctcttgggactgaatggccaagaacctgctacggcctgatggatactctttccacttcctctcattccattcattggttggcagagaccacaaagactcatggggctttcctggaagaacttcgtgcttgatgtaacaccccaattgcaagtcttcttttcctcctttacctcatgttataataaagctctgatctctgactcactaaa

SEQ ID NO: 59708 - DNA, 617 bp, Homo sapiens
ctcaggaacagccttctcctgcctcctctgcacctggacaactcaactcctgccaagatgtcctgccagcagaaccagcagcagtgccaacccccacccaagtgtccctcacccaagtgtcccccaaagagcccagtacagtgtctgcctccagcttcctctggctgtgccccaagctctgggggctgtggccctagctccgagggcggctgcttcctgaaccaccacaggcgccaccaccgatgccggcgccagaggcccaactcctgtgacaggggcagtggtcagcaaggcgggggctctggctgcggccatggctctggaggctgctgctgacctggatcctgatgctgagacaagcgattttggaggaaacaagaatcccaagggcccaggaaaaccccatcttgatgcatgagttcccagataccctcttctggctttcacaggctgagctaggggttttcctgtggaaggtctgagctctccccagaaggcacttcctgtctgatgtccaggatgtcacatgttcccttacccctgtacctgtgaaggattggcagtgcttgtgcctgacctcatcaaaaaataaagctccttgtcctcattaaaaaaaa

SEQ ID NO: 59709 - DNA, 611 bp, Homo sapiens
ctcaggaacagccttctcctgcctctctgcacctggacatctcaactcctgccaagatgtcctgccagcagaaccagaagcagtgccaacccccacccaagtgcccctcacccaagtgtcccccaaagaacccagtacagtgtctgcctccagcttcctctggctgtgccccaagctctgggggctgtggccctagctccgagggcggctgcttcctgaaccaccacaggcgccaccaccgatgccggcgccagaggtccaactcctgtgacaggggcagtggtcagcaaggcgggggctctggctgctgccacggttctgggggctgctgctgatccagatcctgatgctgagacaagcgatctttggaggaaacaagaatcccaagaggccaagaacagccccatctgacgcatgccttcccatataccctcttctgactttcacaggctgagctggaggttttcctgtgggggatctgagctctccccagaaggcacttcttgttttatgtacaggatgtcatatgtccccctacccctgtacctgccaaggattggcagtgcttgtgcccaacctcgtaaaaaagataaagttccttgtcctcatta

SEQ ID NO: 59710 - DNA, 835 bp, Homo sapiens
caggtagagtgcttctcaggaccaggatgaactcttggtgctggtgttttgggcagaaagagcccctgggtggaggttgaggccattcttgaagaaagacaaggataaagaaggattttggaggggaaggttcttctggaaggggagggtggaagctttattcagcttctacagagatgtcctgccagcagagccagcagcagtgccagcctcctcccaaatgtacccctaaatgccctcccaagtgtactcctaagtgtcctcccaagtgtcccccaaaatgccctccccagtgttcagccccatgcccacctccagtctcttcctgctgtggttccagctctgggggctgctgcagctctgagggtggtggctgctgcctgagccaccacaggccccgccagtccctccgacgccgacctcagagttccagctgctgtggcagtggcagtggccagcagtctgggggctccagctgctgccacagctctgggggctctggctgctgccacagctctggaggctgctgctgacctgggccatgaggagcacggaggagaaggactggcagatcccaggtgctgaagatgtgtgtcagcctgaggcttcttttctctcatttcccatggaaggacttcggaaatgccttaagttcccctctttatcctgctcatgttcactccattgtagggttgaagtctagcttgtgatattttctggcctggctttccctctcagacatagctctttggagaactaggtgttgtaattcagttatgaagctattttctctgtaacaataaagctttttattcctgaaaaaaaaaaaaaaaaa

SEQ ID NO: 59711 - DNA, 498 bp, Homo sapiens
ttaaagcaaagaattccccggtcccagccatgtccaacgtcccccacaagtcctcgctgcccgagggcatccgccctggcacggtgctgagaattcgcggcttggttcctcccaatgccagcaggttccatgtaaacctgctgtgcggggaggagcagggctccgatgccgccctgcatttcaacccccggctggacacgtcggaggtggtcttcaacagcaaggagcaaggctcctggggccgcgaggagcgcgggccgggcgttcctttccagcgcgggcagcccttcgaggtgctcatcatcgcgtcagacgacggcttcaaggccgtggttggggacgcccagtaccaccacttccgccaccgcctgccgctggcgcgcgtgcgcctggtggaggtgggcggggacgtgcagctggactccgtgaggatcttctgagcagaagcccaggcggcccggggccttggctggcaaataaagcgttagcccgcagcgc

SEQ ID NO: 59712 - DNA, 3411 bp, Homo sapiens
agtcattggaggtgctttctgctgagtgagcgccctgggtggtgtgcataaatgagctgccacttcccagggagccctccgtgggctcttgctggtcagcccggggcctcagcccccgactggtccacacctgacccattcgccgccttcctgctctcccaggtgcaagccctggaacagcgcaaccagctgctggagacacgctggagcttcctgcagggccaggactcagccatcttcgacctcgggcatctctatgaggaatatcagggccggctgcaggaggaactgcgcaaagtgagccaggagcgggggcagctggaggccaacctgctgcaggtgctggagaaggttgaggagtttcgaatcaggtatgaggatgagatctccaagcgcacagacatggagttcacctttgttcagctgaagaaggtagcctgcccagcctgccccaggggctccttcctcatgggccctgggccctctttccctccagatatcctactctcctttatgcccaatcaaagccctcagaggcttaagtcccaggaccaacagacagacagggggatacccccatccccatccagctcctttttcgaggctctgagccagatctcctctggaatcacccccactctcacccaggaggcagccccccagcccactcctgccctgggaccctccattccctctcccaccactcaccactgctgccaaccccaggacctggatgcagagtgtcttcatcggactgagctggaaaccaagttaaaaagcctggagagcttcgtggagttgatgaaaaccatctatgagcaggagctgaaggacctggcagcacaggtgaaggatgtgtcggtgaccgtcggcatggacagccgctgccacatcgacctgagcggcatcgtggaggaggtgaaggcccagtatgacgccgtcgcggctcgcagcctggaggaggccgaggcatactctcggagccagctggaggagcaggccgcccgctcggccgagtatgggagcagcctccagagcagccgcagtgagatcgcggatctcaatgtgcgcatccagaagctgcggtcccagatcctctctgtcaagagccattgcctgaaactggaggagaacatcaagacagctgaggagcagggtgagctggccttccaggatgccaagaccaagctggcccagctggaggccgccctgcagcaggccaagcaggacatggcgcggcagctgcgcaagtaccaggagctgatgaacgtcaagctggccctggacatcgagatcgccacctacaggaagctggtggagggcgaggagggcaggatggactcgccctcagccactgtggtcagcgctgtgcagtccaggtgcaaaaccgctgcctccagatcaggcctctccaaggccccctcccgaaagaagaagggcagcaaaggccccgtgatcaaaatcaccgaaatgtcagagaagtacttctcgcaggagtcggaggtctcagagtaaggcggctggaccccaggaaccccagggcactccactgcagcaggagggacttaagctagactcaagaaagcagcttggagcctctaggttgagaagagaggcaaaacctgatattgaactgagagaggggttcaaaactgactgtgttttgtgagctgccagggtgggaggggagcatcaccagctcctcagagccactccgctccatatcagtatctcacagtcccatccttccaaccttctggccagaggttttcctgatgggtgagtcggaattaggggtcagttttgtctccacctcctcgctcctctgaggctcctcctccagcatcaggctctgccaaggcccctctgactcttgcccaatccttgaccttgactcctatctcaagccttgccttgtctctgcctcggaactgggactgggactggctcatccacctatgtgcgggagccgaggaggacggcgtgggccctgtcctgtatctggaattcctgggaaggctggctgctgaagaccctcttggctttcccgtgctctttgggctccccagagacctgacagtattagggagtgaagggaggaggggccctggctatttgggacctaagcctaggccccagagatcagcccgaacacccgcatcccttcctcctcccatgggtccctcccagtaggcagtagtcagaactggatgggctgcccccagccagctcccagcagcttctccggaagctgctcttgccataatcaactccctgggagtggaagccagatggcagcttgagattgggcaggagcattcgatcttcctttcacctccctgccatgctggggtcctacccagcctggatctgagctctgtgcccccagccgggttgttcccagcctgagcaccgggctttggtgcaccaggccttggagacccctggtcccacccctgccgtgaagccccaggcccacttcccaagaatctcacttctcagggcctctgttctcctctccactgggccaaatagcctggccctcccctccttggcattcatgggggagcccaggaaccccccacacctatggggttagagctcctcctttcttctcactccttccccttcctccctccatgcccactccccctgcctccagcaggccaggaagaaggcacagtccaggcaagtctgggagcttccaagcccttgaggtccagctgtggggcccaaatgacagccttacaagggttctaccagagaggaaaattccacatcccaccagaagacaggggtgttggcaggcatactcctatctcctcctcttggctctcaatgctgaggcttgcagaggcatcccagcggcaccagcctcccactgcacagcttccttccctccttcactctcctctcccctccctgccccttgcctcacctcctcttctagactgcattagattcattcatctcattttccaggacatgttggccagaggtctgggcccatcccaggcctcaaggccctccaggcctgtggggagcactggagggttactgactctctggccatgggaactcagagattctcatccccaaagtcccaaaagagggtgctgattggtgcttttcctcaggctcttcattggtttccaagggagcaaatcctcagtggggatacaagacatataaagtatatattattttttcataacttatgtggcttttaacttattgcttcccttcctgtttctgcatgatcagtctgtatgtactatctggaaagataacacatactccagccacctcacctgattggctatcttggggccatgtccccttcttgctgccacaggatgaataaagtgttgagatttgtctatggagaaaaaaaaaaaaaaaaaaaaaaaa

SEQ ID NO: 59713 - DNA, 1973 bp, Homo sapiens
agtcgcgcagcctcgagggatggaggaggtgcgtgagggacacgcgctcggtggcgggatggaagccgatgggcccgcgagcctccaggagctgcctccctcgccacggtcgccttcaccgccgccgtcgccgccaccactgccctcgccgccgtcgctgccatcgcccgcagccccggaggcccccgagctccccgagccggcgcagccgtccgaggctcacgcccggcagctgctgctggaggagtgggggccgctgagcgggggcctggagctgccccagcgcctcacctggaagctgctcctgttgcggcggccgctctaccgcaacctgctgcgctcgcccaaccccgaaggcatcaacatttatgagccagcaccccctactggtcccacccagcgacccctggaaactctgggcaatttccgtggctggtacattagaactgaaaagctccagcagaaccaaagctggacagtgaagcagcagtgtgtggaccttctggccgagggcctgtgggaggagctgctggatgacgaacaaccagccattacggtcatggactggttcgaggacagccggctggatgcgtgcgtctatgagctgcatgtctggctgctggcggccgaccgccgcacggtcattgctcagcaccacgtggccccccgaacttctgggagaggaccccctggccgctgggtccaggtgtcccacgtattccgccattatggtcccggtgtgcgctttatccacttcctgcacaaggccaagaaccgcatggagcctggtgggctgcggcggacacgggtgaccgactcctccgtgtctgtgcagctccgggagtgactggctggctcctctgtcctgaccccacagcacctccctgacctttaggagccccaactcttagtcacctcctaggcctcttatttctccctggcccttggcttctcacttgatggacagcttcacacacccttaagcggtggactccagcattttcccagcactgtctgagccccatgagggcggagccactccttgtaaattcagtgcccgacagatgctctggcacagatgctttgtagatctctgttgagagaatgcatagacacctgtgcccaaggatgctgagggctggtctctgcttctttgaacttcactgaaactgaatgctcactgctgtgttgccagcaccacccagcccagggctgtgaacggagtgggtggcagcaaatgtgtgttgaaaggggaatgaagccattcacttcactcagttcctgtcccatttaaccgccccgatccttgatcttccattaccttcacatcccggggtccttctgaactgaccttgacctctgatctcttcacacatctccccttagcatctccacttacctacttttttttttttttttgagatggcatctcactctgtcacccaggctggagtgtagtgacacgatctcgactcactgcaatttccacctctcaggttcaagtggttctcctgcctcagcctctcaagtagctgggattacaggtgcacagcacctcccccgactaatttttatatttttagtagagacgggatttcgccatgttggccaggctggtctcaaactcctgacctcaagtgatctgcccaccttggcttcccaaagtgctgggattgcagacgtgagtcactgcgcccagccattccatgtctcttaagtctcagaatctcccctagctccctccaggtgtctgcagtggttgtcccctcaaagctgtcccacaccctcctccgaggaccctttgtgtatctcctccagctaccgcagagcccacaaacccaggcatctatcaaagtccctcattcatgagggtggtgaggacacagactgcgaccagaacagaaatatgaaaatgtgaatgacagcgtcccccgtgtgtggaatgtggggattaaaagcatttatcaacctct

SEQ ID NO: 59714 - DNA, 1110 bp, Homo sapiens
gcgtgtgaacccccacagccctacacaacttggggcccctctcctccccagcccttctcctgtgtgcctgcctcctgccgccgccaccatgaccaccaccatccaccagttcacctcctccagctccatcaagggctcctccggcctgggagtggctcatcccgcacctcctgccggctgtctggcggcctgggtgccggctcctgcaggctgggatctgctggtggcctgggcagtgccctccggggtagcagctattccagctgctactgctttggctctggcggtggctatggcagcagctttgggggcgttgatgggctgctggccggaggtgagaaggccaccatgcagaacctcaatgaccgcctggcctcctacctggacaagatgcgcgccctggaggaggccaacactgagctggaggtgaagatccgtgactggtaccagaggcaggccccggggcccgcccgtgactacagccagtactacaggacaatcgaggagctgcagaacaagatcctcacagccaccttgaacaatgccaacatcctgctacagattgacaatgcccatctggctgctgctgacttctgcaccaagtttgagacagagcaggccctgcgcctgagtgtggaggccgccatcaatggcctgcgcagggtgctggatgggctgaccttggccagagccgacctggagatgcagattgagaacctcaaggaggagctggcctacctgaagaagaaccacgaggaggagataaacgccctgcgaggccaggtgggcggtgagatcaatgtggagatggacgctgccccaggcatggacctgagccgcatcctgaacgagatgcatgagtagtacgagaagatggcagagaagaaccgcaaggatgccaaggattggttcttcagcaagacagaggaactgaaacgcgaggtggctaccaacagcgaactggtccagagcggcaagagcaagatttcggagctctggcgcaccatgcaggccttggagatcgagctgcagtcccagctcagcatgaaagcatccctggagggcaacctggcggagacagagagccgctactgcatgcagctgtcccag

SEQ ID NO: 59715 - DNA, 821 bp, Homo sapiens
gcgtgtgaacccccacagccctacacaacttggggcccctctcctccccagcccttctcctgtgtgcctgcctcctgccgccgccaccatgaccaccaccatccaccagttcacctcctccagctccatcaagggctcctccggcctgggagtggctcatcccgcacctcctgccggctgtctggcggcctgggtgccggctcctgcaggctgggatctgctggtggcctgggcagtgccctccggggtagcagctattccagctgctactgctttggctctggcggtggctatggcagcagctttgggggcgttgatgggctgctggccggaggtgagaaggccaccatgcagaacctcaatgaccgcctggcctcctacctggacaagatgcgcgccctggaggaggccaacactgagctggaggtgaagatccgtgactggtaccagaggcaggccccggggcccgcccgtgactacagccagtactacaggacaatcgaggagctgcagaacaagatcctcacagccaccttgaacaatgccaacatcctgctacagattgacaatgcccatctggctgctgctgacttctgcaccaaggtgctggatgggctgaccttggccagagccgacctggagatgcagattgagaacctcaaggaggagctggcctacctgaagaagaaccacgaggaggagataaacgccctgcgaggccaggtgggcggtgagatcaatgtggagatggacgctgccccaggcatggacctgagccgcatcctgaacgagatgcatgagtagtacgagaagatggcaga

SEQ ID NO: 59716 - DNA, 938 bp, Homo sapiens
gcgtgtgaacccccacagccctacacaacttggggcccctctcctccccagcccttctcctgtgtgcctgcctcctgccgccgccaccatgaccaccaccatccaccagttcacctcctccagctccatcaagggctcctccggcctgggagtggctcatcccgcacctcctgccggctgtctggcggcctgggtgccggctcctgcaggctgggatctgctggtggcctgggcagtgccctccggggtagcagctattccagctgctactgctttggctctggcggtggctatggcagcagctttgggggcgttgatgggctgctggccggaggtgagaaggccaccatgcagaacctcaatgaccgcctggcctcctacctggacaagatgcgcgccctggaggaggccaacactgagctggaggtgaagatccgtgactggtaccagaggcaggccccggggcccgcccgtgactacagccagtactacaggacaatcgaggagctgcagaacaagatcctcacagccaccttgaacaatgccaacatcctgctacagattgacaatgcccatctggctgctgctgacttctgcaccaagtttgagacagagcaggccctgcgcctgagtgtggaggccgccatcaatggcctgcgcagggtgctggatgggctgaccttggccagagccgacctggagatgcagattgagaacctcaaggaggagctggcctacctgaagaagaaccacgaggaggtgaggtggctggggcagaaggtcaaagatgctgaggagtgggtggcagagccctggggccgggccatggctgaggccatgggagagagcagagcagagcaggcgcactgggattagtcaccttagagggcttccctgtctgcagagccctgatccttggggtctagcgtgcagggcag

SEQ ID NO: 59717 - DNA, 883 bp, Homo sapiens
atgggctgagtccctcttgctcacccttgacttggaaaaaccagtttctcttttattgtctgttactaatctctattctaaaaattcagctcaattctcaaccatactccaaactctctcttttccagctacctttactccctctccttcaattccactttcctctgcttactttttttttttttctgacagggtctcactttgtcgcccgggcaggagtgcagtggctcaatcttgggctcactgcagcctcaacctcccagaggcggggtttcaccatgttgcccagactggtcttgaactcctgagcttaagcaatccacctgcctcggcctcccaaagtgttgggatcacaggcgtgagccaccgcatccggcctcatgttctttttcattaaagagagaaatcaactattcaggaccggcccccacctttcctcaggagtcatttctgttccgcacaggcctgctgaactgggtgctttatataggacactgtcatctctcaagtacccatcttggagggtacggaccccacatgaggatttcagtggagtgaagttcaggaggcatggagctgacaaccatgaggcctcggcagccaccgccaccaccgccgccgccaccaccgtagcagcagcagcagcagcagcagcagcagcagcagcagcaagagtaactctgacttaggaatagagacagccagagagaaatgtgatcaatgaaggagacatctggagtgtgcgtgcttcttcagagggacgggtgatgggcagattggaaaaagcaccgcagatgggaaccttaatctttcttttctaaaattgatgctatgaaaatttgcgttttctgtaacttgtaaaaactaaaagttgcttgtctac

SEQ ID NO: 59718 - DNA, 975 bp, Homo sapiens
atgggctgagtccctcttgctcacccttgacttggaaaaaccagtttctcttttattgtctgttactaatctctattctaaaaattcagctcaattctcaaccatactccaaactctctcttttccagctacctttactccctctccttcaattccactttcctctgcttactttttttttttttctgacagggtctcactttgtcgcccgggcaggagtgcagtggctcaatcttgggctcactgcagcctcaacctcccaggttcaagcgattctcctgcctcagcccctcaagtagctgggactacaagcgcacaccaccacgcctgactaattttttgtatttttttgtagaggcggggtttcaccatgttgcccagactggtcttgaactcctgagcttaagcaatccacctgcctcggcctcccaaagtgttgggatcacaggcgtgagccaccgcatccggcctcatgttctttttcattaaagagagaaatcaactattcaggaccggcccccacctttcctcaggagtcatttctgttccgcacaggcctgctgaactgggtgctttatataggacactgtcatctctcaagtacccatcttggagggtacggaccccacatgaggatttcagtggagtgaagttcaggaggcatggagctgacaaccatgaggcctcggcagccaccgccaccaccgccgccgccaccaccgtagcagcagcagcagcagcagcagcagcagcagcagcagcaagagtaactctgacttaggaatagagacagccagagagaaatgtgatcaatgaaggagacatctggagtgtgcgtgcttcttcagagggacgggtgatgggcagattggaaaaagcaccgcagatgggaaccttaatctttcttttctaaaattgatgctatgaaaatttgcgttttctgtaacttgtaaaaactaaaagttgcttgtctac

SEQ ID NO: 59719 - DNA, 975 bp, Homo sapiens
cagaactccaccctctacccctgacaccatgacccactgttgttccccttgctgtcagcctacgtgctgcaggaccacctgctggaagcccaccactgtgaccacctgcagcagcacaccctgctgccagccctcctgctgtgtgtccagctgctgccagccttgctgccgcccaacttgctgtcaaaacacctgctgccagcccatctgtgtgaccagctgctgccagccttcctgctgcagcacaccctgctgtcagcccacctgctgtggccaaaccagctgtgggtccagctgtggtcagagcagctcctgtgcacctgtgtactgcagaagaacctgctaccaccccacgactgtctgcctgcctggttgcctaaaccagagctgtggctccaactgctgccagccctgctgccgcccagcctgctgtgagaccacctgctgcaggaccacttgcttccagcccacctgtgtgtccagctgctgccagccttcttgctgctgatcacgttccaagagaaccaccatcctcacacaacaaatttctgctcaactgactcatcttttgggggactaatttaatttgctgctgacagccaccatgctctcacccaaatttttatgaattctctacatgtttaaaatcttggaaatctgcttgagggagggcagaatacttcatcctgattctctttttccttacaccttgtggatcatgtgccagcttcatctgttctcaagtttgagtcatggtctcagctttgactctaaagtcaagagcttcattccctgcttctaaggaatttaggtttctgcaactgatcgatgatctttgcaatcttttttttgttttcaatatcctcctcatcgttcttgtatccttctttcttcttttcatgataaatttgtgttgtgtccctggtagcagaaatccttacctatatgtttctgaataaattctgaaccatcctc

SEQ ID NO: 59720 - DNA, 1065 bp, Homo sapiens
ctcctggaaacccaccgagaacctccaccctctgacaccatggtcaactcctgttgtggctctgtgtgctctgaccagggctgtggcctggagaactgctgccgccccagctgctgccagaccacctgctgcaggaccacctgctgccgccccagctgctgtgtgtccagctgctgcaggccccagtgctgccagtctgtgtgctgtcagcccacctgctgccgccccagctgctgtcagaccacctgctgtaggaccacctgctgccgccccagctgctgtgtgtccagctgctgcagaccccagtgctgccagtctgtgtgctgccagcccacctgctgccgccccagctgctgtcagaccacctgctgcaggaccacttgctgccgccccagctgctgtgtgtccagctgctgcagaccccagtgctgccagtctgtgtgctgccagcccacctgctgccgccccagctgctgcatctccagcagctgctgcccctcttgctgtgaatccagctgctgccgcccctgctgctgcctgcgtccagtctgtggccgagtctcctgccacaccacttgctatcgcccaacctgtgtcatctccacctgcccccgccccttgtgctgtgcctcctcttgctgctaaatctctgctgtgaacacaccacttccttattacgtcctttcctacagatgaaggctctcattgcaaacatgcggactgttcaagagaattgatctgggtcccataagcaaacctcatccttagaaattctgtatttgcattctaccttttgtccaaactcccttccttccaaaggaattcattgacaatctcctaataaattgacaaattgtcctccaacatcctcccacctctttgacttcaggacatttattcatcatgcctaaggaatttgaagattgcctccatcatttgtagggccacagatcttaaagcctccaaccttgaagtccagtgaagtctctctcttaaagtcttttgcaaacatttttgtaccttgttatttccatgtaccaaaataaacctctattctattggcac

SEQ ID NO: 59721 - DNA, 891 bp, Homo sapiens
cagccataattcagaaactcctccaagcaacccaaccttcagatcaactcctgacaccatggcctgctgtcagaccagcttctgtggatttcccagctgctccaccagtgggacctgcggctccagctgctgccagccaagctgctgtgagaccagctcctgccagccacgctgctgtgagaccagctgctgccagccaagctgctgccagaccagcttctgtggatttcctagcttctcaaccggtgggacttgtgactctagctgctgccagccaagctgctgtgaaactagctgctgccagccaagctgctaccagaccagctcctgcggaactggctgtggcattggtggtggcattggctatggccaggagggcagcagtggagctgtgagcacccgtatcaggtggtgccgcccagactgccgtgtggagggtacctgcctgcccccctgctgcgtggtgagctgcacacccccatcctgctgccagctgcaccacgccgaggcctcctgctgccgcccatcctactgtggacagtcctgttgccgcccagtctgctgctgctactgctctgagcccacttgttgaaaacctccttctgctggggatcctgataagatggcaccttaaaactagccaaattagaatcctaacaatcttctgaactccagtacctataactgggcttgcaacctctcatcacacagccacataaattccctaggaagtaaattcatttacaatggaagaccaaaaatttttcctagacctggttgtcagccaaagtcctacaatgtgaaaagagttagatactattttactataaatatcacctgaaatatttcaacagttattgggacttaaatttaataaaagttttcatctct

SEQ ID NO: 59722 - DNA, 1191 bp, Homo sapiens
tggaagtcaccaccaaacctcagaaactcctccaagcaacctaactcttaacccaacttctgacaccatgacctgctgccagaccagcttctgtggatatcccagcttctccatcagtgggacctgtggctccagctgctgccagccaagctgctgtgagaccagctgctgccagccacgcagctgccagactagcttctgcggatttcccagcttctcaaccagtgggacctgcagctccagttgctgccagccaagctgctgtgagaccagctgctgccagccaagctgctgtgagaccagctgctgccagccaagctgctgccagatcagctcctgcggaactggctgtggcattggtggtggcatcagctatggccaggagggcagcagtggagctgtgagcacccgtatcaggtggtgccgcccagacagtcgtgtggagggcacctacctacccccctgctgtgtggtgagctgcacgcccccatcctgctgccaactgcaccatgcccaggcctcctgctgccgcccgtcctactgtggacagtcctgctgccgcccagtctgctgctgtgagcccacttgctgaaagccagtttgcttattttcaattgcctaggtcacagtgtctctgaactgttcatcccttgaccacctctggaccactaacaagttctcagactttgcattgcttgtgatggagactactaagtatatgagctcacaattctatctgattccattctacaatgaataccttgacccttcactggggacacagaaatgctacaaagccacctgctgatcatcaatttgcttgggatatactatttctgatatttctgcaggattaaaaattactgacatgttgtggaatttatccatgagaactatccacaagtctaatgtttccatgctttataatctattttatcttgtttacctaaaattttttgcaacatcaaagacaccaaattatagccaagtgacattcctcaagtcaccagagagaatggaagctcatcacccaacattcagcttctaagaagtaggctggactttccacattttaacatctgatccatcccttggtttttggatcataatgatcttgcctgctggatatttcagttatatctgtgatacaatgtcttctgtcatttcttaataaatattatatactaggca

SEQ ID NO: 59723 - DNA, 582 bp, Homo sapiens
ctctcaactcaacaaaaacccacctcccattgccatgtattgctgtgctctccgctcctgcagcgtccccaccggccctgccaccaccttctgctcatttgataaaagctgccgctgtggagtctgcctacccagcacctgcccacatgagatcagcctccttcagcccatctgctgtgacacctgccccccaccctgctgcaagcctgatacctatgtgccaacttgctggctgctcaacaactgtcacccgactcccggactgagtgggatcaacctgaccacctatgttcagcctggctgtgagagtccctgtgagccccgctgttaaccagccgagtctgcacaggttccgtgaggtggctgcccaatgtcctctgcaccatctgggcttcagcactcactactgcctacatcaaggctaaggccatcccaatccccggggccaagtcttgatgaatcttcttaattatttgcacatttgggtaccattggagacctcccttctgtcttttaggctatttcatcactctttgagaaataaccattttgaccatttgttaataaactttattctggctt

SEQ ID NO: 59724 - DNA, 690 bp, Homo sapiens
ctaagaaactgaaagctaaccagacgcccattgccatggattgctgtgcctctcgcagctgcagtgtccccactgggcctgccaccaccatctgctcctccgacaaatcctgccgctgtggagtctgcctgcccagcacctgcccacacacagtttggttactggagcccatctgctgtgacaactgtcccccaccctgccacattcctcagccctgcgtgcccacctgcttcctgctcaactcctgccagccaactccgggcctggagaccctcaacctcaccaccttcactcagccctgctgtgagccctgcctcccaagaggctgctgatggatggctactttgctcagtgcccgacaacgaagaatccagaagctgtcccttcagtattcacttgcctcagtagtttgccagatgttaaggtagaccagatgacccagatatgaagaacttacctttggttttaatgggggaaaaaaagaaaagtattttttatggttatttagctgaaaaaccatttggttcctgtgggcaggtgaatgagttttattagcaaaatactgtttcaatctttaagacctcagattacatgttcttgatcatattgcttcctggctcttgtttcttgtactgggtattttcatagaagaaaatttcttggtgggttttccaataaactatatttctc

SEQ ID NO: 59725 - DNA, 623 bp, Homo sapiens
gcagccgcagtgaggtgacggagctccagagggtgttccagggcctggagatggagctgcagtcccagctcagcatagtatgaaggacccggcacagcagcagcccccaaaaagcgtccctggagaacagcctggaggaaaccaaaggctgccactgcatgcagctgtcccagatccagggactgattggcagtgtggaggagcagctggcccagctacgctgtgagatggagcagcagagccgggagtaccagatcttgctggacatgaagacacggctggagcaggagatcgccacctaccgctgcctgctggagggcgaggacgcccacctttcctccccacacgcatctggccaatcctgttcttcccgagtggtcttcacctcctcttcgtcctcttcgagccgtcagacctggcccatcctcaaggagcagggctcatccagcttcagccagggccagtgctcctagaactgagctgcctctaccacagcctcctgcccaccagctggcctcacctcctgaaggcctgggtcaggaccctgctctcccagtgcagttcccagctgtctccctgctcctctactggtgatgggctaataaagctgactttctggttga

SEQ ID NO: 59726 - DNA, 896 bp, Homo sapiens
ctcttagccttcctgagcaccttcccttttttcagccaactgctcgctcgctcacctccctccttggcacgatgagcacctgcagccaccagttcacctcctccagatccatgaagggctcctgcagtatcgggggcagcatcgggggcggctccagccgcatctcctctgtcctggccggagggtcctgccatgcccccagcacctactggggggcctgtgtgtctccttctctcgcttctcctttgggggagcctgcgggctggggggcggctatggcggtggcttcggcagcagcagcagctttgctagtggctttgggggaggatatggtggtggccttggtgctggcttcggtggtggcttgggtgctggcttgggtggtggctttgctggtggtgatgggcttctggtgggcagtgagaaggtgaccatgcagcacctcggtgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggcacaagatcattgcggccaccattgagaatgcgcagcccattttgcagattgacaatgccaggctggcagctgatgacttcaggaccaattaggagcacgagctggccctgcggctgactgtggaggctggcgtcaatggcctgtgccgggtgttggacgagctgaccctggccaggactgacctggagatggagatggaaggcctgaaggaggagctggcctacctgaggaagaaccacgaggaggagatgcttgctctgcgaggtcagaccggtggagaagtgaacgtggagacgg

SEQ ID NO: 59727 - DNA, 381 bp, Homo sapiens
atgcagcacctcggtgaccgcctggcctcctacctagacaaggtgcgtgctctggaggaggccaacgccgacctggaagtgaagatccgtgactggtaccagaggcagcggcccagtgagatcaaagactatagtccctacttcaagaccatcgaggacctgaggcacaagatcattgcggccaccattgagaatgcgcagcccattttgcagattgacaatgccaggctggagcacgagctggccctgcggctgactgtggaggctggcgtcaatggcctgtgccgggtgttggacgagctgaccctggccaggactgacctggagatgcagatagaaggcctgaaggaggagctggcctacctgaggaagaaccactag

SEQ ID NO: 59728 - DNA, 428 bp, Homo sapiens
atgagtgcagagaatggacagcagagggagcccttgatgagttttgaccatcaagagatgccaaaatggaaccaaatctccatgaactctgctaatggaagacgaggaaaaggcaggtaacctaagcaaacccaaatggaccaaatgcaacgctgatggaatctaagtgctcagaccaaggaacggggactgaaataacagtggacaccacatggcatgatccaatcagattgagccctggaaagatcatcccatggcaagatccagttagattacacttcctggcatcacctcattgcaagatccaagatcatgcctcattaccttctgcctgtaaaacctgccccagcccccagctccaggagacagatttgagccaggctcctgtctttctctgcagccttgcaataaacttttctttctacaaa

SEQ ID NO: 59729 - DNA, 883 bp, Homo sapiens; identical to SEQ ID NO: 59717

SEQ ID NO: 59730 - DNA, 975 bp, Homo sapiens; identical to SEQ ID NO: 59718

SEQ ID NO: 59731 - DNA, 561 bp, Homo sapiens
atgggatcttcctctgaggcgagcttcagatctgctcaagcttcctgcagtggggccaggaggcagggcctgggcaggggagaccagaacctctcggtgatgcctccgaatggcagggctcagacacacacacctggctgggtttcagatcccttagttttgggtgcccaagttcacggagggtgccggggaatagaagctctgtcagtctcgtctggatcttggtcctcagcaactgtctggatcctgacagtgcagtaagagcttgcctggcctgtgtgcagagctgcctcatcctgaaattctgggagttgaaagccccagggcaacccttaaccaatgggggaaaagcattggtgtgtaaatcccccagcttccctgggtgggctgcagctgagccatattctacatgacacttccgaggatccccagtgggcatgacctcaatcgcccacattggatgccacaacctgcactggcttttctcccttccctgtgggtctctctctgcacttcctcccttgtgcattctaggttcaccttccaaataaatgatgtgca

SEQ ID NO: 59732 - DNA, 428 bp, Homo sapiens; identical to SEQ ID NO: 59728

SEQ ID NO: 59733 - DNA, 1227 bp, Homo sapiens
gcgtgtgaacccccacagccctacacaacttggggcccctctcctccccagcccttctcctgtgtgcctgcctcctgccgccgccaccatgaccaccaccatccaccagttcacctcctccagctccatcaagggctcctccggcctgggagtggctcatcccgcacctcctgccggctgtctggcggcctgggtgccggctcctgcaggctgggatctgctggtggcctgggcagtgccctccggggtagcagctattccagctgctactgctttggctctggcggtggctatggcagcagctttgggggcgttgatgggctgctggccggaggtgagaaggccaccatgcagaacctcaatgaccgcctggcctcctacctggacaagatgcgcgccctggaggaggccaacactgagctggaggtgaagatccgtgactggtaccagaggcaggccccggggcccgcccgtgactacagccagtactacaggacaatcgaggagctgcagaacaagatcctcacagccaccttgaacaatgccaacatcctgctacagattgacaatgcccatctggctgctgctgacttctgcaccaagtttgagacagagcaggccctgcgcctgagtgtggaggccgccatcaatggcctgcgcagggtgctggatgggctgaccttggccagagccgacctggagatgcagattgagaacctcaaggaggagctggcctacctgaagaagaaccacgaggaggagataaacgccctgcgaggccaggtgggcggtgagatcaatgtggagatggacgctgccccaggcatggacctgagccgcatcctgaacgagatgcgtgagtagtacgagaagatggcagagaagaaccgcaaggatgccaaggattggttcttcagcaagacagaggaactgaaacgcgaggtggctaccaacagcgaactggtccagagcggcaagagcaagatttcggagctctggcgcaccatgcaggccttggagatcgagctgcagtcccagctcagcatgaaagcatccctggagggcaacctggcggagacagagagccgctactgcatgcagctgtcccagatccaggggctgatcggcagtgtggaggagcagctggcccagcttcgctgcgagacggagcagcagaaccagcagtacaagatcctgctggacgtgaagacgcggctggagcaggag

SEQ ID NO: 59734 - DNA, 821 bp, Homo sapiens
gcgtgtgaacccccacagccctacacaacttggggcccctctcctccccagcccttctcctgtgtgcctgcctcctgccgccgccaccatgaccaccaccatccaccagttcacctcctccagctccatcaagggctcctccggcctgggagtggctcatcccgcacctcctgccggctgtctggcggcctgggtgccggctcctgcaggctgggatctgctggtggcctgggcagtgccctccggggtagcagctattccagctgctactgctttggctctggcggtggctatggcagcagctttgggggcgttgatgggctgctggccggaggtgagaaggccaccatgcagaacctcaatgaccgcctggcctcctacctggacaagatgcgcgccctggaggaggccaacactgagctggaggtgaagatccgtgactggtaccagaggcaggccccggggcccgcccgtgactacagccagtactacaggacaatcgaggagctgcagaacaagatcctcacagccaccttgaacaatgccaacatcctgctacagattgacaatgcccatctggctgctgctgacttctgcaccaaggtgctggatgggctgaccttggccagagccgacctggagatgcagattgagaacctcaaggaggagctggcctacctgaagaagaaccacgaggaggagataaacgccctgcgaggccaggtgggcggtgagatcaatgtggagatggacgctgccccaggcatggacctgagccgcatcctgaacgagatgcgtgagtagtacgagaagatggcaga

SEQ ID NO: 59735 - DNA, 938 bp, Homo sapiens
gcgtgtgaacccccacagccctacacaacttggggcccctctcctccccagcccttctcctgtgtgcctgcctcctgccgccgccaccatgaccaccaccatccaccagttcacctcctccagctccatcaagggctcctccggcctgggagtggctcatcccgcacctcctgccggctgtctggcggcctgggtgccggctcctgcaggctgggatctgctggtggcctgggcagtgccctccggggtagcagctattccagctgctactgctttggctctggcggtggctatggcagcagctttgggggcgttgatgggctgctggccggaggtgagaaggccaccatgcagaacctcaatgaccgcctggcctcctacctggacaagatgcgcgccctggaggaggccaacactgagctggaggtgaagatccgtgactggtaccagaggcaggccccggggcccgcccgtgactacagccagtactacaggacaatcgaggagctgcagaacaagatcctcacagccaccttgaacaatgccaacatcctgctacagattgacaatgcccatctggctgctgctgacttctgcaccaagtttgagacagagcaggccctgcgcctgagtgtggaggccgccatcaatggcctgcgcagggtgctggatgggctgaccttggccagagccgacctggagatgcagattgagaacctcaaggaggagctggcctacctgaagaagaaccacgaggaggtgaggtggctggggcagaaggtcaaagatgctgaggagtgggtggcagagccctggggccgggccatggctgaggccatgggagagagcagagcagagcaggcgcactgggattagtcaccttagagggcttccctgtctgcagagccctgatccttggggtccagcgtgcagggcag

SEQ ID NO: 59736 - DNA, 949 bp, Homo sapiens
cccccaggtcaccagtaatggccaccaccccctcaacaagccacaatttagttccacctttcttttctcaggatgggaccagaggactcatgggacctgttatatagatagagaaactagccctagaatagtgggctagcatttctctatattgtctggcccatcagtaccccaactgggatcaaaatccaggcacctctcaaaaaacatgcccagagacctggagggacaggagtgaccacctccattgactctttttctctctctcacttgcagaaagcgtccctggagaacagcctggaggaaaccaaaggctgccactgcatgcagctgtcccagatccagggactgattggcagtgtggaggagcagctggcccagctatgctgtgagatggagcagcagagccgggagtaccagatcttgctggacatgaagacacggctggagcaggagatcgccacctaccgccgcctgctggagggcgaggacgcccacctttcctccccacacgcatctggccaatcctgttcttcccgagtgggtaaggctcctgaggctccccggcactgcaacccctctgcctgtttccatggagtgggggccaggcccttctcctgagagctcccagctctcccttctccctgccctggagttggcttagctctcagaccccttctcacctcctcttctctctcccacagtcttcacctcctcttcgtcctcttcgagccgtcagacctggcccatcctcaaggagcagggctcatccagcttcagccagggccagtgctcctagaactgagctgcctctaccacagcctcctgcccaccagctggcctcacctcctgaaggcctgggtcaggaccctgctctcccagcgcagttcccagctgtctccctgctcctctactggtgatgggctaataaagctgactttctggttga

SEQ ID NO: 59737 - DNA, 623 bp, Homo sapiens
gcagccgcagtgaggtgacgtagctccagagggtgttccagggcctggagatggagctgcagtcccagctcagcatagtatgaaggacccggcacagcagcagcccccagaaagcgtccctggagaacagcctggaggaaaccaaaggctgccactgcatgcagctgtcccagatccagggactgattggcagtgtggaggagcagctggcccagctatgctgtgagatggagcagcagagccgggagtaccagatcttgctggacatgaagacacggctggagcaggagatcgccacctaccgccgcctgctggagggcgaggacgcccacctttcctccccacacgcatctggccaatcctgttcttcccgagtggtcttcacctcctcttcgtcctcttcgagccgtcagacctggcccatcctcaaggagcagggctcatccagcttcagccagggccagtgctcctagaactgagctgcctctaccacagcctcctgcccaccagctggcctcacctcctgaaggcctgggtcaggaccctgctctcccagcgcagttcccagctgtctccctgctcctctactggtgatgggctaataaagctgactttctggttga

SEQ ID NO: 59738 - DNA, 1815 bp, Homo sapiens
atggagaactggagccggcactacccccggggcagctgtaacaccaccggcgcaggcagcgacatctgcttcatgcagaaaatcaaggcgagccgcagtgagcccgacctctactgtgacccacggggcaccctgcgcaagggcacgctgggcagcaagggccagaagaccacccagaaccgctacagcttttacagcacctgcagtggtcagaaggccataaagaagtgccctgtgcgcccgccctcttgtgcctccaagcaggaccctgtgtatatcccgcccatctcctgcaacaaggacctgtcctttggccactctagggccagctccaagatctgcagtgaggacatcgagtgcagtgggctgaccatccccaaggctgtgcagtacctgagctcccaggatgagaagtaccaggccattggggcctattacatccagcatacctgcttccaggatgaatctgccaagcaacaggtctatcagctgggaggcatctgcaagctggtggacctcctccgcagccccaaccagaacgtccagcaggccgcggcaggggccctgcgcaacctggtgttcaggagcaccaccaacaagctggagacccggaggcagaatgggatccgcgaggcagtcagcctcctgaggagaaccgggaacgccgagatccagaagcagctgactgggctgctctggaacctgtcttccactgacgagctgaaggaggaactcattgccgacgccctgcctgttctggccgaccgcgtcatcattcccttctctggctggtgcgatggcaatagcaacatgtcccgggaagtggtggaccctgaggtcttcttcaatgccacaggctgcttgaggaacctgagctcggccgatgcaggccgccagaccatgcgtaactactcagggctcattgattccctcatggcctatgtccagaactgtgtagcggccagccgctgtgacgacaagtctgtggaaaactgcatgtgtgttctgcacaacctctcctaccgcctggacgccgaggtgcccacccgctaccgccagctggagtataacgcccgcaacgcctacaccgagaagtcctccactggctgcttcagcaacaagagcgacaagatgatgaacaacaactatgactgccccctgcctgaggaagagaccaaccccaagggcagcggctggttgtaccattcagatgccatccgcacctacctgaacctcatgggcaagagcaagaaagatgctaccctggaggcctgtgctggtgccctgcagaacctgacagccagcaaggggctgatgtccagtggcatgagccagttgattgggctgaaggaaaagggcctgccacaaattgcccgcctcctgcaatctggcaactctgatgtggtgcggtccggagcctccctcctgagcaacatgtcccgccaccctctgctgcacagagtgatggggaaccaggtgttcccggaggtgaccaggctcctcaccagccacactggcaataccagcaactccgaagacatcttgtcctcggcctgctacactgtgaggaacctgatggcctcgcagccacaactggccaagcagtacttctccagcagcatgctcaacaacatcatcaacctgtgccgaagcagtgcctcacccaaggccgcagaagctgcccggcttctcctgtctgacatgtggtccagcaaggaactgcagggtgtcctcagacagcaaggtttcgataggaacatgctgggaaccttagctggggccaacagcctcaggaacttcacctcccgattctaa

SEQ ID NO: 59739 - DNA, 1356 bp, Homo sapiens
atgggtttgaaatacgaaggtccacttaaacagagacttttttcagtaaatgtattggaaaagttttctgagatttgcaacaatttgaaaaaatctgcagatgaactgtgcgcgccgccctacagacgttcgcacacctgggtgccagcgccccagaggtcccgggacagcccgaggcgccgcgcccgccgccccgagctccccaagccttcgagagcggcgcacactcccggtctccactcgctcttccaacacccgctcgttttggcggcagctcgtgtcccagagaccgagttgccccagagaccgagacgccgccgctgcgaaggaccaatgagagccccgctgctaccgccggcgccagtggtgctgtcgctcttgatactcggctcaggccattatgctgctggattggacctcaatgacacctactctgggaagcgtgaaccattttctggggaccacagtgctgatggatttgaggttacctcaagaagtgagatgtcttcagggagtgagatttcccctgtgagtgaaatgccttctagtagtgaaccgtcctcgggagccgactatgactactcagaagagtatgataacgaaccacaaatacctggctatattgtcgatgattcagtcagagttgaacaggtagttaagcccccccaaaacaagacggaaagtgaaaatacttcagataaacccaaaagaaagaaaaagggaggcaaaaatggaaaaaatagaagaaacagaaagaagaaaaatccatgtaatgcagaatttcaaaatttctgcattcacggagaatgcaaatatatagagcacctggaagcagtaacatgcaaatgtcagcaagaatatttcggtgaacggtgtggggaaaagtccatgaaaactcacagcatgattgacagtagtttatcaaaaattgcattagcagccatagctgcctttatgtctgctgtgatcctcacagctgttgctgttattacagtccagcttagaagacaatacgtcaggaaatatgaaggagaagctgaggaacgaaagaaacttcgacaagagaatggaaatgtacatgctatagcataactgaagataaaattacaggatatcacattggagtcactgccaagtcatagccataaatgatgagtcggtcctctttccagtggatcataagacaatggaccctttttgttatgatggttttaaactttcaattgtcactttttatgctatttctgtatataaaggtgcacgaaggtaaaaagtattttttcaagttgtaaataatttatttaatatttaatggaagtgtatttattttacagctcattaaacttttttaaccaa

SEQ ID NO: 59740 - DNA, 763 bp, Homo sapiens
agttgggagtgactccagagcctcctgcaagatgctgttgattctgctgtcagtggccttgctggccctgagctcagctcagaacttaaatgaagatgtcagccaggaagaatctccctccctaatagcaggaaagccacaaggaccacccccacaaggaggcaaccagcctcaaggtcccccacctcctccaggaaagccacaaggaccacccccacaaggaggcaacaaacctcaaggtcccccacctccaggaaagccacaaggaccacccccacaaggagacaagtcccgaagtccccgatctcctccaggaaagccacaaggaccacccccacaaggaggaaagccacaaggaccacccccacaaggaggcaacaaacctcaaggtcccccacctccaggaaagccacaaggaccacccccacaaggaggcagcaagtcccgaagtgcccgatctcctccaggaaagccacaaggaccaccccaacaagaaggcaacaatcctcaaggtcccccacctccagcaggaggcaatccccagcagcctcaggcacctcctgctggacagccccagggaccaccacgccctcctcaagggggcagaccttccagacctccccagtgacagcctccccagtcatctaggattcaatgacaggaagtgaataagaagatgagagtgattcaaatgattcaaatgccatgacattggaaaaaggtcatcatagctctaacttctgtataccaataaaataattag

SEQ ID NO: 59741 - DNA, 1166 bp, Homo sapiens
gagttgggagtgactccagagcctcctgcaagatgctgttgattctgctgtcagtggccttgctggccctgagctcagctcagaacttaaatgaagatgtcagccaggaagaatctccctccctaatagcaggaaagccacaaggaccacccccacaaggaggcaaccagcctcaaggtcccccacctcctccaggaaagccacaaggaccacccccacaaggaggcaacaaacctcaaggtcccccacctccaggaaagccacaaggaccacccccacaaggagacaagtcccgaagtccccgatctcctccaggaaagccacaaggaccacccccacaaggaggcaaccagcctcaaggtcctccacctcctccaggaaagccacaaggaccacccccacaaggaggcaacaaacctcaaggtcccccacctccaggaaagccacaaggaccacccccacaaggagacaacaagtcccgaagttctcgatctcctccaggaaagccacaaggaccacccccacaaggaggcaaccagccccaaggtcccccacctcctccaggaaagccacaaggaccacccccacaaggaggcaacaaacctcaaggtcccccacctccaggaaagccacaaggaccacccccacaaggagacaagtcccgaagttctcgatctcctccaggaaagccacaaggaccacccccacaaggaggcaaccagcctcaaggtcccccacctcctccaggaaagccacaaggaccacccccacaaggaggcaacaaacctcaaggtcccccacctccaggaaagccacaaggaccacccccacaaggaggcagcaagtcccgaagtgcccgatctcctccaggaaagccacaaggaccaccccaacaagaaggcaacaatcctcaaggtcccccacctccagcaggaggcaatccccagcagcctcaggcacctcctgctggacagccccagggaccaccacgccctcctcaagggggcagaccttccagacctccccagtgacagcctccccagtcatctaggattcaatgacaggaagtgaataagaagatgagagtgattcaaatgattcaaatgccatgacattggaaaaaggtcatcatagctctaacttctgtataccaataaaataattag

SEQ ID NO: 59742 - DNA, 950 bp, Homo sapiens
gagttgggagtgactccagagcctcctgcaagatgctgttgattctgctgtcagtggccttgctggccctgagctcagctcagaacttaaatgaagatgtcagccaggaagaatctccctccctaatagcaggaaagccacaaggaccacccccacaaggaggcaaccagcctcaaggtcccccacctcctccaggaaagccacaaggaccacccccacaaggaggcaacaaacctcaaggtcccccacctccaggaaagccacaaggaccacccccacaaggagacaagtcccgaagtccccgatctcctccaggaaagccacaaggaccacccccacaaggaggcaaccagcctcaaggtcctccacctcctccaggaaagccacaaggaccacccccacaaggaggcaacaaacctcaaggtcccccacctccaggaaagccacaaggaccacccccacaaggagacaacaagtcccgaagttctcgatctcctccaggaaagccacaaggaccacccccacaaggaggaaagccacaaggaccacccccacaaggaggcaacaaacctcaaggtcccccacctccaggaaagccacaaggaccacccccacaaggaggcagcaagtcccgaagtgcccgatctcctccaggaaagccacaaggaccaccccaacaagaaggcaacaatcctcaaggtcccccacctccagcaggaggcaatccccagcagcctcaggcacctcctgctggacagccccagggaccaccacgccctcctcaagggggcagaccttccagacctccccagtgacagcctccccagtcatctaggattcaatgacaggaagtgaataagaagatgagagtgattcaaatgattcaaatgccatgacattggaaaaaggtcatcatagctctaacttctgtataccaataaaataattag

SEQ ID NO: 59743 - DNA, 703 bp, Homo sapiens
agttgggagtgactccagagcctcctgcaagatgctgttgattctgctgtcagtggccttgctggccctgagctcagctcagaacttaaatgaagatgtcagccaggaagaatctccctccctaatagcaggaaagccacaaggaccacccccacaaggaggcaaccagcctcaaggtcccccacctcctccaggaaagccacaaggaccacccccacaaggaggcaacaaacctcaaggtcccccacctccaggaaagccacaaggaccacccccacaaggagacaagtcccgaagtccccgatctcctccaggaaagccacaaggaccacccccacaaggaggaaagccacaaggaccacccccacaaggaggcagcaagtcccgaagtgcccgatctcctccaggaaagccacaaggaccaccccaacaagaaggcaacaatcctcaaggtcccccacctccagcaggaggcaatccccagcagcctcaggcacctcctgctggacagccccagggaccaccacgccctcctcaagggggcagaccttccagacctccccagtgacagcctccccagtcatctaggattcaatgacaggaagtgaataagaagatgagagtgattcaaatgattcaaatgccatgacattggaaaaaggtcatcatagctctaacttctgtataccaataaaataattag

SEQ ID NO: 59744 - DNA, 1169 bp, Homo sapiens
agttgggagtgactccagagcctcctgcaagatgctgttgattctgctgtcagtggccttgctggccctgagctcagctcagaacttaaatgaagatgtcagccaggaagaatctccctccctaatagcaggaaagccacaaggaccacccccacaaggaggcaaccagcctcaaggtcccccacctcctccaggaaagccacaaggaccacccccacaaggaggcaacaaacctcaaggtcccccacctccaggaaagccacaaggaccacccccacaaggagacaagtcccgaagtccccgatctcctccaggaaagccacaaggaccacccccacaaggaggcaaccagcctcaaggtcccccacctcctccaggaaagccacaaggaccacccccacaaggaggcaacaaacctcaaggtcccccacctccaggaaagccacaaggaccacccccacaaggagacaacaagtcccaaagtgcccgatctcctccaggaaagccacaaggaccacccccacaaggaggcaaccagccccaaggtcccccacctcctccaggaaagccacaaggaccacccccacaaggaggcaacaaacctcaaggtcccccacctccaggaaagccacaaggaccacccccacaaggaggcagcaagtcccgaagttctcgatctcctccaggaaagccacaaggaccacccccacaaggaggcaaccagcctcaaggtcccccacctcctccaggaaagccacaaggaccacccccacaaggaggcaacaaacctcaaggtcccccacctccaggaaagccacaaggaccacccccacaaggaggcagcaagtcccgaagtgcccgatctcctccaggaaagccacaaggaccaccccaacaagaaggcaacaatcctcaaggtcccccacctccagcaggaggcaatccccagcagcctcaggcacctcctgctggacagccccagggaccaccacgccctcctcaagggggcagaccttccagacctccccagtgacagcctccccagtcatctaggattcaatgacaggaagtgaataagaagatgagagtgattcaaatgattcaaatgccatgacattggaaaaaggtcatcatagctctaacttctgtataccaataaaataattagc

SEQ ID NO: 59745 - DNA, 485 bp, Homo sapiens
gcccaacccggtcccagccatgtccaacgtcccccacaagtcctcactgcccgagggcatccgccctggcacggtgctgagaattcgcggcttggttcctcccaatgccagcaggttccatgtaaacctgctgtgcggggaggagcagggctccgatgccgccctgcatttcaacccccggctggacacgtcggaggtggtcttcaacagcaaggagcaaggctcctggggccgcgaggagcgcgggccgggcgttcctttccagcgcgggcagcccttcgaggtgctcatcatcgcgtcagacgacggcttcaaggccgtggttggggacgcccagtaccaccacttccgccaccgcctgccgctggcgcgcgtgcgcctggtggaggtgggcggggacgtgcagctggactccgtgaggatcttctgagcagaagcccaggcgggcccggggccttggctggcaaataaagcgttagcccgca

SEQ ID NO: 59746 - DNA, 506 bp, Homo sapiens
catagggagctctgccttaccattgggttcctaattaactgagtgagtgggtgtgttctgcatggtgagaggcattggaatgatgcatcagaaaacatgtcataatgtcatcactgtaatatgacaagaattgcagctgtggctggaacctttataaagtgaccaagcacaccttttcatccagtctcagcgtggggtgaagcctagcagctatgaggatccattatcttctgtttgctttgctcttcctgtttttggtgcctgttccaggtcatggaggaatcataaacacattacagaaatattattgcagagtcagaggcggccggtgtgctgtgctcagctgccttccaaaggaggaacagatcggcaagtgctcgacgcgtggccgaaaatgctgccgaagaaagaaataaaaaccctgaaacatgacgagagtgttgtaaagtgtggaaatgccttcttaaagtttataaaagtaaaatcaaattacatttttttttcaa

SEQ ID NO: 59747 - DNA, 763 bp, Homo sapiens; identical to SEQ ID NO: 59740

SEQ ID NO: 59748 - DNA, 1166 bp, Homo sapiens; identical to SEQ ID NO: 59741

SEQ ID NO: 59749 - DNA, 950 bp, Homo sapiens; identical to SEQ ID NO: 59742

SEQ ID NO: 59750 - DNA, 703 bp, Homo sapiens; identical to SEQ ID NO: 59743

SEQ ID NO: 59751 - DNA, 1169 bp, Homo sapiens; identical to SEQ ID NO: 59744

SEQ ID NO: 59752 - DNA, 485 bp, Homo sapiens
gcccaacccggtcccagccatgtccaacgtcccccacaagtcctcgctgcccgagggcatccgccctggcacggtgctgagaattcgcggcttggttcctcccaatgccagcaggttccatgtaaacctgctgtgcggggaggagcagggctccgatgccgccctgcatttcaacccccggctggacacgtcggaggtggtcttcaacagcaaggagcaaggctcctggggccgcgaggagcgcgggccgggcgttcctttccagcgcgggcagcccttcgaggtgctcatcatcgcgtcagacgacggcttcaaggccgtggttggggacgcccagtaccaccacttccgccaccgcctgccgctggcgcgcgtgcgcctggtggaggtgggcggggacgtgcagctggactccgtgaggatcttctgagcagaagcccaggcgggcccggggccttggctggcaaataaagcgttagcccgca

SEQ ID NO: 59753 - DNA, 1218 bp, Homo sapiens
ggtgctttgggctctccttccttctcagacaagatgtcttatcagaaaaagcagcccacccctcagcccccagtggactgcgtgaagacctctggcggcggtggcggtggcggcggcacgggcggtggtggctgcggcttcttcggcggcggcggctcagggggcggtagcagcggttctggctgtggctactccggcggcggtggctactctggcggcggctgcggcgggggctcctccggcggcgggggcgggggcggcattggaggctgcggagggggctccggtgggagcgtcaagtactccggcggcggcggctcctccggcgggggctctggctgtttctccagcggtgggggcggctccggctgcttctcctccggtggcggcggctcctccgggggaggctccggctgcttctccagcggtgggggcggctcctccgggggcggctccggctgcttctcctccggcggcggcggcttctcgggccaggcggtccagtgccagagctacggaggcgtctctagcggcggctcctccgggggcggctccggctgcttctccagcggcgggggcggcggctctgtctgcggctactctggcggcggctctggcggcggctctggctgcggcggaggctcctctggcggcagcggctccggctacgtctcctcgcagcaggtcactcagacctcgtgcgcgccccagccgagttacggaggggggtcgtccggcggcggcggcagcggcggaagcggctgcttctccagcggcgggggcggcgggagctccggctgcggcggcggctcctccgggattggcagcggctgcatcatcagtggcgggggctccgtctgcggaggtggttcctctggaggcggcggcggcggctcctccgtgggtggctccgggagtggcaagggcgtcccgatctgccaccagacccagcagaagcaggcgcctacctggccgtccaaatagatcccccagggtaccacggaggcgaaggagttggaggtgttttccaggggcaccgatgggcttagagctctcatgatgctacccgaggtttgcaaatccttcatgtcttaacctacctggaagaagccattgagctctccggctgcatctagttctgctgtttagcctctttggtttctgtacaactacctcccaaccccagtgcctcagtcaataaatttgcaaattcatgag

SEQ ID NO: 59754 - DNA, 806 bp, Homo sapiens
gcccacccccgcccagcccgtgcctataaggccttggcaatgcaggggcccgcactgctcccagacgacatcagagatgaggacagcattgctgctccttgcagccctggctgtggctacagggccagcccttaccctgcgctgccacgtgtgcaccagctccagcaactgcaagcattctgtggtctgcccggccagctctcgcttctgcaagaccacgaacacagtggagcctctgagggggaatctggtgaagaaggactgtgcggagtcgtgcacacccagctacaccctgcaaggccaggtcagcagcggcaccagctccacccagtgctgccaggaggacctgtgcaatgagaagctgcacaacgctgcacccacccgcaccgccctcgcccacagtgccctcagcctggggctggccctgagcctcctggccgtcatcttagcccccagcctgtgaccttccccccagggaaggcccctcatgcctttccttccctttctctggggattccacacctctcttccccagccgcaacgggggtgccaggagccccaggctgagggcttccccgaaagtctgggaccaggtccaggtgggcatggaatgctgatgacttggagcaggccccacagaccccacagaggatgaagccaccccacagaggatgcagcccccagctgcatggaaggtggaggacagaagccctgtggatccccggatttcacactccttctgttttgttgccgtttatttttgtactcaaatctctacatggagataaatgatttaaaccagaaaa

SEQ ID NO: 59755 - DNA, 880 bp, Homo sapiens
tgaaaatctactctatcagctgctgtggttgccaccattctcaggaccctcgccatgaaagcccttatgctgctcaccctgtctgttctgctctgctgggtctcagctgacattcgctgtcactcctgctacaaggtccctgtgctgggctgtgtggaccggcagtcctgccgcctggagccaggacagcaatgcctgacaacacatgcataccttggtaagatgtgggttttctccaatctgcgctgtggcacaccagaagagccctgtcaggaggccttcaaccaaaccaaccgtaagctgggtctgacatataacaccacctgctgcaacaaggacaactgcaacagcgcaggaccccggcccactccagccctgggccttgtcttccttacctccttggctggccttggcctctggctgctgcactgagactcattccattggctgcccctcctcccacctgccttggcctgagcctctctccctgtgtctctgtatcccctggctttacagaatcgtctctccctagctcccatttctttaattaaacactgttccgagtggtctcctcatccgtccttcccacctcacacccttcactctcctttttctgggtcccttcccacttccttccaggacctccattggctcctagaagggctccccactttgcttcctatactctgctgtcccctacttgaggagggattgggatctgggcctgaaatggggcttctgtgttgtccccagtgaaggctcccacaaggacctgatgacctcactgtacagagctgactccccaaatccaggctcccatatgtaccccatcccccatactcacctctttccattttgagtaataaatgtctgagtctga

SEQ ID NO: 59756 - DNA, 1698 bp, Homo sapiens
ggttactcatcctgggctcaggtaagagggcccgagctcggaggcggcacacccaggggggacgccaagggagcaggacggagccatggaccccgccaggaaagcaggtgcccaggccatgatctggactgcaggctggctgctgctgctgctgcttcgcggaggagcgcaggccctggagtgctacagctgcgtgcagaaagcagatgacggatgctccccgaacaagatgaagacagtgaagtgcgcgccgggcgtggacgtctgcaccgaggccgtgggggcggtggagaccatccacggacaattctcgctggcagtgcsgggttgcggttcgggactccccggcaagaatgaccgcggcctggatcttcacgggcttctggcgttcatccagctgcagcaatgcgctcaggatcgctgcaacgccaagctcaacctcacctcgcgggcgctcgacccggcaggtaatgagagtgcatacccgcccaacggcgtggagtgctacagctgtgtgggcctgagccgggaggcgtgccagggtacatcgccgccggtcgtgagctgctacaacgccagcgatcatgtctacaagggctgcttcgacggcaacgtcaccttgacggcagctaatgtgactgtgtccttgcctgtccggggctgtgtccaggatgaattctgcactcgggatggagtaacaggcccagggttcacgctcagtggctcctgttgccaggggtcccgctgtaactctgacctccgcaacaagacctacttctcccctcgaatcccaccccttgtccggctgccccctccagagcccacgactgtggcctcaaccacatctgtcaccacttctacctcggccccagtgagacccacatccaccaccaaacccatgccagcgccaaccagtcagactccgagacagggagtagaacacgaggcctcccgggatgaggagcccaggttgactggaggcgccgctggccaccaggaccgcagcaattcagggcagtatcctgcaaaaggggggccccagcagccccataataaaggctgtgtggctcccacagctggattggcagcccttctgttggccgtggctgctggtgtcctactgtgagcttctccacctggaaatttccctctcacctacttctctggccctgggtacccctcttctcatcacttcctgttcccaccactggactgggctggcccagcccctgtttttccaacattccccagtatccccagcttctgctgcgctggtttgcggctttgggaaataaaataccgttgtatatattctggcaggggtgttctagctttttgaggacagctcctgtatccttctcatccttgtctctccgcttgtcctcttgtgatgttaggacagagtgagagaagtcagctgtcacggggaaggtgagagagaggatgctaagcttcctactcactttctcctagccagcctggactttggagcgtggggtgggtgggacaatggctccccactctaagcactgcctcccctactccccgcatctttggggaatcggttccccatatgtcttccttactagactgtgagctcctcgagggcagggaccgtgccttatgtctgtgtgtgatcagtttctggcacataaatgcctcaataaagatttaattactttgtatagtgaaaaaaaa

SEQ ID NO: 59757 - DNA, 2186 bp, Homo sapiens
agtaaggagaaccagccaggcagaacatcacagcgggaggagctgtcccaggtggcccagctcagcaatggcaatgggggtccccagagtcattctgctctgcctctttggggctgcactctgcctgacagggtcccaagccctgcagtgctacagctttgagcacacctactttggcccctttgacctcagggccatgaagctgcccagcatctcctgtcctcatgagtgctttgaggctatcctgtctctggacaccgggtatcgcgcgccggtgaccctggtgcggaagggctgctggaccgggcctcctgcgggccagacgcaatcgaacgcggacgcgctgccgccagactactcggtggtgcgcggctgcacaactgacaaatgcaacgcccacctcatgactcatgacgccctccccaacctgagccaagcacccgacccgccgacgctcagcggcgccgagtgctacgcctgtatcggggtccaccaggatgactgcgctatcggcaggtcccgacgagtccagtgtcaccaggaccagaccgcctgcttccagggcaatggcagaatgacagttggcaatttctcagtccctgtgtacatcagaacctgccaccggccctcctgcaccaccgagggcagcaccagcccctggacagccatcgacctccagggctcctgctgtgaggggtacctctgcaacaggaaatccatgacccagcccttcaccagtgcttcagccaccacccctccccgagcactacaggtcctggccctgctcctcccagtcctcctgctggtggggctctcagcatagaccgcccctccaggatgctggggacagggctcacacacctcattcttgctgcttcagcccctatcacatagctcactggaaaatgatgttaaagtaagaattgcactcctgtccctctggccttccatctctcccgcccttgtgccccacaacctggccaacagtactggaagaaactggacacagtcaccagcatccccggggagggcaaaacagccatgtcgtgccctgatgaagagcaattctgatcacagctgttactcactgagcaccagccaggcaccaggcaccccataacacggcttcctgtgctctccctccagagcctgtcgcagctctaggagggagctatacaatgatgtctttattagtgtcatcatgagaagcccaataagcagtatgccctaacagttagtaggccaggctctggagctaagctgcatgggttcaaatcccagctccaccattcagcctgcagagaccatgagcgagttacttaagccaggctctggagctaagctgcatgggttcaaatcccagctccagcattcagcctacagagaccatgggtgagttacttaagccaggctctggagctaagctgcatgggttcaaatcccagctccaccattcagcctgcagagactgtgggtgagttacttgagctctctgtgccaatattttctcacctataaggtggaggtgaaaataaactctataacatgacaagaactacttcacagtagttgcagtgaggattcaacgagatgaacatttagtacttgggacacagcagtggcccagtgtaaatgggctacttgtcataagccctaagtcacaggtcaacaaactgagaggcaaaagcacttggttgagcttgtgtatctagtgagtatggattcagggaccagattcccagccccacgaactgctaagcaaccccacctcctaaacacatgagtgccgattaacttcacagaaaaacacacaaggcaaagttcagcgaggtgaaattctccaagctataaagatcagggaagacttcctggaggaattcacccttgagcaaaatcctaaaggatcaatagtagctggcaaaaagaagcaggaggaagcgcattctaggtagaggagacagcctggacaaaggtctgagggaggaaggagcacaaggagtgcaggacactttcatgagtgcaggacactttcataactgcatgaacttcatagagatgggatcctttagcatgttctctgtgcacatgcttgaccatgttctttcacatgctttttgccacttgatctttccagcaactcagtgagagaagcaaaaaagtaagttgcatccaaaaaaaaaaaaaaa

SEQ ID NO: 59758 - DNA, 2118 bp, Homo sapiens
gattcttgggttccgcgcgtagtttcggaaggagacatcgaagcagggcgaggcgcagagggcgttgcggactcatgccccagtcggcagtgcggggtcccaagccctgcagtgctacagctttgagcacacctactttggcccctttgacctcagggccatgaagctgcccagcatctcctgtcctcatgagtgctttgaggctatcctgtctctggacaccgggtatcgcgcgccggtgaccctggtgcggaagggctgctggaccgggcctcctgcgggccagacgcaatcgaacccggacgcgctgccgccagactactcggtggtgcgcggctgcacaactgacaaatgcaacgcccacctcatgactcatgacgccctccccaacctgagccaagcacccgacccgccgacgctcagcggcgccgagtgctacgcctgtatcggggtccaccaggatgactgcgctatcggcaggtcccgacgagtccagtgtcaccaggaccagaccgcctgcttccagggcagtggcagaatgacagttggcaatttctcagtccctgtgtacatcagaacctgccaccggccctcctgcaccaccgagggcaccaccagcccctggacagccatcgacctccagggctcctgctgtgaggggtacctctgcaacaggaaatccatgacccagcccttcaccagtgcttcagccaccacccctccccgagcactacaggtcctggccctgctcctcccagtcctcctgctggtggggctctcagcatagaccgcccctccaggatgctggggacagggctcacacacctcattcttgctgcttcagcccctatcacatagctcactggaaaatgatgttaaagtaagaattgcactcctgtccctctggccttccatctctcctgcccttgtgccccacaacctggccaacagtactggaagaaactggacacagtcaccagcatcccaggggagggcaaaacagccatgtcgtgccctgatgaagagcaattctgatcacagctgttactcactgagcaccagccaggcaccaggcaccccataacacggcttcctgtgctctccttccagagcctgtcgcagctctaggggggagctatacaatgatgtctttattagtgtcatcatgagaagcccaataagcagtatgccctaacagttagtaggccaggctctggagctaagctgcatgggttcacatcccagctccaccattcagcctgcagagaccatgagcgagttacttaagccaggctctggagctaagctgcatgggttcaaatcccagctccagcattcagcctacagagaccatgggtgagttacttaagccaggctctggagctaagctgcatgggttcaaatcccagctccaccattcagcctgcagagactgtgggtgagttacttgagctctctgtgccaatattttctcacctataaggtggaggtgaaaataaactctataacatgacaagaactacttcacagtagttgcagtgaggattcaacgagatgaacatttagtacttgggacacagcagtggcccagtataaatgggctacttgtcataagccctaagtcacaggtcaacaaactgagaggtaaaagcacttggttgagcttgtgtatctagtgagtatggattcagggaccagattcccagccccacgaactgctaagcaaccccacctcctaaacacatgagtgccgattaacttcacagaaaaacacacaaggcaaagttcagcgaggtgaaattctccaagctataaagatcagggaagacttcctggaggaattcacccttgagcaaaatcctaaaggatcaatagtagctggcaaaaagaagcaggaggaagcacattttaggtagaggagacagcctggacaaaggtctgagggaggaaggaacacaaggagtgcaggacactttcataactgcatgaacttcatagagatgggatcctttagcatgttctctgtgcacatgcttgaccatgttctttcacatgctttttgccacttgatctttccagcaactcagtgagagaagcaaaaaagtaagttgcatcctg

SEQ ID NO: 59759 - DNA, 1793 bp, Homo sapiens
tcgctctccccatcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgccaacctggattcactggagcaagatgtactgagaatgtgcccatgaaagtccaaaaccaagaaaaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaagacataaccttatagctgagctaaggagaaacaaggcacacagatccaaatgcatgcagatccagctatcagcaactcatcttagatcttcttccattccccatttgggcttcattctctaagaccccttggcctttaggaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccacgcgcccacgcgtccgcggacgcgtgg

SEQ ID NO: 59760 - DNA, 2438 bp, Homo sapiens
cccggcggcgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccaccaaaaaaaaaaaaaaaa

SEQ ID NO: 59761 - DNA, 3636 bp, Homo sapiens
cagcgacgtcgaggcgctcatggttgcaggcgggcgccgccgttcagttcagggtctgagcctggaggagtgagccaggcagtgagactggctcgggcgggccgggacgcgtcgttgcagcagcggctcccagctcccagccaggattccgcgcgccccttcacgcgccctgctcctgaacttcagctcctgcacagtcctccccaccgcaaggctcaaggcgccgccggcgtggaccgcgcacggcctctaggtctcctcgccaggacagcaacctctcccctggccctcatgggcaccgtcagctccaggcggtcctggtggccgctgccactgctgctgctgctgctgctgctcctgggtcccgcgggcgcccgtgcgcaggaggacgaggacggcgactacgaggagctggtgctagccttgcgttccgaggaggacggcctggccgaagcacccgagcacggaaccacagccaccttccaccgctgcgccaaggatccgtggaggttgcctggcacctacgtggtggtgctgaaggaggagacccacctctcgcagtcagagcgcactgcccgccgcctgcaggcccaggctgcccgccggggatacctcaccaagatcctgcatgtcttccatggccttcttcctggcttcctggtgaagatgagtggcgacctgctggagctggccttgaagttgccccatgtcgactacatcgaggaggactcctctgtctttgcccagagcatcccgtggaacctggagcggattacccctccacggtaccgggcggatgaataccagccccccgacggaggcagcctggtggaggtgtatctcctagacaccagcatacagagtgaccaccgggaaatcgagggcagggtcatggtcaccgacttcgagaatgtgcccgaggaggacgggacccgcttccacagacaggccagcaagtgtgacagtcatggcacccacctggcaggggtggtcagcggccgggatgccggcgtggccaagggtgccagcatgcgcagcctgcgcgtgctcaactgccaagggaagggcacggttagcggcaccctcataggcctggagtttattcggaaaagccagctggtccagcctgtggggccactggtggtgctgctgcccctggcgggtgggtacagccgcgtcctcaacgccgcctgccagcgcctggcgagggctggggtcgtgctggtcaccgctgccggcaacttccgggacgatgcctgcctctactccccagcctcagctcccgaggtcatcacagttggggccaccaatgcccaagaccagccggtgaccctggggactttggggaccaactttggccgctgtgtggacctctttgccccaggggaggacatcattggtgcctccagcgactgcagcacctgctttgtgtcacagagtgggacatcacaggctgctgcccacgtggctggcattgcagccatgatgctgtctgccgagccggagctcaccctggccgagttgaggcagagactgatccacttctctgccaaagatgtcatcaatgaggcctggttccctgaggaccagcgggtactgacccccaacctggtggccgccctgccccccagcacccatggggcaggttggcagctgttttgcaggactgtatggtcagcacactcggggcctacacggatggccacagccgtcgcccgctgcgccccagatgaggagctgctgagctgctccagtttctccaggagtgggaagcggcggggcgagcgcatggaggcccaagggggcaagctggtctgccgggcccacaacgcttttgggggtgagggtgtctacgccattgccaggtgctgcctgctaccccaggccaactgcagcgtccacacagctccaccagctgaggccagcatggggacccgtgtccactgccaccaacagggccacgtcctcacaggctgcagctcccactgggaggtggaggaccttggcacccacaagccgcctgtgctgaggccacgaggtcagcccaaccagtgcgtgggccacagggaggccagcatccacgcttcctgctgccatgccccaggtctggaatgcaaagtcaaggagcatggaatcccggcccctcaggagcaggtgaccgtggcctgcgaggagggctggaccctgactggctgcagtgccctccctgggacctcccacgtcctgggggcctacgccgtagacaacacgtgtgtagtcaggagccgggacgtcagcactacaggcagcaccagcgaaggggccgtgacagccgttgccatctgctgccggagccggcacctggcgcaggcctcccaggagctccagtgacagccccatcccaggatgggtgtctggggagggtcaagggctggggctgagctttaaaatggttccgacttgtccctctctcagccctccatggcctggcacgaggggatggggatgcttccgcctttccggggctgctggcctggcccttgagtggggcagcctccttgcctggaactcactcactctgggtgcctcctccccaggtggaggtgccaggaagctccctccctcactgtggggcatttcaccattcaaacaggtcgagctgtgctcgggtgctgccagctgctcccaatgtgccgatgtccgtgggcagaatgacttttattgagctcttgttccgtgccaggcattcaatcctcaggtctccaccaaggaggcaggattcttcccatggataggggagggggcggtaggggctgcagggacaaacatcgttggggggtgagtgtgaaaggtgctgatggccctcatctccagctaactgtggagaagcccctgggggctccctgattaatggaggcttagctttctggatggcatctagccagaggctggagacaggtgcgcccctggtggtcacaggctgtgccttggtttcctgagccacctttactctgctctatgccaggctgtgctagcaacacccaaaggtggcctgcggggagccatcacctaggactgactcggcagtgtgcagtggtgcatgcactgtctcagccaacccgctccactacccggcagggtacacattcgcacccctacttcacagaggaagaaacctggaaccagagggggcgtgcctgccaagctcacacagcaggaactgagccagaaacgcagattgggctggctctgaagccaagcctcttcttacttcacccggctgggctcctcatttttacgggtaacagtgaggctgggaaggggaacacagaccaggaagctcggtgagtgatggcagaacgatgcctgcaggcatggaactttttccgttatcacccaggcctgattcactggcctggcggagatgcttctaaggcatggtcgggggagagggccaacaactgtccctccttgagcaccagccccacccaagcaagcagacatttatcttttgggtctgtcctctctgttgcctttttacagccaacttttctagacctgttttgcttttgtaacttgaagatatttattctgggttttgtagcatttttattaatatggtgactttttaaaataaaaacaaacaaacgttgtcct

SEQ ID NO: 59762 - DNA, 1941 bp, Homo sapiens
gcttttgtggcggcgcccgcgctcgcaggccactctctgctgtcgcccgtcccgcgcgctcctccgacccgctccgctccgctccgctcggccccgcgccgcccgtcaacatgatccgctgcggcctggcctgcgagcgctgccgctggatcctgcccctgctcctactcagcgccatcgccttcgacatcatcgcgctggccggccgcggctggttgcagtctagcgaccacggccagacgtcctcgctgtggtggaaatgctcccaagagggcggcggcagcgggtcctacgaggagggctgtcagagcctcatggagtacgcgtggggtagagcagcggctgccatgctcttctgtggcttcatcatcctggtgatctgtttcatcctctccttcttcgccctctgtggaccccagatgcttgtcttcctgagagtgattggaggtctccttgccttggctgctgtgttccagatcatctccctggtaatttaccccgtgaagtacacccagaccttcacccttcatgccaaccctgctgtcacttacatctataactgggcctacggctttgggtgggcagccacgattatcctgattggctgtgccttcttcttctgctgcctccccaactacgaagatgaccttctgggcaatgccaagcccaggtacttctacacatctgcctaacttgggaatgaatgtgggagaaaatcgctgctgctgagatggactccagaagaagaaactgtttctccaggcgactttgaacccattttttggcagtgttcatattattaaactagtcaaaaatgctaaaataatttgggagaaaatattttttaagtagtgttatagtttcatgtttatcttttattatgttttgtgaagttgtgtcttttcactaattacctatactatgccaatatttcctatctatccataacatttatactacatttgtaagagaatatgcacgtgaaacttaacactttataaggtaaaaatgaggtttccaagatttaataatctgatcaagttcttgttatttccaaatagaatggactcggtctgttaagggctaaggagaagaggaagataaggttaaaagttgttaatgaccaaacattctaaaagaaatgcaaaaaaaaagtttattttcaagccttcgaactatttaaggaaagcaaaatcatttcctaaatgcatatcatttgtgagaatttctcattaatatcctgaatcattcattttagctaaggcttcatgttgactcgatatgtcatctaggaaagtactatttcatggtccaaacctgttgccatagttggtaaggctttcctttaagtgtgaaatatttagatgaaattttctcttttaaagttctttatagggttagggtgtgggaaaatgctatattaataaatctgtagtgttttgtgtttatatgttcagaaccagagtagactggattgaaagatggactgggtctaatttatcatgactgatagatctgttaagttgtgtagtaaagcattaggagggtcattcttgtcacaaaagtgccactaaaacagcctcaggagaataaatgacttgcttttctaaatctcaggtttatctgggctctatcatatagacaggcttctgatagtttgcaactgtaagcagaaacctacatatagttaaaatcctggtctttcttggtaaacagattttaaatgtctgatataaaacatgccacaggagaattcggggatttgagtttctctgaatagcatatatatgatgcatcggataggtcattatgattttttaccatttcgacttacataatgaaaaccaattcattttaaatatcagattattattttgtaagttgtggaaaaagctaattgtagttttcattatgaagttttcccaataaaccaggtattct

SEQ ID NO: 59763 - DNA, 1173 bp, Homo sapiens
cctctcttccagggctgccgtccacactctcccggtcagagtcctgggaccacatggggacgctgccatggcttcttgccttcttcattctgggtctccaggcttgggatactcccaccatcgtctcccgcaaggagtggggggcaagaccgctcgcctgcagggccctgctgaccctgcctgtggcctacatcatcacagaccagctcccagggatgcagtgccagcagcagagcgtttgcagccagatgctgcgggggttgcagtcccattccgtctacaccataggctggtgcgacgtggcgtacaacttcctggttggggatgatggcagggtgtatgaaggtgttggctggaacatccaaggcttgcacacccagggctacaacaacatttccctgggcatcgccttctttggcaataagataggcagcagtcccagccctgctgccttatcagctgcagagggtctgatctcctatgccatccagaagggtcacctgtcgcccaggtatattcagccacttcttctgaaagaagagacctgcctggaccctcaacatccagtgatgcccaggaaggtttgccccaacatcatcaaacgatctgcttgggaagccagagagacacactgccctaaaatgaacctcccagccaaatatgtcatcatcatccacaccgctggcacaagctgcactgtatccacagactgccagactgtcgtccgaaacatacagtcctttcacatggacacacggaacttttgtgacattggatatcacttcctggtgggccaggatggtggcgtgtatgaaggggttggatggcacatccaaggctctcacacttatggattcaacgatattgccctaggaattgccttcatcggctactttgtagaaaagcctccaaatgctgcagcgctggaggcggcccaggacctgatccagtgtgccgtggttgaggggtacctgactccaaactacctgctgatgggccacagtgacgtggtcaacatcctgtcccctgggcaggctttgtataacatcatcagcacctggcctcatttcaagcactgaaggaggccccactccctttgagactgccctccctcccctgctgggtctctccaaccctcaccagccaagctggctcagcaccttgtgtccccct

SEQ ID NO: 59764 - DNA, 623 bp, Homo sapiens
aggccaagctggactgcataaagattggtatggccttagctcttagccaaacaccttcctgacaccatgagggccagcagcttcttgatcgtggtggtgttcctcatcgctgggacgctggttctagaggcagctgtcacgggagttcctgttaaaggtcaagacactgtcaaaggccgtgttccattcaatggacaagatcccgttaaaggacaagtttcagttaaaggtcaagataaagtcaaagcgcaagagccagtcaaaggtccagtctccactaagcctggctcctgccccattatcttgatccggtgcgccatgttgaatccccctaaccgctgcttgaaagatactgactgcccaggaatcaagaagtgctgtgaaggctcttgcgggatggcctgtttcgttccccagtgagagggagccggtccttgctgcacctgtgccgtccccagagctacaggccccatctggtcctaagtccctgctgcccttccccttcccacactgtccattcttcctcccattcaggatgcccacggctggagctgcctctctcatccactttccaataaagagttccttctgctccaaaaaaaaaaaaaaaaaaaaaaaaaaaa

SEQ ID NO: 59765 - DNA, 5451 bp, Homo sapiens
gggtggtgcagggcaggggtggtatatcctgtctgacggagggcgggcctcgccagtgccagagagggacgaaccagggtggaagcgccaggagcagctgcagggagccctcacgcggacctcgcactctatggccgtagggagccgctgagagcgagaagagcacgctcctgcccgcccgctgcaccgcacctcgcctcgcctctctgctctcctaggccccggccgcgcgccacccgcctcccgccaccatgaaccactcgccgctcaagaccgccttggcgtacgaatgcttccaggaccaggacaactccacgttggctttgccgtcggaccaaaagatgaaaacaggcacgtctggcaggcagcgcgtgcaggagcaggtgatgatgaccgtcaagcggcagaagtccaagtcttcccagtcgtccaccctgagccactccaatcgaggttccatgtatgatggcttggctgacaattacaactatgggaccaccagcaggagcagctactactccaagttccaggcagggaatggctcatggggatatccgatctacaatggaaccctcaagcgggagcctgacaacaggcgcttcagctcctacagccagatggagaactggagccggcactacccccggggcagctgtaacaccaccggcgcaggcagcgacatctgcttcatgcagaaaatcaaggcgagccgcagtgagcccgacctctactgtgacccacggggcaccctgcgcaagggcacgctgggcagcaagggccagaagaccacccagaaccgctacagcttttacagcacctgcagtggtcagaaggccataaagaagtgccctgtgcgcccgccctcttgtgcctccaagcaggaccctgtgtatatcccgcccatctcctgcaacaaggacctgtcctttggccactctagggccagctccaagatctgcagtgaggacatcgagtgcagtgggctgaccatccccaaggctgtgcagtacctgagctcccaggatgagaagtaccaggccattggggcctattacatccagcatacctgcttccaggatgaatctgccaagcaacaggtctatcagctgggaggcatctgcaagctggtggacctcctccgcagccccaaccagaacgtccagcaggccgcggcaggggccctgcgcaacctggtgttcaggagcaccaccaacaagctggagacccggaggcagaatgggatccgcgaggcagtcagcctcctgaggagaaccgggaacgccgagatccagaagcagctgactgggctgctctggaacctgtcttccactgacgagctgaaggaggaactcattgccgacgccctgcctgttctggccgaccgcgtcatcattcccttctctggctggtgcgatggcaatagcaacatgtcccgggaagtggtggaccctgaggtcttcttcaatgccacaggctgcttgagaaagagactgggcatgcgggagcttctggctcttgttccgcaaagggccactagtagcagggtgaacctgagctcggccgatgcaggccgccagaccatgcgtaactactcagggctcattgattccctcatggcctatgtccagaactgtgtagcggccagccgctgtgacgacaagtctgtggaaaactgcatgtgtgttctgcacaacctctcctaccgcctggacgccgaggtgcccacccgctaccgccagctggagtataacgcccgcaacgcctacaccgagaagtcctccactggctgcttcagcaacaagagcgacaagatgatgaacaacaactatgactgccccctgcctgaggaagagaccaaccccaagggcagcggctggttgtaccattcagatgccatccgcacctacctgaacctcatgggcaagagcaagaaagatgctaccctggaggcctgtgctggtgccctgcagaacctgacagccagcaaggggctgatgtccagtggcatgagccagttgattgggctgaaggaaaagggcctgccacaaattgcccgcctcctgcaatctggcaactctgatgtggtgcggtccggagcctccctcctgagcaacatgtcccgccaccctctgctgcacagagtgatggggaaccaggtgttcccggaggtgaccaggctcctcaccagccacactggcaataccagcaactccgaagacatcttgtcctcggcctgctacactgtgaggaacctgatggcctcgcagccacaactggccaagcagtacttctccagcagcatgctcaacaacatcatcaacctgtgccgaagcagtgcctcacccaaggccgcagaagctgcccggcttctcctgtctgacatgtggtccagcaaggaactgcagggtgtcctcagacagcaaggtttcgataggaacatgctgggaaccttagctggggccaacagcctcaggaacttcacctcccgattctaagaagagactgtccaagcaagttaggcttgcaggaagatatgacccagctgagaagccctcaggcctcgctggatggggttttctgtccatcctatgcagtatttgggaaagttcacaagaaactgagaagaaacctaaaaactgtggatagtggaaagatttttagattttttttttccttggggaaactggcaggcaatgggggttagggaggttggggcggtgggggctttcttgagttaaaggggcttatatgtgatgtcaatatttcttcctctgagaaatggtatatatatgtgtataatgtaagtgtgtgcatgcatgtgcgcgtgcatgtgtgtgtgtgtgagtgtcttaaagcataaccacaaactgcaaaaagctaggtaagctattttgttgcagctcataaggtggtgaaaaggactctcctgtgtttcttactcataggcaaggacaacatgtgctttttggtgagctgctcataattcctgaaatgtgtggtgccagggcaagggggccatcactgcagtcaggccctcagaggagtcctgcaggcttcctaccagtggtctccaggggtgcaggagtaactggggctgggccagcctccccacttacaaggctgctttccaggaagggaggtctggtgtatctcatgggagaatctggggtgtctgtaatgtcacccctccagcagcgccacaaggactgaggttgggtaggtgtggggttccagaggacagcaggacactctcgcatactttgccaaatgaggcctgctcagaggagtaggagctgaaagatggtgccttccaccctcttgggctgtgtgcccatcagagcaggctcagcctgcaaaggccctgcattcagaggtcttgtaatctacttgttgcaggagaaagaaggtaaaaaatgatttttttaagaaaagctattttattgcagctctttcccaagagctgttctgggaatggctggtcttcatattcccagtggagaggggaacaagtggggctgggcatatacctattccggcttctagtgggatggagttggggtatagaaattaaccaggaagatgtttccaccaagcctgctgtgagtcaattgagggagtgtttggggtcccaggagacttggacggggggagtttgggtagactaggaaaggaaagtgccatatcagggtaccggtaccggcaagctcacatctcagccaggggccatgccccacttcccctgaccccagctgtcttgtctccactctgtgaaacccacaggggatgtgataaacagggctattaggggtatcagccacgtcgagcccccagactctgtgcacttcagaccagcagcagcaggagggctcccgagggccttatgagaaaacctgtgtggacatcccttggtgtacactaagacagagcagagcccagcgctcccaagccttcctccttccagcttctacctccatgctagcattgctggtgttagagaggaattaacttcctggtctgtgcccttctctagaagaatataagatgctcctcctcctcaccccttctcagcctcctcccaagtcttcctcttctgcaccacccccgagtccaaacccacctcttgccccagcattcaggctggaaaacactgatgtggactcagtatgataactgagatgggggacgccagacatgtgaggacgctgtcctccgagaggtgtccccggctgttagccagctgtgctgtggtgctgtgggtctgtcataccctcccttgcttctgttcacactgggaggcccactcctggctcacctctccctctcagggacccacgtgggagcctggatccctggactgtcctgggcataggtttcaggggcctcctttgttgtcatcagaacccagaggaattcttctcctaaaaaatacgtatggcataccaatctgtgcggggcagtgtcctaagcacttagactacatcagggaagaacacagaccacatccctgtcctcatgcggcttatgttttctggaggaaagtggagacacaagtccttggctttagggctcccccggctgggggctgtgcagtccggtcagggcgggaggggaaatgcaccgctgcatgtgaaccttaccagcccaggcggatgccccttccccttagcactaccctggcctcctgcatcccctcgcctcatgttcctcccaccttcaaagaatgaagagccccatgggcccagcccctgccctgggaaccaggcagccttccagacctcaggggctgaggcagactattagggcagggctgactttggtgacactgcccattccctctcaggccagctcaggtcacccgggcctctgacccaggcctgtcactttgagaggggcaaaactgagaggggcttttcctagagaaagagaacaaggagcttgccaggcttcatgtagccgacacacgtctcaggattttaagtccacattggcctcacactaccagggccaatgcccaaaataaggagttccaatttggggccaaatgaggaaggacacagactctgccctgggatctcctgtgctagcggccaatgacaaatccagtcattggccaccagccacctctgcagtggggaccacactagcagccctgactccacactcctcctggggacccaagaggcagtgttgctgtctgcatgtccaccttggaatctggctgaactggctggcaggaccaagactgcggctggggtgggcagggaagggaagccgggggctgctgtgagggatcttggagcttccctgtagcccaccttccccttgcttcatgtttgtagaggaaccttgtgccggccaggcccagtttccttgtgtgatacactaatgtatttgctttttttggaaatagagaaaatcaataaattgctagtgtttctttgaaaaaaaaaa

SEQ ID NO: 59766 - DNA, 5388 bp, Homo sapiens
gggtggtgcagggcaggggtggtatatcctgtctgacggagggcgggcctcgccagtgccagagagggacgaaccagggtggaagcgccaggagcagctgcagggagccctcacgcggacctcgcactctatggccgtagggagccgctgagagcgagaagagcacgctcctgcccgcccgctgcaccgcacctcgcctcgcctctctgctctcctaggccccggccgcgcgccacccgcctcccgccaccatgaaccactcgccgctcaagaccgccttggcgtacgaatgcttccaggaccaggacaactccacgttggctttgccgtcggaccaaaagatgaaaacaggcacgtctggcaggcagcgcgtgcaggagcaggtgatgatgaccgtcaagcggcagaagtccaagtcttcccagtcgtccaccctgagccactccaatcgaggttccatgtatgatggcttggctgacaattacaactatgggaccaccagcaggagcagctactactccaagttccaggcagggaatggctcatggggatatccgatctacaatggaaccctcaagcgggagcctgacaacaggcgcttcagctcctacagccagatggagaactggagccggcactacccccggggcagctgtaacaccaccggcgcaggcagcgacatctgcttcatgcagaaaatcaaggcgagccgcagtgagcccgacctctactgtgacccacggggcaccctgcgcaagggcacgctgggcagcaagggccagaagaccacccagaaccgctacagcttttacagcacctgcagtggtcagaaggccataaagaagtgccctgtgcgcccgccctcttgtgcctccaagcaggaccctgtgtatatcccgcccatctcctgcaacaaggacctgtcctttggccactctagggccagctccaagatctgcagtgaggacatcgagtgcagtgggctgaccatccccaaggctgtgcagtacctgagctcccaggatgagaagtaccaggccattggggcctattacatccagcatacctgcttccaggatgaatctgccaagcaacaggtctatcagctgggaggcatctgcaagctggtggacctcctccgcagccccaaccagaacgtccagcaggccgcggcaggggccctgcgcaacctggtgttcaggagcaccaccaacaagctggagacccggaggcagaatgggatccgcgaggcagtcagcctcctgaggagaaccgggaacgccgagatccagaagcagctgactgggctgctctggaacctgtcttccactgacgagctgaaggaggaactcattgccgacgccctgcctgttctggccgaccgcgtcatcattcccttctctggctggtgcgatggcaatagcaacatgtcccgggaagtggtggaccctgaggtcttcttcaatgccacaggctgcttgaggaacctgagctcggccgatgcaggccgccagaccatgcgtaactactcagggctcattgattccctcatggcctatgtccagaactgtgtagcggccagccgctgtgacgacaagtctgtggaaaactgcatgtgtgttctgcacaacctctcctaccgcctggacgccgaggtgcccacccgctaccgccagctggagtataacgcccgcaacgcctacaccgagaagtcctccactggctgcttcagcaacaagagcgacaagatgatgaacaacaactatgactgccccctgcctgaggaagagaccaaccccaagggcagcggctggttgtaccattcagatgccatccgcacctacctgaacctcatgggcaagagcaagaaagatgctaccctggaggcctgtgctggtgccctgcagaacctgacagccagcaaggggctgatgtccagtggcatgagccagttgattgggctgaaggaaaagggcctgccacaaattgcccgcctcctgcaatctggcaactctgatgtggtgcggtccggagcctccctcctgagcaacatgtcccgccaccctctgctgcacagagtgatggggaaccaggtgttcccggaggtgaccaggctcctcaccagccacactggcaataccagcaactccgaagacatcttgtcctcggcctgctacactgtgaggaacctgatggcctcgcagccacaactggccaagcagtacttctccagcagcatgctcaacaacatcatcaacctgtgccgaagcagtgcctcacccaaggccgcagaagctgcccggcttctcctgtctgacatgtggtccagcaaggaactgcagggtgtcctcagacagcaaggtttcgataggaacatgctgggaaccttagctggggccaacagcctcaggaacttcacctcccgattctaagaagagactgtccaagcaagttaggcttgcaggaagatatgacccagctgagaagccctcaggcctcgctggatggggttttctgtccatcctatgcagtatttgggaaagttcacaagaaactgagaagaaacctaaaaactgtggatagtggaaagatttttagattttttttttccttggggaaactggcaggcaatgggggttagggaggttggggcggtgggggctttcttgagttaaaggggcttatatgtgatgtcaatatttcttcctctgagaaatggtatatatatgtgtataatgtaagtgtgtgcatgcatgtgcgcgtgcatgtgtgtgtgtgtgagtgtcttaaagcataaccacaaactgcaaaaagctaggtaagctattttgttgcagctcataaggtggtgaaaaggactctcctgtgtttcttactcataggcaaggacaacatgtgctttttggtgagctgctcataattcctgaaatgtgtggtgccagggcaagggggccatcactgcagtcaggccctcagaggagtcctgcaggcttcctaccagtggtctccaggggtgcaggagtaactggggctgggccagcctccccacttacaaggctgctttccaggaagggaggtctggtgtatctcatgggagaatctggggtgtctgtaatgtcacccctccagcagcgccacaaggactgaggttgggtaggtgtggggttccagaggacagcaggacactctcgcatactttgccaaatgaggcctgctcagaggagtaggagctgaaagatggtgccttccaccctcttgggctgtgtgcccatcagagcaggctcagcctgcaaaggccctgcattcagaggtcttgtaatctacttgttgcaggagaaagaaggtaaaaaatgatttttttaagaaaagctattttattgcagctctttcccaagagctgttctgggaatggctggtcttcatattcccagtggagaggggaacaagtggggctgggcatatacctattccggcttctagtgggatggagttggggtatagaaattaaccaggaagatgtttccaccaagcctgctgtgagtcaattgagggagtgtttggggtcccaggagacttggacggggggagtttgggtagactaggaaaggaaagtgccatatcagggtaccggtaccggcaagctcacatctcagccaggggccatgccccacttcccctgaccccagctgtcttgtctccactctgtgaaacccacaggggatgtgataaacagggctattaggggtatcagccacgtcgagcccccagactctgtgcacttcagaccagcagcagcaggagggctcccgagggccttatgagaaaacctgtgtggacatcccttggtgtacactaagacagagcagagcccagcgctcccaagccttcctccttccagcttctacctccatgctagcattgctggtgttagagaggaattaacttcctggtctgtgcccttctctagaagaatataagatgctcctcctcctcaccccttctcagcctcctcccaagtcttcctcttctgcaccacccccgagtccaaacccacctcttgccccagcattcaggctggaaaacactgatgtggactcagtatgataactgagatgggggacgccagacatgtgaggacgctgtcctccgagaggtgtccccggctgttagccagctgtgctgtggtgctgtgggtctgtcataccctcccttgcttctgttcacactgggaggcccactcctggctcacctctccctctcagggacccacgtgggagcctggatccctggactgtcctgggcataggtttcaggggcctcctttgttgtcatcagaacccagaggaattcttctcctaaaaaatacgtatggcataccaatctgtgcggggcagtgtcctaagcacttagactacatcagggaagaacacagaccacatccctgtcctcatgcggcttatgttttctggaggaaagtggagacacaagtccttggctttagggctcccccggctgggggctgtgcagtccggtcagggcgggaggggaaatgcaccgctgcatgtgaaccttaccagcccaggcggatgccccttccccttagcactaccctggcctcctgcatcccctcgcctcatgttcctcccaccttcaaagaatgaagagccccatgggcccagcccctgccctgggaaccaggcagccttccagacctcaggggctgaggcagactattagggcagggctgactttggtgacactgcccattccctctcaggccagctcaggtcacccgggcctctgacccaggcctgtcactttgagaggggcaaaactgagaggggcttttcctagagaaagagaacaaggagcttgccaggcttcatgtagccgacacacgtctcaggattttaagtccacattggcctcacactaccagggccaatgcccaaaataaggagttccaatttggggccaaatgaggaaggacacagactctgccctgggatctcctgtgctagcggccaatgacaaatccagtcattggccaccagccacctctgcagtggggaccacactagcagccctgactccacactcctcctggggacccaagaggcagtgttgctgtctgcatgtccaccttggaatctggctgaactggctggcaggaccaagactgcggctggggtgggcagggaagggaagccgggggctgctgtgagggatcttggagcttccctgtagcccaccttccccttgcttcatgtttgtagaggaaccttgtgccggccaggcccagtttccttgtgtgatacactaatgtatttgctttttttggaaatagagaaaatcaataaattgctagtgtttctttgaaaaaaaaaa

SEQ ID NO: 59767 - DNA, 3587 bp, Homo sapiens
ggccgctgtcctatcccactgggaccgtcgctgccactcagccagagagccagcatcttggcaagggctgggcctggagtgaagctggaagggctagcatggagagcctgtcacctgggggaccaactggccacccttaccagggggaggcctctacctgctggcagctcacagtgagggtcctggaggcgcggaacctgcgctgggctgacctgttgagtgaggccgacccttacgtgatcctacagctgtcgaccgcacctggaatgaagtttaagaccaagacgctcaccgacaccagtcatcctgtgtggaatgaggccttccgtttccttatccaaagtcaggtcaagaatgttctggagcttagcatctatgatgaggactcagtcacggaggatgacatctgcttcaaggttctctatgacatctcagaagtcctccctggcaagctgctccggaaaaccttctcccagagtccccagggagaggaggagctggatgtggagttcctgatggaagaaacgtcagatcgcccagaaaacctcatcaccaacaaagtcattgtggcccgagagctgtcatgcctggatgtgcatctggacagcacagggagcaccgctgtggttgcagatcaggacaagctggagctggagctggtgctgaaggggtcctatgaggacacacagacatccttcctgggcacagcctctgccttccgcttccactacatggcagccctagagacagagctgagcgggcgcctgaggagctccagaagcaatggctggaatggggacaactcagctgggtacctcactgtgcccctgaggcccttgaccattgggaaggaggtgactatggatgttcctgctccaaatgccccaggagtgaggctgcagctcaaggcagagggctgccctgaggagctggccgtgcacctgggcttcaatctctgtgcagaggagcaggccttcctgagcaggaggaagcaggtggtggccaaggccctgaagcaggccctgcagctggacagagacctgcaggaggatgaggtacccgttgtgggcatcatggccacaggaggaggtgcccgggccatgacctcactctacggccacctattggccttgcagaagctgggcctcctagactgtgtgacctacttcagtggcatctctggctctacgtggacaatggcccacctgtacggggaccctgagtggtcgcagagggacctggagggacctatcagatacgcccgggagcacctggccaagagcaagctggaggtcttttccccagagcgcctggcgagctaccgccgggagctggagctgcgggctgagcagggccaccccacgacctttgtggacctgtgggcgctagtgctggagtccatgctgcacggccaggtgatggatcagaagctgtcaggacagagagccgccctggaacggggtcagaaccctctgcccctctacttgagcctcaatgtcaaagagaacaatctggagacactggacttcaaggagtgggttgagttctccccctatgaggtcggtttcctgaagtacggggccttcgtccctcctgagctcttcggctccgagttcttcatgggacggctgatgaggaggatcccggagccccggatctgctttctggaagccatctggagcaacattttctccctgaacctgctggatgcctggtatgacctcaccagttctggggagtcctggaaacagcacatcaaggacaagaccaggagcttagagaaggagcccctgaccacctcggggacctcctcgcggctggaggcctcgtggctgcagccaggcacggcgctggcccaggcatttaaaggcttcctgacaggcaggcccctccaccagcgcagccccaacttcctccagggcctccagctgcaccaggactactgtagccacaaagacttctccacctgggcagactaccagcttgactccatgcccagccagctgacccccaaggagccccggctctgcctggtggacgccgcctacttcatcaacaccagctctccctccatgttccggccaggccgcaggctggacctcatcctctccttcgactactccctatctgcgcccttcgaggcactgcagcagacggagctgtactgccgggcccgggggctgcccttcccccgggtggaacccagccctcaggaccagcaccagccaagggaatgccacctcttctcagaccccgcctgccccgaggccccgatcctgctgcacttcccgctggtcaatgcctccttcaaggaccactcagcccccggtgtccagcgcagccccgcagagctccagggtggccaagtggatctcaccggggccacctgcccctacaccctgtccaacatgacctacaaggaggaagacttcgagcgcctgctgcggctcagtgactacaacgtgcagaccagccagggtgccatcctgcaggccctgaggaccgcgctgaagcaccggactctagaggcgaggcctccaagggcacagacctgaggttgctcagaggctgcaggaccctccagggcctgcgggcataacctgatctgtagctgggctcagccacaggccttcctggttggagttctgggctctcccaggcctgggtggcctctgtagctggtctcactgcccagagggaactgcacacacagacttctctcttacgttcatggctggcttgagatgagttgaaaataacttcgccaggccagtgtgtagaacagctggtccaaccagacagactttcacaccacaattacttccatgcctgagcaggatagatttgaagtgcaagccggaggcagcagatcaggagtagggacaggaaggacaggggatgcctgacctgacaggtggcttcaggcctcgggaatcacaagacatcctgaacacattgcctcctcatcttcttcctgctcctccacctcctcctctccttgtccttctcctctttgtcctcctgctttccgtatccaagtcttgtacttgtttaaatttattcctaaatattttattctttttgataagtggagttactttcttaatttcatttagattattcattgctattttatagaaatacaatggatttttaaatgttgatcttgtattccgcaatcttgctgaagttgtttaccggctctaatacttttgcggatttcttagaattttctgtagacagatcatgccatctccaaatagagatggttttacttcttcctgtctgatctgaatgccttttatttatttttcccaattgccctgagcagtacaatgatgaacacacgtttcaagagcagacatcttgtcttgttcctgactctgacaagaaagcataagtctctcaccatttagtgtgattttagctgtgggtttttcttggacatccttatcaggttgagaaagttctcttttatttctagtttattgagtgttttatgatgaaacggtgttaggttttgtcaagtgatttttctgtgtctatgggcatgatcatgtggttttgtcgtgtattttattaatgta

SEQ ID NO: 59768 - DNA, 2374 bp, Homo sapiens
gggtggggggaataacatgttcttttaaacgcagagtttaaacattgagttgcatcattgtgaggaaaaccacttagtatttttagtgaggtgactttacaagtaaagatcttcaagaagatttttatgtgatttaaaaaatcagcttagatgcttggaatttggattgttgcattcttgttctttggcacatcaagaggaaaagaagtttgctatgaaaggttagggtgtttcaaagatggtttaccatggaccaggactttctcaacagagttggtaggtttaccctggtctccagagaagataaacactcgtttcctgctctacactatacacaatcccaatgcctatcaggagatcagtgcggttaattcttcaactatccaagcctcatattttggaacagacaagatcacccgtatcaacatagctggatggaaaacagatggcaaatggcagagagacatgtgcaatgtgttgctacagctggaagatataaattgcattaatttagattggatcaacggttcacgggaatacatccatgctgtaaacaatctccgtgttgttggtgctgaggtggcttattttattgatgttctcatgaaaaaatttgaatattccccttctaaagtgcacttgattggccacagcttgggagcacacctggctggggaagctgggtcaaggataccaggccttggaagaataactgggttggacccagctgggccatttttccacaacactccaaaggaagtcaggctagacccctcggatgccaactttgttgacgttattcatacaaatgcagctcgcatcctctttgagcttggtgttggaaccattgatgcttgtggtcatcttgacttttacccaaatggagggaagcacatgccaggatgtgaagacttaattacacctttactgaaatttaacttcaatgcttacaaaaaagaaatggcttccttctttgactgtaaccatgcccgaagttatcaattttatgctgaaagcattcttaatcctgatgcatttattgcttatccttgtagatcctacacatcttttaaagcaggaaattgcttcttttgttccaaagaaggttgcccaacaatgggtcattttgctgatagatttcacttcaaaaatatgaagactaatggatcacattattttttaaacacagggtccctttccccatttgcccgttggaggcacaaattgtctgttaaactcagtggaagcgaagtcactcaaggaactgtctttcttcgtgtaggcggggcaattgggaaaactggggagtttgccattgtcagtggaaaacttgagccaggcatgacttacacaaaattaatcgatgcagatgttaacgttggaaacattacaagtgttcagttcatctggaaaaaacatttgtttgaagattctcagaataagttgggagcagaaatggtgataaatacatctgggaaatatggatataaatctacctactgtagccaagacattatgggacctaatattctccagaacctgaaaccatgctaatctcagatacagtcttgatggatttctttagtaggagcaatgaagaaaagtgtctccttccacctggcatccagaccaaatttgacccttgtaaatgacttagtcatttacaggggtcttactcagagtcaagtacgggtttgctttttttctgtgtagaatgttcatctaactgcaccttaaaaacacactgaaccctgggacaaaagataattactatgatctgtaggaatctggatatcattgacaaaatagagctgttttggaattttcctgaataagaggaggtgatgcaaatgtatgttgagtgtataaactcactggacaaaagtaagcctctggcttgctgagtttttgaagtatattttcaggtataataatcattgttctaaaattatataaaactatttgttatgttgttaaatcttgctgagacaaattatgactatagtgcatgatatatagtagattataaccttgtgggttgatgtgtctatctagtaataataaaaactaatgagatggcactagtatttccaaggtgttccttggtgttcagggtgtgcacaagagagattttggagcttatctgttatgtgttcatcagttagcaatgggacctgaagttcaacaacccagggtatagcccccttcctccaaagtccctgccacaggagaattactcctctctctgggtcttgaatgctctatggtgaatttgtatttagcctcaaggcagcatttcatttgtaaagcacttgggtaaccctttgttcttgcaataacaatattataatatttaaaaaaaaaaaaaaaaaaa

SEQ ID NO: 59769 - DNA, 2367 bp, Homo sapiens
agacacaaaatcagccagggggagcccacattggagggcagtccacaatggaaggcttcttggaggaggagatgattgagctgcttctactaagatgagtatctcagagtcctcaacgtgggtgtggccgaggtgaagaaatccttcctggggcccttgtccccgtcctgtaagatggtgcagatgatgaggcagtttctgtaccgggtcctgcccgaggactcctacaaggtcaccacggggaagctccatgtgagcctcacccgcttaacggacggggaaaatgtggtggtttcagagttcacgtccaaggaggagctcattgaggccctatactgcagctgcttcgtcccggtgtactgtggcctcatccccccgacttaccgcggtgtgaggtacatcgatgggggcttcacgggcatgcagccctgtgccttctggaccgacgccatcaccatctccaccttcagtgggcagcaggacatctgtccccgggactgcccggccatcttccacgacttccgcatgttcaactgctccttccagttctccctggagaacatcgccaggatgacccacgcattgttccccccggacctggtgatcctgcacgattactactaccgagggtacgaggatgcagttttgtacttgaggcggctgaatgctgtttatcttaattcttcctccaagagagtgattttcccccgggtggaagtgtactgccagatagaactcgcccttggcaatgagtgccctgaacgcagtcaaccaagccttcgagcacggcaggccagtctggaaggagccacacaacctcacaaggagtgggttcccaaaggggatggaaggggcagccatggtccgcctgtgtcccaacctgtgcagacacttgaattcacatgcgagtcacctgtttcagcaccagtctctccacttgagcagccacctgcacagccactggcctcttcaactccactttctctaagtggcatgccacctgtatcattcccagctgtgcacaagccacccagctccacacctggttcatcactgcccaccccaccacctggactgtcacctctgtcacctcagcagcaggtacaaccgtctggatcaccagccagatccctacactctcaggcacccacttcacacaggccatccctggggccttcaactgtgggggcacctcaaacactgccccgaagttctctttcagccttccctgctcagccacctgtggaggaactaggccaagaacagccccaagctgtagctcttcttgtctcttcaaaaccaaaaagcgccgtgcctctggttcatgtgaaggaaaccgtcagcaagccttatgtaacggagagccctgctgaagactcaaactgggtgaataaggtcttcaagaagaacaagcaaaagacaagtggcaccagaaaaggcttcccaagacattcgggatccaaaaaaccaagcagcaaagtgcagtgagcatgtctaatgttccttaaatcccacggagaggagcagctttgggaactgtgttcagagagattccgaggaatagaggagagtgtaagggagtagggggtgcagtgggagattgggctttggaacagacacatccgacataaaattcctgctctgccacagctccactcagggatcatggttgggacacttgctctccctgagcctccatttcctgtaaaatggggatgataccacttcataaagttgtgagagttaaatgtgatcgatgatgtaaattgcttcatagaatgcagaatgtgtaatagctcacaataagtaggtattatgtttacatattatgtttgtatttatgctacttaaatacaaaactggacaggccaggcatggtggctcatgcctgtaatcccagcactttgggaggctgaggtaggtggaaaacctgaggtcaggagttcaagaacagcctgaccaacatggtgaaactccatctctactaaaaatacaaaaattaaccaggcttgatggtgtgcacctgtaatctcagctactcgggaggctgaggcaagagaatcgcttgaacccaggaggcagaggttgcagtgcaccaagactgcgccattgcactccagcccgggcaacaagagcgaaaccccatctcgaaaaaaaacaaaacaaaactagacaagtgagtgcctacgtgacactcaaatgttgccagcatacagttaagggccctagtcaatgtaggcctgcttcttatagctttttgactatattatgctgtctttgacttagtcagtcaacacttattgagcacctactaagtgccaaacactctcctggactctggcaaaataaaaaatgaattaaaactct

SEQ ID NO: 59770 - DNA, 2868 bp, Homo sapiens
ggggaggatggtgaatctggagtccatgcacacagatatcaagatgagtggggatgtagccgattccacggatgctcgcagcactctcagccaggtggagccaggaaatgatcgaaaaggcctagatttcaacaggcagattaaaaccgaagatctcagtgactccctgcagcagaccctctcccatcggccatgccacctgagtcaaggacctgccatgatgtccggaaaccaaatgtctgggctaaatgccagcccatgtcaggacatggcttccctccatccgctccagcagcttgtgctggttcccggccacttacagtctgtatcccagttcctgctatctcagacccagcctgggcagcaaggtctgcagccaaatctcctcccctttccacagcaacaaagcggtctcctcctcccacagactgggccgggactggcatcccaggcatttgggcaccctgggctgccaggatcctctttagaaccccacctggaagcatcccagcatctcccagtgcccaagcatctacccagctctggaggggccgatgagcccagtgacctcgaggagctggagaagtttgccaagaccttcaagcagaggcgcattaagctgggcttcacacagggagatgtggggctggcgatgggaaagctgtatggcaacgacttcagccagaccaccatctcacgatttgaggccctcaacctgagcttcaagaacatgtgcaagctcaagcccctgctggagaagtggctgaatgatgcagagtcctctccgtcagacccctcagtgagcacgcccagctcctaccccagcctcagtgaagtatttggtaggaagagaaagaaacggaccagcatcgagaccaacatccgcctgactctggagaagaggtttcaagataacccaaaacccagctcggaggagatctccatgattgcagagcagttgtccatggagaaggaggtggtgagggtctggttctgcaaccgacgccaaaaggagaagcgaatcaactgccctgtggccacacccatcaaaccacctgtctacaactcccggctggtatctccctcagggtctctgggccccctctctgtccctcctgtccacagtaccatgcctggaacagtaacgtcatcctgttcccctgggaacaacagcaggccttcatctcctggctcaggactccacgccagcagccccactgcatctcaaaataactccaaagcagcagtgaactccgcctccagttttaactcttcaggatcttggtaccgatggaatcattccacctacctccactgagaccaaaaagtttctcctactccagctggccctgtattcccctggaaggaagggaatcatgccttctatatacagacagattgccttcagaagagtggaagaaaatctccactatcaatgaacccagactcttgtcttcttcaagagcaagggcctccggagatccaaactgtgattgaaccaagtgcagactcctaatgctcttgaaatacacagcccctcctaggagcttaccattttcaccttccttgcctatgcccttgccttctagttccaaatattttagccagcttcactgtggcaatagtctttcagagaaaagacttcttgctgttattctccaactcatccgtgggcttctggggacagccatttggctggggtgccaaacaccagaaggggagataatagttttgactctgaacttggccacaacccctgaactgatcccaaaatctgtgaaaagatttgaatctgatatctccaccaaagccttgatgttttctctgtacagctaagttttctgatggaatcttcatctcaccccattttctttttaacctcgcccccttttctacaatcaaatccattcattattgcgccctccaggtcccctcctttttgcagaaggtgtaaaagagctgcccttggtgggtgcccttgagcatgttgcaacgcctgctggtgcccttctgtctgtccacgtctgcctagggctcaggagtgcttgttctttccctggcgccctgggtttctctttatcctgtcccctctcctttctcctggcagcagaaaaggaagaacacaagagcaaacacacaacaatgatggtggcaaagtacctgtatatagccctttcccatttttgcattatgttcttaactccttaatgtggaattttccagcaaaatgtttaactcaggtgtgatttttgaaaatgtctctgtaatattttatcttctttaaaaaaaagggggggaaataccaaagtgtgaaatactgtgctaccttccagagttcccacatgggctgggatttttttttctttttcttttttttttttttttttgagacagtcttgctccagcccaggctggagtgcagtggcatgatcttggctcactgcatgctctgccacttgggttcaagcgattctcctgcctcagcctctcaagtagcggattacaggcgcccaccaccaaaaattagcccagctaatttttgtatttttagtagagatggggtttcaccatgttggtcaggctggtcttgaactcctgacctcctgatccacccacctcagcgtcccgaagtgctgggattacaggtgtgagccaccgcgcctggcctgggctgggaatctttgttgacttctttgggaacattatctctagagtctgcttttttgtgggccagtttgtagagatgtaacatgaagccattccagaaatggtaacttaaaaaaaaaaagactacatgtctaggaaactgttgagattcaaaggaatctcactgttcctaaataaatgtgtatagtgattatgaaaagt

SEQ ID NO: 59771 - DNA, 944 bp, Homo sapiens
cagagttgggagtgactccagagcctccagcgagatgctgctgattctgctgtcagtggccctgctggccctgagctcagctgagagttcaagtgaagatgtcagccaggaagaatctctcttcctaatatcaggaaagccagaaggacgacgcccacaaggaggaaaccagccccaacgtcccccacctcctccaggaaagccacaaggaccacccccacaaggaggaaaccagtcccaaggtcccccacctcctccaggaaagccagaaggacgacccccacaaggaggcaaccagtcccaaggtcccccacctcatccaggaaagccagaaagaccacccccacaaggaggaaaccagtcccaaggtaccccacctcctccaggaaagccagaaagaccacccccacaaggaggcaaccagtcccaccgtcccccacctcctccaggaaagccagaaagaccacccccacaaggaggtaaccagtcccaaggtcccccacctcatccaggaaagccagaaggaccacccccacaggaaggaaacaagtcccgaagtgcccgatctcctccaggaaagccacaaggaccaccccaacaagaaggcaacaagcctcaaggtcccccacctcctggaaagccacaaggcccacccccagcaggaggcaatccccagcagcctcaggcacctcctgctggaaagccccaggggccacctccacctcctcaagggggcaggccacccagacctgcccagggacaacagcctccccagtaatctaggattcaatgacaggaagtgaataagaagatatcagtgaattcaaataattcaattgctacaaatgccgtgacattggaacaaggtcatcatagctctaactttaatataccaataaaataatcagcttgcaaaaaaaaaaaaaaaaaaaaaaaaaaaaaaa

SEQ ID NO: 59772 - DNA, 1143 bp, Homo sapiens
gagatgccaagtgggtattgactgctccaggatgtggatggagggtgtgaaaaccagggtggggtgacgcaggctctgggtcatgatagggagagcaggcagctgggtcctgggctggaggactaaaataagggacgccaccttcaggggtgacacatcagcccaggccctccctacgggtttgaccagtcctgttctgacggtattcctgcgccactgggctggtccctcctccactcctcccctataaagcctcctggggtccccaggcacccagactcagcccaccccagctttgggggccagtacgcagccatgatcctcaactggaagctcctggggatcctggtcctttgcctgcacaccagaggcatctcaggcagcgagggccacccctctcacccacccgcagaggaccgagaggaggcaggctccccaacattgcctcagggccccccagtccccggtgacccttggccaggggcaccccctctctttgaagatcctccgcctacccgccccagtcgtccctggagagacctgcctgaaactggagtctggccccctgaaccgcctagaacggatcctcctcaacctccccggcctgacgacccttggccggcaggaccccagcccccagaaaacccctggcctcctgcccctgaggtggacaaccgacctcaggaggagccagacctagacccaccccgggaagagtacagataatggagtcccctcagccgttctgttcccaggcatctccaggcacccacgccctctccaccctctgattccccgtgaattcttcccaatttagcctatctccttaaacctcttcctcattccctcggttttattctgaacccgtaaggtggtgttctcaatatttcctgtcccctcctgagatccatacttagtcctcacatcgcccgttttttcctctgacagcctaagcctactctcctacctcgcctccaggcctcggccccacctacctcccacccggtcttcctgcccgcgcgatcgctggggcagggctacggtactgtgttcccttctgccacctggtggccggcggcaggaactatcagtagacagctgctgcttccatgaaacggaaaaataaaaatcatgttttcttaa

SEQ ID NO: 59773 - DNA, 1465 bp, Homo sapiens
catgaacctgattcatttcctgatccagtgatgctcccagcccacccccaaacagacacagcgtagcccgggccagctcttaaggagttcaggagtgagaagaggccctcagagatctgacagcctaggagtgcgtggacaccacctcagcccactgagtaggagtcacagcacgaagaccaagcgcaaagcgacccctgccctccatcctgactgctcctcctaagagagatggcaccggccagagcaggattctgcccccttctgctgcttctgctgctggggctgtgggtggcagagatcccagtcagtgccaagcccaagggcatgacctcatcacagtggtttaaaattcagcacatgcagcccagccctcaagcatgcaactcagccatgaaaaacattaacaagcacacaaaacggtgcaaagacctcaacaccttcctgcacgagcctttctccagtgtggccgccacctgccagacccccaaaatagcctgcaagaatggcgataaaaactgccaccagagccacgggcccgtgtccctgaccatgtgtaagctcacctcagggaagtatccgaactgcaggtacaaagagaagcgacagaacaagtcttacgtagtggcctgtaagcctccccagaaaaaggactctcagcaattccacctggttcctgtacacttggacagagtcctttaggtttccagactggcttgctctttggctgaccttcaattccctctccaggactccgcaccactcccctacacccagagcattctcttcccctcatctcttggggctgttcctggttcagcctctgctgggaggctgaagctgacactctggtgagctgagctctagaaggatggcttttcatctttttgttgctgttttcccagatgcttatccccaagaaacagcaagctcaggtctgtgggttccctggtcatgccattgcacatgtctcccctgccccctggcattagggcagcatgacaaggagaggaaataaatggaaaggaggcatatgggatttgtggacacagctgtttctgttcctgaactagaggtcttccccagctctgacgtggcagtgaggtgacctgaaggaaagaaaaatataaataaataccacttcatatttgtatagaatcctctaatcccttgtgacatagacttgacagggattgtatgccttctttatggatgaggaaattaaggttttagaaagcttaatgaattaaagagcttgtctaattagttagtagcagaacctggacttgaacctaggtctccttgctctaaatacagtgtaccttctactctaccagttgcgcaagaaagaagtcactgtcacagaggcaagcggtgaactaggtaagagttcactcatgaagaaacgagtgctctgaagagccagttaccctgtgttggctgcaataaaggtcattacctctct

SEQ ID NO: 59774 - DNA, 9147 bp, Homo sapiens
accctgcaagctgcattaggctttatcctacttgttcctttggtgaaccagggttcacttaaacttgcaaaaagatgaccgacctcttgagaagtgttgtcaccgtaattgatgttttctacaaatacaccaagcaagatggggagtgtggcacactgagcaagggtgaactaaaggaacttctggagaaagagcttcatccagttctgaagaacccagatgatccagacacagtggatgtcatcatgcatatgctggatcgagatcatgacagaagattggactttactgagtttcttttgatgatattcaagctgactatggcctgcaacaaggtcctcagcaaagaatactgcaaagcttcagggtcaaagaagcataggcgtggtcaccgacaccaagaagaagaaagtgaaacagaagaggatgaagaggatacaccaggacataaatcaggttacagacattcaagttggagtgagggagaggagcatggatatagttctgggcactcaaggggaactgtgaaatgtagacatgggtccaactccaggaggctaggaagacaaggtaatttatccagctctgggaaccaagagggatctcagaaaagataccacaggtccagctgtggtcattcatggagtggtggcaaagacagacatggttccagctctgtagaactgagagaaagaataaacaagtcacacattagcccttctagggaatctggggaggagtatgaatctggatctggatcaaacagttgggaaaggaaaggtcatggtggtctgtcatgtggattggagactagtgggcatgaatcaaactctactcagtcaagaattagagaacaaaagcttgggtctagctgttcaggttcaggagacagtgggaggcgaagtcatgcatgtggttatagcaattcaagtgggtgtggaaggccacaaaatgcttcaagttcttgtcagtcacatagatttggagggcaaggaaatcaatttagctatattcagtcaggctgtcagtcaggaattaagggaggacaaggccatggctgtgtctcaggaggtcagccctctggatgtggtcaacctgagtctaacccctgtagtcagtcctatagtcagagaggatatggagctagagaaaatggtcaaccacagaactgtggaggacaatggagaacaggctcaagtcagtcctcttgctgtggacaatatgggtctggaggtagccagtcttgtagtaatggtcaacatgaatatggttcctgtggccgcttttcaaactcttctagttcaaatgaattttccaaatgtgatcaatatgggtctggttcaagtcagtctactagctttgaacaacatggaacaggcttgagtcagtcctctgggttcgaacaacatgtatgtggctcaggtcaaacttgtggccagcatgagtctacatcaagtcaatccttgggctatgaccagcatgggtctagctcaggtaagacatctggctttggacaacatgggtctggctcaggtcagtcctctggctttggacaatgtgggtcaggctcaggtcagtcctctggctttggacagcatgggtctgtctcaggacaatcctctggttttggacagcatgggtctgtctcaggacaatcctctggttttggacaacatgagtctagatcacgtcagtctagctatggccaacatggttctggctcaagtcaatcatctggctatggccaatatgggtctagagagacatctggctttggacaacatgggttgggctcaggtcaatccactggctttggccaatatggatcgggctcaggtcagtcctctggctttggacaacatgggtctggctcaggacaatcctctggctttggacaacatgagtctagatcaggtcagtctagttatggccaacacagttctggctcaagtcagtcatctggctatggccaacatgggtctagacagacatctggctttggacaacatgggtcaggctcaagtcaatccactggctttggccaatatggatcaggctcaggtcagtcctctggctttggacaacatgtttctggctcaggacaatcctctggttttggacaacatgagtctagatcaggtcattctagctatggccaacatggttttggctcaagtcaatcatctggctatggtcaacatgggtcaagttcaggacagacatctggatttggacaacacgagttaagctcaggtcagtcttccagctttggccaacatggatcaggctcaggtcagtcctctggctttggacaacatgggtctggctcaggacaatcctctggctttggacaacatgagtctagatcaggtcagtctagctatggccaacacagttctggctcaagtcagtcatctggctatggccaacatgggtctagacagacatctggctttggacaacatgggtcaggctcaagtcaatccactggctttggccaatatggatcaggctcaggtcagtccgctggctttggacaacatgggtctggctcaggacaatcctctggctttggacagcatgagtctagatcacatcagtccagctatggccaacatggttctggctcaagtcaatcatctggctatggtcaacatgggtcaagttcgggacagacatctggctttggacaacacaggtcaagctcaggtcaatactctggctttggacaacatggatcaggctcaggtcagtccagtggctttggacaacatgggactggctcaggacaatactctggttttggacaacatgagtctagatcacatcagtctagctatggccaacatggttctggctcaagtcagtcatctggctatggtcaacatgggtcaagttcaggacagacttttggatttggacaacacaggtcaggctcaggtcaatcctctggctttggccaacatggatcaggctcaggtcagtcctctggctttggacaacatgagtcaggctcaggaaaatcctctggctttggacagcatgagtctagatcaagtcagtctaattatggccaacatggttctggctcaagtcagtcatctggctatggtcaacatgggtctagttcaggacagacaactggctttggacaacacaggtcaagctcaggccaatactcaggctttggacaacatggatcaggctcagatcagtcctctggctttggacaacatgggactggttcaggacaatcctctggttttggacaatatgagtctagatcacgtcagtctagctatggccaacatggttctggctcaagtcaatcatctggctatggtcaacatgggtcaaattcaggacagacatctggatttggacaacacaggccaggctcaggtcagtcctctggctttggccaatatggatcgggctcaggtcagtcttctggctttggacaacatgggtcaggcacaggtaaatcctctggctttgcacagcatgagtacagatcaggtcagtctagctatggccaacatggtactggctccagtcaatcatctggctgtggccaacatgagtctggctcaggtccaaccacaagttttggacagcatgtgtctggctcagacaatttctctagttctggacaacatatatctgactcaggtcagtccactggatttggccaatatggttcaggctcaggtcaatcaactggcttgggccagggtgaatctcaacaagtagagtcaggatccacagttcatgggagacaggaaactactcatggtcagacaataaataccactagacatagccagtctggtcaaggacaatccacacagacagggtccagggtaactagaagacgaagatctagccaaagtgagaacagtgacagtgaagtgcactcaaaggtctcacacagacattcagaacacattcacacacaagctggatctcactacccaaagtcaggatccacagttcgcagaagacaaggaactactcatggacagagaggagataccactagacatggccattctggtcatggacagtctacacagacaggttccagaacatctggaagacagagatttagccacagtgatgccactgacagtgaagtgcactcaggggtctcacatagaccacactcacaagaacaaactcacagccaagctggatctcaacatggagagtcagaatccacagttcatgagagacatgaaactacttatggacagacaggagaggccactggacatggccactctggtcatggacagtccacacagagagggtccaggacaactggaagaaggggatctggccatagtgagtccagtgacagtgaagtgcactcagggggctcacacagaccacaatcacaagaacaaactcatggccaagccggatctcaacatggagagtcaggatccacagttcatgggagacacggaactactcatggacagacaggagataccactagacatgcccactatcatcatggaaaatccacacagagagggtccagtacaactggaagaaggggatctggccacagtgagtccagtgacagtgaagtgcactcagggggctcgcacacacattcaggacacactcacggccaaagtggatctcaacatggagagtcagaatccataattcatgacagacacagaattactcatggacagacaggagataccactagacattcctactctggtcatgaacaaaccacacagacagggtccaggacaactggaagacagagaactagccacagtgagtccactgacagtgaagtgcactcagggggctcacacagaccacactcacgagaacacacttacggccaagccggatctcaacatgaagagccagaattcacagttcatgagagacacggaactactcatggacagataggagataccactggacattcccactctggtcatggacagtccacacagagagggtccaggacaactggaagacagagatctagccacagtgagtccagtgacagtgaagtgcactcaggggtctcacacacacatacaggacacactcatggtcaagctggatctcaacatggacagtcagaatccatagttcctgagagacatggaactactcatggacagacaggagataccactagacatgcccactatcatcatggattaaccacacagacagggtccaggactactggaagaaggggatctggccacagtgagtacagtgacagtgaagggtactcaggagtctcacatacacattcaggacacactcatggccaagccagatctcaacatggagagtcagaatccatagttcatgagagacatggaactatacatggacagacaggcgataccaccagacatgcccactctggtcatggacagtccacacagacagggtccaggaccactggaagaaggtcatctggccacagtgagtacagtgacagtgaagggcactcagggttctcacaaagaccacactcacgaggacacactcacggccaggctggatctcaacatggagagtcagaatccatagttgacgagagacatggaactactcatggacagacaggagataccagtggacattctcaatctggtcatggacagtccacacagtcaggatccagtacaactggaagaaggagatctggccacagtgagtccagtgacagtgaagtgcactcagggggctcacatacacattcaggacacacacacagccaagccaggtctcaacatggagagtcagaatccacagttcacaagagacaccaaactactcatggacagacaggagataccactgaacatggccaccctagtcatggacaaaccatacagacagggtccaggacaactggaagaaggggatctggccacagtgagtacagtgacagtgaagggccctcaggggtctcacacacacattcaggacacactcacggtcaagctggatctcactatccagagtcaggatcctcagttcatgagagacacggaactactcatggacaaacagcagataccactagacatggccactctggtcatggacagtccacacagagagggtccaggacaactggaagaagggcatctggccacagtgagtacagtgacagtgaagggcactcaggggtctcacacacacattcaggacacgctcatggccaagccggatctcaacatggagagtcaggatcctcagttcatgagagacacggaactactcatggacagacaggagataccactagacatgctcactctggtcatggacagtccacacagagagggtcaaggacagctggaagaaggggatctggccacagtgagtccagtgacagtgaagtgcactcaggggtctcacacacacattcaggacacacttatggccaagccagatctcaacatggagagtcaggatctgccattcacgggagacagggaactatacatggacagacaggagataccactagacatggccagtctggtcatggacagtccacacagacaggttccaggacaactggaagacaaagatctagtcacagtgagtccagtgatagtgaagtgcactcagaggcctcacccacacattcaggacacactcacagccaagccggatctcgacatggacagtcaggatcctcaggtcatgggagacagggaactactcatggacagacaggagataccactagacatgcccactatggttatggacaatccacacagagagggtccaggacaactggaagaaggggatctggccacagtgagtccagtgacagtgaagtgcactcatggggctcacacacacattcaggacacattcagggccaagctggatctcaacaaagacagccaggatccacagttcatgggagactggaaactactcatggacagacaggagataccactagacatggccattctggttatggacaatccacacagacaggttccagatctagtagagcaagtcattttcagtcacatagtagtgaaaggcaaaggcatggatcaagtcaggtttggaaacatggcagctatggacctgcagaatatgactatgggcacactgggtatgggccttctggtggcagcagaaaaagcatcagtaattctcacctttcatggtcaacagacagcactgcaaacaagcaactgtctagacattgacagttattttctagttctgaccttatagtatccaaagcaactaaaagaacaggaagacacagtttaaatcatgaacagtcaatggtaagttatgaacattcagttgattctcagtatcagtctcgacctattattataagaagtcaggaatctagtcatggacattctatagtaactcataaacagtcaaacaacacctatgttcaacctggatataacacagccagaagggagggatgtacacatagccagtcaaatgaccaccttggatttggccatggacaatccatatcagttcatggccattcaaaatctagttcaatcagaaaacaggaatcccatactgataacaaaaagcattcagaagattgggagaaagacactcatgagcaattaggatctaggcatgggaagttagagttcaatacaataggtatacatggatctagccagcaacatttcggagatacaacttttcatgggcaggtaagatccagcacaggttttgccagataggtattaagtcatgggccatcaagagatgcctagggtcagtctggattcagtaccaatgaaagacaagtatacagccatggccaatcaaatgatagttatgagtagtcaaatgacagcaaaagtcaaagatacattttcagtcactttcttgacagccaagaccctgcaggaattgaagagtataggtatagatattcatcaagcagtgcaaccatatgcagtgggggagacaaaggcaagagtcagagtcaagtctgtcaggaggtatcagaatatacggtgaggatgtgggcaaaaaacaaagaggctctgaggccagcggttaccatacaaaggaaagaacaggctctggttccttctgcttagatagcaacaccccactctatgaatatgtccaagaacaaaggagttattactttgaataagaagccaacataaactagcccaagataagaactaacccagagaagaaatgagacacatacatgaaattaaggtatttaacatgatctcctcttttggtagtaagggtatatgtctgttctttcattttaactatagttctgtactatattacttttgtttggtgccaggtgtttttgtaaggctccacattcattgaactccttggttagaaaatagtgaatgaggccgggcgcggtggctcacgcctgtaatcccagcactttgggaggccaagatgggtggatcacgaagtcaggagttcgagaccagcctggccaacatagtgaaatcccgtctctactaaaaatacaaaaattagctgggtgcagtagcgggcacctgtaatcctagctactcaggaggctgaggcaggagaattggttgaacccgggaggcagaggttgcagtgagccgagatcgcaccactgcactccagcctgggtgactgagcaagactccaccttgaaaaaaagaaagaaagaaaatagtgaatggaagaaaaagataaacaccatttggggctatattcagaactatataataaagagagatttgtgtggttgggaataaaattaggttttaaaaaaatttccgaatttcaaaatttggattttccagattttgttttaattaattattgacaaatctatccaaggagctaaatgacgtggtttaggagccaaaacgtctctagaaacattataacacatcccatcctgaacaaagaatgttgtcatagtttcccacatgaatattcagaatatttgcatctttttgtgtcactactggaattctgtacaattatatttaaatttattgtcatggccttctggatataggatccagaaaattgtacttcataaaaattggcaataaacatttcatcaaaaaaaaaaaaaaaaaaaaaaaaaaaaaa

SEQ ID NO: 59775 - DNA, 1057 bp, Homo sapiens
gtctcagcggctgccaacagatcatgagccatcagctcctctggggccagctataggacaacagaactctcaccaaaggaccagacacagtgagcaccatgggacagtgtcggtcagccaacgcagaggatgctcaggaattcagtgatgtggagagggccattgagaccctcatcaagaactttcaccagtactccgtggagggtgggaaggagacgctgaccccttctgagctacgggacctggtcacccagcagctgccccatctcatgccgagcaactgtggcctggaagagaaaattgccaacctgggcagctgcaatgactctaaactggagttcaggagtttctgggagctgattggagaagcggccaagagtgtgaagctggagaggcctgtccgggggcactgagaactccctctggaattcttggggggtgttggggagagactgtgggcctggagataaaacttgtctcctctaccaccaccctgtaccctagcctgcacctgtcctcatctctgcaaagttcagcttccttccccaggtctctgtgcactctgtcttggatgctctggggagctcatgggtggaggagtctccaccagagggaggctcaggggactggttgggccagggatgaatatttgagggataaaaattgtgtaagagccaaagaattggtagtagggggagaacagagaggagctgggctatgggaaatgatttgaataatggagctgggaatatggctggatatctggtactaaaaaagggtctttaagaacctacttcctaatctcttccccaatccaaaccatagctgtctgtccagtgctctcttcctgcctccagctctgccccaggctcctcctagactctgtccctgggctagggcaggggaggagggagagcagggttgggggagaggctgaggagagtgtgacatgtggggagaggaccagctgggtgcttgggcattgacagaatgatggttgttttgtatcatttgattaataaaaaaaaatgaaaaaagtgaaaaaaaaaaaaaaaaa

SEQ ID NO: 59776 - DNA, 437 bp, Homo sapiens
gtccaaacacacacatctcactcatccttctactcgtgacgcttcccagctctggctttttgaaagcaaagatgagcaacactcaagctgagaggtccataataggcatgatcgacatgtttcacaaatacaccagacgtgatgacaagattgacaagccaagcctgctgacgatgatgaaggagaacttccccaacttccttagtgcctgtgacaaaaagggcacaaattacctcgccgacgtctttgagaaaaaggacaagaatgaggataagaagattgatttttctgagtttctgtccttgctgggagacatagccacagactaccacaagcagagccatggagcagcgccctgttccgggggcagccagtgacccagccccaccaatgggcctccagagacccaggaacaataaaatgtcttctcccaccag

SEQ ID NO: 59777 - DNA, 4351 bp, Homo sapiens
atctcactcatccttctactcgtgacacttcccagttctggctttttgaaagcaaagatgagcaacactcaagctgagaggtccataataggcatgatcgacatgtttcacaaatacaccggacgtgatggcaagattgagaagccaagcctgctgacgatgatgaaggagaacttccccaatttcctcagtgcctgtgacaaaaagggcatacattacctcgccactgtctttgagaaaaaggacaagaatgaggataagaagattgatttttctgagtttctgtccttgctgggagacatagccgcagactaccacaagcagagccatggagcggcgccctgttctgggggaagccagtgatccagccccaccaaggggcctccagagaccccaggaacaataagtgtctcctcccaccagacacttgccttatttcttcttctctttggtgacctacattgtcaaaactaccaattccaggttaactttgttggagaatttcccccacccccatccagtgggtcacccaggagtaatgtccctccagcaacgttccccctatggcctccagcagagctgatctgcctctcacacaggtcctggtgtctgcctctgcaccgttccctaaatgcagccaccttggcaggttccaggtggaagttggtagaaggcccctgccaggtcacagcaatgctctccttgtcaaggcatggaccagggtcattcagacacattcagatactgcactgagaaggagctggcatctctcagtgtgctcctgccctcccactcctgccccagctgttctccagggcttggggaaacagaaaccactcacatagggattcctggatggcttcaggttcagcgcccttggggctatgaatgggaggctcagcagtgccctgaggatgggcttccttgtcctgtggcctctgctccaggggcagtgtcctttccctgtgctgtgtgcttgtgtgcatgtgcctatgtgggtgaccctgtggaagtgagaaggagtcactgtgatgcttagctgtcctaaatgatggtttgctcaatgccaggactgggtttctggtgatgaatgaatattccagattttgaggagctctaagtggtccaggagtccaagtaagcagtctggctggaataaggcagcatcacggaaattctgtaaggactgacacagagagctcatgctgactgtgatgagaaattgcagcacctctatctcgcaggtaatggagtagtttgttattggtagtctactccaggccaggcagtgtgttatgggctgaggatgcagaaacaggcaggacacagtgctgtcctagcagtgcactggcgggtctctccatgcaggccacaacacagggtcagtgttcacctggtgtcacttccaggcaatgttctgtgcagccgctcttagtattcttccttgaggctcacatcatgtgtccctatcactcttactactctggtcagtctccagctaacctctcaatcaggcaaacattcttcttggaggaatcaggcaaacatctcaaaaattctctttccatcctaccagcagcagtgtgtaagatgggctatttgttctttggaatgactgctccactccacactcacacctctattcacagaccagcatctcctctccttatcaggaacattccttcctgaacatattctgcacctcgtcagccttcaggactgatctgccattttcacctctaaatccccatgtctgaccattagttttcttctctttccttctctccctttctcattctcattccacctgttcttggaactcacggagacctacagtccctgggctttcattttctcctcccagccccctgctgccttctctatgcagcctgccctccatcatccaccccagaattgctctctttcctctcttagctcctgccttctctatgcagcctgccctccatcatccaccccagaattgctctctttcctctcttagctctgttgcccactttccttgggccataccttccctgcagatctccagcccagaaccatcttcccctgttgtcctcctctctcctccaccgggactgctggtcactgcttagaaccgtcatgccagggtcccaaaagtgtgggtgcctgacttcctctctgtgcagcactctctgaatccctcctattcaccttgctgctgttattccccgaatgcgcaacataccccccatcaatatatctcagtatttcatgtctcaataccaatcttttaaactactgcctctaccagaaatgtcttttaatacttcttctgtctcattaacattacatttcaaggctgagctttaatgtcagtgtctcttagacattcagagggtgaaccaccatcccttcaccccaaagaaatgatctctgcttcatttgtgcctccctcaccatgaccccactcttaccatagtggctacattacttcagattcccctaatgtctttccagccagacttggaatcatggagggaaaacattgttacctcggatctcctggttacccagcacatagtagtactggattccagctcataataagtactctatatcatttttcaatataaaatgtatttgtgcaaattctagtcaatactactttatgtaaacagcagtgtaaaatccaaaaacttccagtcctggaggcaggttgtgcagcttaggggaggaccccagaatctggaccccagagtctggaagcaggccagaaaggataaggcaaatgactgaacagttccctcaggactcacgtactgatctcccaaaagaagagagggtctccctggggtggggttgctggaccttcaatccatcgctacagtccagaaggcaattggccactcctaatgtgggcctgccctccctttatttttccagttcttatttcacctgataatattccgtccaattggcaatggcacataaaaattaggatggagtgtgtggacaaatacttcttcatcttcttgtctaggttttagaaatcaccttctcaagggagccttgtctaatgttcctgagactatttcacactctccatgcttatgtcaatgcaggactcatcacatctattcggatattctgtttacacacccatgtcatcccagagaggtgatcacagggcagggacacatgtgtggcatacagttcctagttaagatcccaaatcctgagatattgctgatttgctatggcaggtcgtcaagagaactgtgtcattccaaactcaccaaggtggcttatagaacagaagcagatggatatgaagaggagaggggaccagaccatctccgcaaccacagcccagagctccagtcaccagatagaaaattgatttgatttcatccaatattccttcgaaagagtgtcaaggaatagggtggggcaatgtgtcattctgcattggaaggaggacattttagagcaaggcctaagggcacaggtattagtgtcatattgatcagaattcaacctttgttctaacacatactagagcaagaatttacttgatttggaataattaatagctactggacattatattggtactaaagagaaagaatacttgacagctctatgcccacactcacattacagctgatgtgaaagagattctggaaatccaaatgttccccagaaattctgatatcaaaacattccaataacttttttttttcaggcgcagtctcactctgtcgcccgggctggagtgctgtgagctgtccgtggtgctgaattcactgtgacgtcactcctgtctctctttgctttcttctgactgacatttattcagccttctctacaggaatctcttatgttcccccacatgcaggtggtttttcagtaggctcctgaagagtgatctcaactttccaggaagaaaagagggcaaagggaacaatgtgaaaagaagcagaaaatcataaaagaccatgtgtttgataaacaaccagattgtttctggttccctgccactataaaaacaccatgagagcatactcatacatgttcccttataaatctgcgaggtagtttctttggtattcttgcccaggaaatgggttgattcatcacagattttatatatatacttttttttaactaagtgtgagataatatcttattgtttttgtaacttgcattttacaagagttctgaccagcaccagataagcttcagtgctctcctttctttggccttaatattattggattaaagaattactgcctctcactaggagcatcatttatttaccattattttcaatttcatattaaaactcaatttctagtagagtcaaaaa

SEQ ID NO: 59778 - DNA, 957 bp, Homo sapiens
gggagagaggataaatagcagcgtggcttccctggctcctctctgcatccttcccgaccttcccagcaatatgcatcttgcacgtctggtcggctcctgctccctccttctgctactgggggccctgtctggatgggcggccagcgatgaccccattgagaaggtcattgaagggatcaaccgagggctgagcaatgcagagagagaggtgggcaaggccctggatggcatcaacagtggaatcacgcatgccggaagggaagtggagaaggttttcaacggacttagcaacatggggagccacaccggcaaggagttggacaaaggcgtccaggggctcaaccacggcatggacaaggttgcccatgagatcaaccatggtattggacaagcaggaaaggaagcagagaagcttggccatggggtcaacaacgctgctggacaggccgggaaggaagcagacaaagcggtccaagggttccacactggggtccaccaggctgggaaggaagcagagaaacttggccaaggggtcaaccatgctgctgaccaggctggaaaggaagtggagaagcttggccaaggtgcccaccatgctgctggccaggccgggaaggagctgcagaatgctcataatggggtcaaccaagccagcaaggaggccaaccagctgctgaatggcaaccatcaaagcggatcttccagccatcaaggaggggccacaaccacgccgttagcctctggggcctcagtcaacacgcctttcatcaaccttcccgccctgtggaggagcgtcgccaacatcatgccctaaactggcatccggccttgctgggagaataatgtcgccgttgtcacatcagctgacatgacctggaggggttgggggtgggggacaggtttctgaaatccctgaagggggttgtactgggatttgtgaataaacttgatacacca

SEQ ID NO: 59779 - DNA, 454 bp, Homo sapiens
ggagtccaaatcactcattgtttgtgaaagctgagctcacagcaaaacaagccaccatgaagctgtcggtgtgtctcctgctggtcacgctggccctctgctgctaccaggccaatgccgagttctgcccagctcttgtttctgagctgttagacttcttcttcattagtgaacctctgttcaagttaagtcttgccaaatttgatgcccctccggaagctgttgcagccaagttaggagtgaagagatgcacggatcagatgtcccttcagaaacgaagcctcattgcggaagtcctggtgaaaatattgaagaaatgtagtgtgtgacatgtaaaaactttcatcctggtttccactgtctttcaatgacaccctgatcttcactgcagaatgtaaaggtttcaacgtcttgctttaataaatcacttgctctccaaaaaaaaaaaaaaaaa

SEQ ID NO: 59780 - DNA, 2087 bp, Homo sapiens
ctcccaggtgcctggcagagagtcctcaccagccccctgccggatgtctggctggcatctgaggggactgaacatggcaagaagcaaaacagcagcacaagaaaccagtttcttcatctgaaaccgagcaggctctactccagaacagaacccacagtcccaggcgctgggccttcttcttaagttgggaaatcactcatccccaggagaaaaaaagagcaaaagcttccagtactggggatgtggggagaggttttttaaaaatatcagcccaatatatgggaaaatatgggatgcaggcatccccaggtgtcaagcgtccagatccgtagacacactgggacgatggtgatcagtatcactccctctgactcatcggccctacagagaagacaccatgctggtgcacagtcggtgccaaacccgcgtttgtaaatgaataagtgttgctgccctggtggaagcccagctcatgtggaggaagccagcttgcagagagagcaagaacagagccagcacacacattggagcaaaggcaagggcagatggaaagttctggcggcatcatgccaaggctcccatccgaggcctccctgaaccccactctctcggcgccaccttggatgctgcgggctggtacattccccacttgcaaaactctgtggggctgggttcctctcttttctttccaaatatcccaggaagtggatggttttatccaaattcagcagacgagtaaaaagagtcttcgggaggtgcaatagctttctaggaatgaggatattcttcaaggaaaatgaaccccacactaggcctggccatttttctggctgttctcctcacggtgaaaggtcttctaaagccgagcttctcaccaaggaattataaagctttgagcgaggtccaaggatggaagcaaaggatggcagccaaggagcttgcaaggcagaacatggacttaggctttaagctgctcaagaagctggccttttacaaccctggcaggaacatcttcctatcccccttgagcatctctacagctttctccatgctgtgcctgggtgcccaggacagcaccctggacgagatcaagcaggggttcaacttcagaaagatgccagaaaaagatcttcatgagggcttccattacatcatccacgagctgacccagaagacccaggacctcaaactgagcattgggaacacgctgttcattgaccagaggctgcagccacagcgtaagtttttggaagatgccaagaacttttacagtgccgaaaccatccttaccaactttcagaatttggaaatggctcagaagcagatcaatgactttatcagtcaaaaaacccatgggaaaattaacaacctgatcgagaatatagaccccggcactgtgatgcttcttgcaaattatattttctttcgagccaggtggaaacatgagtttgatccaaatgtaactaaagaggaagatttctttctggagaaaaacagttcagtcaaggtgcccatgatgttccgtagtggcatataccaagttggctatgacgataagctctcttgcaccatcctggaaataccctaccagaaaaatatcacagccatcttcatccttcctgatgagggcaagctgaagcacttggagaagggattgcaggtggacactttctccagatggaaaacattactgtcacgcagggtcgtagacgtgtctgtacccagactccacatgacgggcaccttcgacctgaagaagactctctcctacataggtgtctccaaaatctttgaggaacatggtgatctcaccaagatcgcccctcatcgcagcctgaaagtgggcgaggctgtgcacaaggctgagctgaagatggatgagaggggtacggaaggggccgctggcaccggagcacagactctgcccatggagacaccactcgtcgtcaagatagacaaaccctatctgctgctgatttacagcgagaaaataccttccgtgctcttcctgggaaagattgttaaccctattggaaaataaaggagaattcctgcttgccaaaaaaaaaaaaaaaaaaaaaaaaaaa

SEQ ID NO: 59781 - DNA, 3143 bp, Homo sapiens
ctataaattaaggatcccagctacttaattgacttatgcttcctagttcgttgcccagccaccaccgtctctccaaaaacccgaggtctcgctaaaatcatcatggattcacttggcgccgtcagcactcgacttgggtttgatcttttcaaagagctgaagaaaacaaatgatggcaacatcttcttttcccctgtgggcatcttgactgcaattggcatggtcctcctggggacccgaggagccaccgcttcccagttggaggaggtgtttcactctgaaaaagagacgaagagctcaagaataaaggctgaagaaaaagaggtgattgagaacacagaagcagtacatcaacaattccaaaagtttttgactgaaataagcaaactcactaatgattatgaactgaacataaccaacaggctgtttggagaaaaaacatacctcttccttcaaaaatacttagattatgttgaaaaatattatcatgcatctctggaacctgttgattttgtaaatgcagccgatgaaagtcgaaagaagattaattcctgggttgaaagcaaaacaaatgaaaaaatcaaggacttgttcccagatggctctattagtagctctaccaagctggtgctggtgaacatggtttattttaaagggcaatgggacagggagtttaagaaagaaaatactaaggaagagaaattttggatgaataagagcacaagtaaatctgtacagatgatgacacagagccattcctttagcttcactttcctggaggacttgcaggccaaaattctagggattccatataaaaacaacgacctaagcatgtttgtgcttctgcccaacgacatcgatggcctggagaagataatagataaaataagtcctgagaaattggtagagtggactagtccagggcatatggaagaaagaaaggtgaatctgcacttgccccggtttgaggtggaggacggttacgatctagaggcggtcctggctgccatggggatgggcgatgccttcagtgagcacaaagccgactactcgggaatgtcgtcaggctccgggttgtacgcccagaagttcctgcacagttcctttgtggcagtaactgaggaaggcaccgaggctgcagctgccaccggcataggctttactgtcacatccgccccaggtcatgaaaatgttcactgcaatcatcccttcctgttcttcatcaggcacaatgaatccaacagcatcctcttcttcggcagattttcttctccttaagatgatcgttgccatggcattgctgcttttagcaaaaaacaactaccagtgttactcatatgattatgaaaatcgtccattcttttaaatgttgtctcacttgcatttccagtcttggccatcaaatcaatgatttaatgactccaataatgtgtgtgtttataaccatcctcgaaagtgaaatgtccttttttttgtgccatgcgtaaggtgagtcaaaccaaacctcattgataatctcccctttggtttcctttgaaagtaaattggtatcttgtagttttgtgcacacgaaaggagagaaagtttctccagtaaagagtacgaactagtaattttggggggtctctctaattctggtattttgacatgttataatacgcaagtaaaataaaacaatagtttactcagctcatgttactattccccaacagatattgtggcaaatcacacataggaaagaggatttgggaatacagtagcaaaacataaattaaaactcaaatgcccaggacaaaataaaacaatataccagatggagaggatgcccgtattttcatcttccattctaacattatccattgttagatgcataagcattttgatattgtgtaataaatgtggtatttgagaagataaatgatgtagttgatcagtaatcctcctctatcacctttttagactttgtaaggtaaatatttggactaacttttagaaaagtttccctttttttctccatttacatttttctggtttttttttttttttttgagtgaggtacgagtattaccaaatgatattttctgaagatgctttttggaaagctctgaatctatacctaatgctcttaattattggcttgtttcatttttttcctccagtttttaacaagatcacataactggcttatttttaacagctttgtcaaactacaatttacatgccgtaaaatgtacacactgtaattttataattcattgacttttagtaaattttctagcgttatgcatcgccacaatccagttttagaatatttccatgaccctaagaagtttcctcatgtctattaatattcccaatcctaggcaccactgagttgttttctgtctttataagtttttctttctacatcttatataaatggaatcataatacatgtagtattttgtgtctggcgtcttgcacttagcatggtgttcttgaggttcatctgttgtagtatgtattgatacttaggatttttttattgccgaatactattccattgcatggaaaagacctattttatttctaggttcaccagttgagggacatttggattgttcccacttcttgggctgttaggaataatgttgctctgaacatgtaaataaagatctttgtgttcacatatgtttttcattttctgttggggagattccctaggctagaaattgctgggccatatgaaaaatcaatagttagctttgtaagaaacagtcaaactgttttcccaacgtgacattttatattcccaccaggaatgtttaaaactagtgtcttcaaatcctcaccaacatccaggattgtgtctttatgattatagccatttttgtaggtacaaagtggcatctcatggtggttttaatttgcatttccataatatctaattaggttgagctttttttatgtgcttattggccatttgtttgactttgtttggtgaaatgtatacaaatcatttgctcatttttaatttgggttgtctgtcttgtcttctcattttattgagttaaatgagttcttaataatctctggcttacaagtccttaatttatcaaatatatgatacgtggacatttcctcataaaaaaaaaaaaaaaaaa

SEQ ID NO: 59782 - DNA, 2249 bp, Homo sapiens
gtctacttatcaataagcagctgcctgtgcagagtgcaggctgcacctttggacagcctttaaaactgaattctcagaattttagaacaaatttttgtctagaaatgctgactttggttcattaggtagtggtaaaacaggctcccttcgaagctctccttcatcaccttcctaagtgcatgtacagggaagctctccttcatcaccttcctaagtgcatgggggaaaatacctagggctcaacagtcttgagaagtgtggaaacattttctttgtgagtgagaacagatcacctagagaaaggaaaccagattcccatcactgcttctgggtatcagatgctagcgctgcactccattttgcaatggcctcccttgctgcagcaaatgcagagttttgcttcaacctgttcagagagatggatgacaatcaaggaaatggaaatgtgttcttttcctctctgagcctcttcgctgccctggccctggtccgcttgggcgctcaagatgactccctctctcagattgataagttgcttcatgttaacactgcctcaggatatggaaactcttctaatagtcagtcagggctccagtctcaactgaaaagagttttttctgatataaatgcatcccacaaggattatgatctcagcattgtgaatgggctttttgctgaaaaagtgtatggctttcataaggactacattgagtgtgccgaaaaattatacgatgccaaagtggagcgagttgactttacgaatcatttagaagacactagacgtaatattaataagtgggttgaaaatgaaacacatggcaaaatcaagaacgtgattggtgaaggtggcataagctcatctgctgtaatggtgctggtgaatgctgtgtacttcaaaggcaagtggcaatcagccttcaccaagagcgaaaccataaattgccatttcaaatctcccaagtgctctgggaaggcagtcgccatgatgcatcaggaacggaagttcaatttgtctgttattgaggacccatcaatgaagattcttgagctcagatacaatggtggcataaacatgtacgttctgctgcctgagaatgacctctctgaaattgaaaacaaactgacctttcagaatctaatggaatggaccaatccaaggcgaatgacctctaagtatgttgaggtattttttcctcagttcaagatagagaagaattatgaaatgaaacaatatttgagagccctagggctgaaagatatctttgatgaatccaaagcagatctctctgggattgcttcggggggtcgtctgtatatatcaaggatgatgcacaaatcttacatagaggtcactgaggagggcaccgaggctactgctgccacaggaagtaatattgtagaaaagcaactccctcagtccacgctgtttagagctgaccacccattcctatttgttatcaggaaggatgacatcatcttattcagtggcaaagtttcttgcccttgaaaatccaattggtttctgttatagcagtccccacaacatcaaagraccaccacaagtcaatagatytgrgtttaattggaaaaatgtggtgtttcctttgagtttatttcttcctaacattggtcagcagatgacactggtgacttgacccttcctagacacctggttgattgtcctgatccctgctcttagcattctaccaccatgtgtctcacccatttctaatttcattgtctttcttcccacgctcatttctatcattctcccccatgacccgtctggaaattatggagrgtgctcaactggtaaggagaacgtagaagtagccctagggatcctttttgaaactctacagttatcgcagatattctagcttcattgtaagcaatctaggaaataagccctgctgctttctagaaataagtgtgaaggataaattttctttgttgacctatgaagattttagagtttaccttcatatgtttgattttaaatcagtgtataatctagatggtaaaaaatgtgaaattgggattagggacctaccaaaatatttcattaatgctttcaattgacaaattttggcctttctttgataagacaatatgtacatgttttttcaaatattaaagatcttttaactgttggcagttgttatctacagaatcatatttcatatgctgtgtagtttataagtttttcctctatttatcagaataaagaaatacaacatacctgtaaa

SEQ ID NO: 59783 - DNA, 537 bp, Homo sapiens
ctctcatcacttctgagcacggagcaatggcctctcgctgggctgtgcagctgctgctcgtggcagcctggagcatgggctgtggtgaggccctcaagtgctacacctgcaaggagcccatgaccagtgcttcctgcaggaccattacccgctgcaagccagaggacacagcctgcatgaccacgctggtgacggtggaggcagagtaccccttcaaccagagccccgtggtgacccgctcctgctccagctcctgtgtggccaccgaccccgacagcatcggggccgcccacctgatcttctgctgcttccgagacctctgcaactcggaactctgaacccagggcggcagggcggaaggtgctcctcaggcacctcctctctgacggggcctggctccacctgtgatcacctccccctgcttcctgctgctgtggcacagctcactcatggggtctgaggggagagaagcacaccaggggcgccctctgccttccataccccacgcttataaaacataactaagccaagagtgga

SEQ ID NO: 59784 - DNA, 3610 bp, Homo sapiens
atgcatggagtggacctgtaggcgacttgcatcgtcttcaacatgaagatagccacagtgtcagtgcttctgcccttggctctttgcctcatacaagatgctgccagtaagaatgaagatcaggaaatgtgccatgaatttcaggcatttatgaaaaatggaaaactgttctgtccccaggataagaaattttttcaaagtcttgatggaataatgttcatcaataaatgtgccacgtgcaaaatgatactggaaaaagaagcaaaatcacagaagagggccaggcatttagcaagagctcccaaggctactgccccaacagagctgaattgtgatgattttaaaaaaggagaaagagatggggattttatctgtcctgattattatgaagctgtttgtggcacagatgggaaaacatatgacaacagatgtgcactgtgtgctgagaatgcgaaaaccgggtcccaaattggtgtaaaaagtgaaggggaatgtaagagcagtaatccagagcaggatgtatgcagtgcttttcggccctttgttagagatggaagacttggatgcacaagggaaaatgatcctgttcttggtcctgatgggaagacgcatggcaataagtgtgcaatgtgtgctgagctgtttttaaaagaagctgaaaatgccaagcgagagggtgaaactagaattcgacgaaatgctgaaaaggatttttgcaaggaatatgaaaaacaagtgagaaatggaaggcttttttgtacacgggagagtgatccagtccgtggccctgacggcaggatgcatggcaacaaatgtgccctgtgtgctgaaattttcaagcagcgtttttcagaggaaaacagtaaaacagatcaaaatttgggaaaagctgaagaaaaaactaaagttaaaagagaaattgtgaaactctgcagtcaatatcaaaatcaggcaaagaatggaatacttttctgtaccagagaaaatgaccctattcgtggtccagatgggaaaatgcatggcaacttgtgttccatgtgtcaagcctacttccaagcagaaaatgaagaaaagaaaaaggctgaagcacgagctagaaacaaaagagaatctggaaaagcaacctcatatgcagagctttgcagtgaatatcgaaagcttgtgaggaacggaaaacttgcttgcaccagagagaacgatcctatccagggcccagatgggaaagtgcatggcaacacctgctccatgtgtgaggtcttcttccaagcagaagaagaagaaaagaaaaagaaggaaggtaaatcaagaaacaaaagacaatctaagagtacagcttcctttgaggagttgtgtagtgaataccgcaaatccaggaaaaacggacggcttttttgcaccagagagaatgaccccatccagggcccagatggaaaaatgcatggcaacacctgctccatgtgtgaggccttctttcaacaagaagaaagagcaagagcaaaggctaaaagagaagctgcaaaggaaatctgcagtgaatttcgggaccaagtgaggaatggaacacttatatgcaccagggagcataatcctgtccgtggcccagatggcaaaatgcatggaaacaagtgtgccatgtgtgccagtgtgttcaaacttgaagaagaagagaagaaaaatgataaagaagaaaaagggaaagtcgaggctgaaaaagttaagagagaagcagttcaggagctgtgcagtgaatatcgtcattatgtgaggaatggacgactcccctgtaccagagagaatgatcctattgagggtctagatgggaaaatccacggcaacacctgctccatgtgtgaagccttcttccagcaagaagcaaaagaaaaagaaagagctgaacccagagcaaaagtcaaaagagaagctgaaaaggagacatgcgatgaatttcggagacttttgcaaaatggaaaacttttctgcacaagagaaaatgatcctgtgcgtggcccagatggcaagacccatggcaacaagtgtgccatgtgtaaggcagtcttccagaaagaaaatgaggaaagaaagaggaaagaagaggaagatcagagaaatgctgcaggacatggttccagtggtggtggaggaggaaacactcaggacgaatgtgctgagtatcgggaacaaatgaaaaatggaagactcagctgtactcgggagagtgatcctgtacgtgatgctgatggcaaatcgtacaacaatcagtgtaccatgtgtaaagcaaaattggaaagagaagcagagagaaaaaatgagtattctcgctccagatcaaatgggactggatcagaatcagggaaggatacatgtgatgagtttagaagccaaatgaaaaatggaaaactcatctgcactcgagaaagtgaccctgtccggggtccagatggcaagacacatggcaataagtgtactatgtgtaaggaaaaactggaaagggaagcagctgaaaaaaaaaagaaagaggatgaagacaggagcaatacaggagaaaggagcaatacaggagaaaggagcaatgacaaagaggatctgtgtcgtgaatttcgaagcatgcagagaaatggaaagcttatctgcaccagagaaaataaccctgttcgaggcccatatggcaagatgcacatcaataaatgtgctatgtgtcagagcatctttgatcgagaagctaatgaaagaaaaaagaaagatgaagagaaatcaagtagcaagccctcaaataatgcaaaggatgagtgcagtgaatttcgaaactatataaggaacaatgaactcatctgccctagagagaatgacccagtgcacggtgctgatggaaagttctatacaaacaagtgctacatgtgcagagctgtctttctaacagaagctttggaaagggcaaagcttcaagaaaagccatcccatgttagagcttctcaagaggaagacagcccagactctttcagttctctggattctgagatgtgcaaagactaccgagtattgcccaggataggttatctttgtccaaaggatttaaagcctgtctgtggtgacgatggccaaacctacaacaatccttgcatgctctgtcatgaaaacctgatacgccaaacaaatacacacatccgcagtacagggaagtgtgaggagagcagcaccccaggaaccaccgcagccagcatgcccccgtctgacgaatgacaggaagattgttgaaagccatgagggaaaaaataaaccccagttctgaatcacctaccttcaccatctgtatatacaaagaattcttcggagcttgtcttatttgctatagaaaacaatacagagcttttgggaatggactcactgattttcagtcttttccatctctttcctcctagactctgtgatctgagggtataaagacatctccaccaagtctgagccctcaaaatgtcctgattacaatgctgtctgtccaactgcctgttcaataaaagtaaactcagcagaacaccctttctgggatttctttgtcactatctggataatagatatttgcttttaaagaaactgaataaactctacccttttg

SEQ ID NO: 59785 - DNA, 690 bp, Homo sapiens
ggaaaatgtaggctaccagtagaaaatgacattctctattaataagatctgaggtgcgacacacataattgtcccaatttttaagattgatggggagcatgaagcatttttttaatgtgttggcaggccccattaaatgcataaactgcataggactcatgtggtctgaatgtattttagggctttctgggaattgtcttgacagagaacctcagctggacaaagcagccttgatctgagtgagctaactgacacaatgaaactgtcaggcatgtttctgctcctctctctggctcttttctgctttttaacaggtgtcttcagtcagggaggacaggttgactgtggtgagttccaggaccccaaggtctactgcactcgggaatctaacccacactgtggctctgatggccagacatatggcaataaatgtgccttctgtaaggccatagtgaaaagtggtggaaagattagcctaaagcatcctggaaaatgctgagttaaagccaatgtttcttggtgacttgccagcttttgcagccttcttttctcacttctgcttatacttttgctggtggattcctttaattcataaagacatacctactctgcctgggtcttgaggagttcaatgtatgtctatttctcttgattcacttgtcaataaagtacattctgcaaaagcaaaaa

SEQ ID NO: 59786 - DNA, 566 bp, Homo sapiens
tcgatgcagctgtagtgacaatctcagagcagcttctacaccacagccatttccagcatgaagatcactgggggtctccttctgctctgtacagtggtctatttctgtagcagctcagaagctgctagtctgtctccaaaaaaagtggactgcagcatttacaagaagtatccagtggtggccatcccctgccccatcacatacctaccagtttgtggttctgactacatcacctatgggaatgaatgtcacttgtgtaccgagagcttgaaaagtaatggaagagttcagtttcttcacgatggaagttgctaaattctccatggacatagagagaaaggaatgatattctcatcatcatcttcatcatcccaggctctgactgagtttctttcagttttactgatgttctgggtgggggacagagccagattcagagtaatcttgactgaatggagaaagtttctgtgctacccctacaaacccatgcctcactgacagaccagcattttttttttaacacgtcaataaaaaaataatctcccagaaaaaaaaaaaaaaaaaaa

SEQ ID NO: 59787 - DNA, 662 bp, Homo sapiens
actcctggtactctagcaccgatctgctttggagaaactggttaattctgagactccagcaggatgtcttatcaacagcagcagtgcaagcagccctgccagccacctcctgtgtgccccacgccaaagtgcccagagccatgtccacccccgaagtgccctgagccctgcccaccaccaaagtgtccacagccctgcccacctcagcagtgccagcagaaatatcctcctgtgacaccttccccaccctgccagccaaagtatccaccgaagagcaagtaacagcttcaggattcatcaggagcatgagaggataaggataattggctcacctcgttccacagctccaccttcatcttctcatcaaagcttatcatggattcatagggagcttctttccccttagcctgtgatctgcccatgatgttccctgatagcaaaaggtttcctttctaaggctgccatactgccactgtccaggtggagactgagcaaaggaaccttggctttgtcagttcccagagcttcagcagaaagagctgcagctgtgtgcctgggaaccatcagagaattctgttgatgtgttctgtgtctgtctttcacctgggcatgagcttctaccacctgtgcaattgtcacttttctttcactccctgaataaa

SEQ ID NO: 59788 - DNA, 790 bp, Homo sapiens
ctgtagtacacatccttgatggcaccaagtagcaaacgtgctgtggagactagatctcactctcaaatctgtcctgggatgcaagtgcctctacgaatgtggtgcagaagctacaaatgtggtgcagaagacagcttcaaagaggaaaggaatatagatcctgagactccagcaggatgtcttatcaacagcagcagtgcaagcagccctgccagccacctcctgtgtgccccacgccaaagtgcccagagccatgtccacccccgaagtgccctgagccctgcccatcaccaaagtgtccacagccctgcccacctcagcagtgccagcagaaatatcctcctgtgacaccttccccaccctgccagccaaagtgtccacccaagagcaagtaacagcttcaggattcatcaggagcatgagaggataaggataattggctcacctcgttccacagctccacttgcatcttctcaccaaagccttccatggatgcacagggagcttctttctccttaacctgtggcctgcctgtgatgatctgtgacagcaaaagattccctttctgaggctgccatactgccactgtccaggtggagctaagaaaaggaagtcctcagctgtgccagctcccagagcttcggaagaaagagcagcagctctctccctgggaaccatcagacaattctgttgatgtgttctgtgtctgtctgtcacctggtcatgagcttctaccacctttgcaattgtcatttatctttcactccctgaataaagtatctatgcatat

SEQ ID NO: 59789 - DNA, 762 bp, Homo sapiens
aaactcctggtacttgagcactgatctgctttggagaacctgattctgagactccagcaggatgtcttatcaacagcagcagtgcaagcagccctgccagccacctcctgtgtgccccacgccaaagtgcccagagccatgtccacccccgaagtgccctgagccctgcccaccaccaaagtgtccacagccctgcccacctcagcagtgccagcaaaaatgtcctcctgtgacaccttccccaccctgccagccaaagtgtccacccaagagcaagtaacagcttcagaattcatcaggagcatgaaaggataaggataattggctcaccttgttccacagcttcacctgcatcttctcatcaaagcctaccatggatacacagttagcttctttcctcttagccagtgatctgcccatgatgatccctgatagcaaaaggtttcctttctgaggctgccatattgccactgtccaggtggagactgagaaaggaagtcctcagcagtgtcagttcccagagctttggaagaaggaccagcagctctgtccctgggaaccatcaaaaaatgctgttgatgttttctgtgtctgtctgtcacctgggcatgggcttctaacacctgtgcaattgtcacttttctttcactccctgaataaaatatctttgcatacgtaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 59790 - DNA, 580 bp, Homo sapiens
gaagactctgattctctgagactgaggagagatgtcttaccagcagcagcagtgcaagcagccctgccagccacctcctgtgtgccccacgccaaagtgcccagagccatgtccacccccgaagtgccctgagccttacctgcctcctccttgtccacctgagcattgcccacctccaccatgccaggataaatgccctcctgtgcaaccatacccaccctgccagcagaagtatccacccaagagcaagtaacatcactagaattcatcaggaccatgaaacaacaagatccagtggctcttcttactcccaggactccatcatcttcccttcagctgtagtgggaggctgcatcttccctaacctctgtctggcttgagcgttgacagagaaaaggcttagttctgaaaaccgatatgttgttggaagatgagcagccagatcactgcctaatctcgctttgctgtctgtgatgtagatggtggttcctatcctgagagcaagtgtgtttattcttttgcttctccccaataaagcacatgtttcatggtcaagcccaaaaaaaaaaaaaaaaaaaaa

SEQ ID NO: 59791 - DNA, 766 bp, Homo sapiens
aagggctcagcctcctctcctggggtccagcttgtcgcctctggctcacctgttcctagagcaatgtcttcccagcagcagcagcggcagcagcagcagtgcccaccccagagggcccagcagcagcaagtgaagcagccttgtcagccaccccctgttaaatgtcaagagacatgtgcacccaaaaccaaggatccatgtgctccccaggtcaagaagcaatgcccaccgaaaggcaccatcattccagcccagcagaagtgtccctcagcccagcaagcctccaagagtaaacagaagtaaggatggactggatattaccatcatccaccatcctggctaccagatggaaccttctcttcttccttctcctcttccctccagctcttgagcctaccctcctctcacatctcctcctgcccaagatgtaaggaagcattgtaaggatttcttcccatcgtacccttccccacacataccaccttggcttcttctatatcccaccccgatgctctcccaggtgggtgtgagagagacctcattctctgcaggctccagcgtggccacagctaaggcccatccatttcccaaagtgaggaaagtgtctgggcttcttctggggttccaccctgacaagtagggtcacagaggctggtgcacagtttctgcctcattcctctccatgatgccccctgctctgggcttctctcctgttttccccaataaatatgtgcctcatgtaataaatgtgtctgcttcctgggct

SEQ ID NO: 59792 - DNA, 6894 bp, Homo sapiens
atgtctccacttctgagaagcatctgtgacatcactgaaattttcaatcagtatgtctctcatgattgtgatggagcagcattaactaagaaagacctgaagaacctccttgaaagggaatttggagctgtgcttcggagaccacatgaccctaagacggtagatctgatcctggaacttctggatcttgacagtaatgggcgtgtcgatttcaacgaattcctcctatttattttcaaagtggctcaagcttgttactatgctctcggccaggccacgggactggatgaggagaagcgagcccggtgtgacggaaaggagagcctgttacaagatcgcaggcaagaagaagaccaaaggagattcgagccccgggacagacaactggaagaagaacctgggcaacgacgcaggcagaagaggcaggaacaggagagggagctagctgagggagaggagcaaagtgagaaacaagagcgacttgaacagcgcgacaggcagcgccgcgacgaggagctgtggcggcaaaggcaagaatggcaagaacgggaagagcgccgtgcagaggaagagcagctgcagagttgcaaaggtcacgaaactgaggagtttccagacgaagagcaactgcgaaggcgggagctgctggagctgaggaggaagggccgcgaggagaaacagcagcaaaggcgagagcggcaagacagagtgttccaggaggaagaagagaaagagtggaggaagcgcgagacagtgctccggaaggaagaagagaagttgcaggaagaggagccgcagcggcaaagagagctccaggaggaagaagagcagctacggaagctggagcggcaagagctgaggagggagcgccaggaggaagagcagcagcagcaaaggctgaggcgcgagcagcaactaaggcgcaagcaggaggaggagaggcgcgagcagcaggaggagaggcgcgagcagcaggagaggcgcgagcagcaggaggagaggcgcgagcagcagctgaggcgcgagcaggaggagaggcgcgagcagcagctgaggcgcgagcaggaggaggagaggcgcgagcagcagctgaggcgcgagcaggaggaggagaggcgcgagcagcagctgaggcgcgagcagcagctgaggcgcgagcagcagctgaggcgcgagcagcagctgaggcgcgagcagcagctgaggcgcgagcagcagctgaggcgcgagcagcagctgaggcgcgagcagcagctgaggcgcgagcagcagctgaggcgcgagcaggaggaggagaggcacgagcagaagcacgagcaggagaggcgcgagcagcggctgaagcgcgagcaggaggagaggcgcgattggctgaagcgcgaggaggagacggagaggcacgagcaggagaggcgcaagcagcagctgaagcgcgaccaggaggaggagaggcgcgaacgttggctgaagctcgaggaggaggagaggcgcgagcagcaggagaggcgcgagcagcaactaaggcgggagcaagaggagaggcgcgagcagcggctgaagcgccaggaggaggaagagaggctccagcagcggttgaggagcgagcaacaactaagacgcgagcaggaggagaggcgcgagcagctgctgaagcgcgaggaggagaagaggctcgagcaggagaggcgagagcagcggctgaagcgcgagcaggaggagaggcgcgatcagctgctgaagcgcgaggaggagaggcgccagcagcggctgaagcgcgagcaggaagagaggctcgagcagcgactgaagcgcgaggaggtggagagactcgagcaggaggagaggcgcgagcagcggctgaagcgcgaggagccggaggaagagaggcgccagcagctgctgaagagcgaggagcaggaggagaggcgccagcagcaactaaggcgcgagcagcaggaaaggcgcgagcagcggctgaagcgcgaggaggaggaagagaggctcgagcagcggctgaagcgcgagcatgaggaagagaggcgcgagcaggagctagctgaggaggagcaggaacaggcccgggagcggattaagagccgcatcccgaagtggcagtggcagctagaaagcgaggccgacgcacggcaaagcaaagtctactcgaggccccgcaagcaggaagggcagaggcgccgccaagagcaggaggaaaagaggcggcgccgggagagtgagctgcaatggcaggaggaggaacgggctcaccggcagcagcaggaagaggagcagcgccgggacttcacatggcagtggcaggcggaggaaaagagcgagaggggccgtcagaggctgtcggccaggcccccattgcgggagcagcgggagaggcagctgagggccgaggagcgccagcagcgggaacaacggtttctcccggaggaggaggagaaggagcagcggcgccgccagcgacgcgagagggagaaagagctgcagttcctggaggaagaggagcagctccagcggcgggagcgtgcccaacagctccaggaggaggaggacggcctccaggaggatcaggagaggaggcgaagccaggagcagcgccgcgaccaaaaatggaggtggcaactagaagaagaaaggaagagacgccgccacacgctgtacgccaagccagccctacaagagcagctgaggaaggaacagcagctgctgcaggaggaggaggaggagctacagagagaggagcgcgagaagagaaggcgccaagaacaggagagacaataccgcgaggaagagcagctgcagcaggaggaagagcagctgctgagagaggaacgggagaaaagaagacgccaggagcgggaaaggcaatatcggaaggataagaagctgcagcagaaggaagagcagctgctgggagaggaaccggagaagagaaggcgccaggagcgggagaaaaaataccgcgaggaagaggagttgcagcaggaggaagagcagctgctgagagaggaacgggagaagagaaggcgccaggagtgggagaggcagtaccgcaaaaaagacgagctgcagcaggaagaagagcagctgctgagagaggaacgggagaaaagaagactccaggagcgggagaggcaatatcgggaggaagaggagctgcagcaggaggaagagcagctgctgggagaggaacgggagacgagaaggcgccaggagctggagaggcaatatcggaaggaagaggagctgcagcaggaggaagagcagctgctgagagaggaaccggagaagagaaggcgccaggagcgggagaggcaatgtcgggaggaagaggagctgcagcaggaggaagagcagctgctgagagaggaacgggagaagagaaggcgccaggagctggagaggcaatatcgggaggaagaggaggtgcagcaggaggaagagcagctgctgagagaggaaccggagaagagaaggcgccaggagctggagaggcaataccgcgaggaagaggagctgcagcaggaggaagagcagctgctgagagaggaacaggagaaaaggcgccaggagcgggagaggcagtatcgggaggaggaagagcttcagcgccagaaaaggaagcagcgataccgggatgaggatcagcgcagtgatctgaaatggcagtgggaaccagaaaaagaaaatgcagttcgtgataacaaggtttactgcaaaggcagagagaatgaacagttccggcagttggaagattcccagctgcgcgacagacaatcccagcaagatctgcagcacctgctgggtgaacagcaagagcgagatcgtgagcaagagaggaggcgctggcagcagcgcgacaggcatttcccagaggaagaacagctggagcgagaagagcaaaaggaagccaaaaggcgcgacaggaagtcccaagaggaaaagcagttgctgagagaggaaagagaagagaagagacgccgtcaagagacagacagaaaattccgcgaggaggaacagctgctccaggaaagggaggaacagccgctgcgccgccaagagcgtgacagaaaattccgcgaagaggaactgcgccatcaggaacaagggagaaaattcctcgaggaggaacagcggctgcgccgccaggaacgggagagaaaattccttaaggaggaacagcagctgcgctgccaggagcgcgagcaacagctgcgtcaggaccgcgacagaaaattccgcgaggaggaacagcagctgagccgccaagagcgtgacagaaaattccgtgaagaggaacagcaggtgcgccgccaggaacgagagagaaaattcctggaggaggaacagcagctgcgccaggagcgtcacagaaaattccgcgaagaggaacagctgctccaggaaagggaagaacagcagctgcaccgccaagagcgtgacagaaaattcctggaggaggaacaacagctgcgccgccaagagcgtgacagaaaattccgcgaacaggaactgcgcagtcaggaaccagagagaaaattcctcgaggaggaacagcagctgcaccgccagcaacggcagagaaaattcctccaggaggaacagcagctgcgccgccaggagcgcgggcaacagcggcgtcaggaccgtgacagaaaattccgcgaggaggaacagctgcgccaggagagggaggaacagcagctgagccgccaagagcgtgacagaaaattccgtttagaggaacagaaagtgcgccgccaggaacaagagagaaaattcatggaggacgaacagcagctgcgccgccaggagggccaacaacagctgcgccaggagcgcgacagaaaattccgcgaagacgaacagctgctccaggaaagggaagaacagcagctgcaccgccaagagcgtgacagaaaattcctcgaggaggaaccgcagctgcgccgccaggagcgcgaacaacagctgcgtcacgaccgcgacagaaaattccgtgaagaggaacagctgctccaggaaggggaggaacagcagctgcgccgccaagagcgtgacagaaaattccgcgaagaggaacagcagctccgccgtcaggaacgagagagaaaattcctccaggaggaacagcagctgcgccgccaggaactggagagaaaattccgtgaggaggaacagctgcgccaagaaacggagcaagagcagctgcgccgccaagaacgctacagaaaaatcctagaggaagagcagctccgtccggaaagggaagaacagcagctgcgccgccaggagcgcgacagaaaattccgcgaggaggaacagctccgccaggagagggaggaacagcagctgcgcagccaagagtctgacagaaaattccgcgaggaggaacagctacgccaggagagggaagaacagcagctgcgcccccaacagcgtgacggaaagtatcgctgggaagaagagcagctccaacttgaggaacaagagcagaggctgcggcaggagcgagaccggcagtaccgggcggaggagcagtttgccacgcaggagaagagtcgtcgtgaggaacaagaactatggcaagaagaggagcagaaacgtcgccaggaacgggaaaggaaattacgggaagaacacatccgccgccagcagaaggaggaacagaggcaccgccaagtcggggagataaaatcccaagaagggaagggccatgggcggcttctggagcccggcactcatcagtttgccagtgtcccagtgcgctccagccctctctatgagtacatccaagagcagagatctcaataccgcccttaagtgatgttgccaatatcttgacacctgccaaagcttcgagcacgggaaaatgagaaacactgggtaccaagtgataactcagatgtttctggttgtgggaaaactctctgatattagaatgtcttttcttccaaaatcttaaactacgctcattttacgcactttgtacttctgctttttattcttcctcaagtagttctttactgcaagatgtctttcttttgctctttgatgcagatgtggtgtgcatttaaaaaaaatataaatcatttaatttgtttaagaaattttgtttgaggaacatgttcatttattgctttcagaagtaacaagagtaataggatgatttgagattctaaacaatgggtcggtttgtttaatgactgacccatcttgtggaaagtgcagatacttttaatgttcaagttgctatttcttcttgaacctaaattgatcattgcctccaaacagcatttcatcttttgtggcatagttagcacaaattccaggtaactaaatttttataacccttgaatagtgcagggggagtgacctctgcataaaaacttcctgtaaaatcagcccattactggaagaaatatctgttaagaataggtttagctttgaagatttagaatttaaattagattttttttaaactcaactccacttaaacacataatctcatgaagaaataatgaggtgtttctcaacttcagagttcaaattttaaaactgtgtctgttgtagtctatagtgttcattctacttccccaagttttgatgagtttcagaatattatgaacctttgttaattttagcttgttagaaggaagctgctcagaatcccataaacatctgtcttactctagggccaataagagatcacatagagcatgttgggggtgtaaaagggaaaaatgtgtgaacataggggcaaatttctagaggccctttgacaagacccatttgcccacaatcatttgaggcctattgataataccttagatatattcttgttgaaataattggactgtgaaaaattaataataaatgtttggc

SEQ ID NO: 59793 - DNA, 6911 bp, Homo sapiens
atgtctccacttctgagaagcatctgtgacatcactgaaattttcaatcagtatgtctctcatgattgtgatggagcagcattaactaagaaagacctgaagaacctccttgaaagggaatttggagctgtgcttcggagaccacatgaccctaagacggtagatctgatcctggaacttctggatcgtgacagtaatgggcgtgtcgatttcaacgaattcctcctatttattttcaaagtggctcaagcttgttactatgctctcggccaggccacgggactggatgaggagaagcgagcccggtgtgacggaaaggagagcctgttacaagatcgcaggcaagaagaagaccaaaggagattcgagccccgggacagacaactggaagaagaacctgggcaacgacgcaggcagaagaggcaggaacaggagagggagctagctgagggagaggagcaaagtgagaaacaagagcgacttgaacagcgcgacaggcagcgccgcgacgaggagctgtggcggcaaaggcaagaatggcaagaacgggaagagcgccgtgcagaggaagagcagctgcagagttgcaaaggtcacgaaactgaggagtttccagacgaagagcaactgcgaaggcgggagctgctggagctgaggaggaagggccgcgaggagaaacagcagcaaaggcgagagcggcaagacagagtgttccaggaggaagaagagaaagagtggaggaagcgcgagacagtgctccggaaggaagaagagaagttgcaggaagaggagccgcagcggcaaagagagctccaggaggaagaagagcagctacggaagctggagcggcaagagctgaggagggagcgccaggaggaagagcagcagcagcaaaggctgaggcgcgagcagcaactaaggcgcaagcaggaggaggagaggcgcgagcagcaggaggagaggcgcgagcagcaggagaggcgcgagcagcaggaggagaggcgcgagcagcagctgaggcgcgagcaggaggagaggcgcgagcagcagctgaggcgcgagcaggaggaggagaggcgcgagcagcagctgaggcgcgagcaggaggaggagaggcgcgagcagcagctgaggcgcgagcagcagctgaggcgcgagcagcagctgaggcgcgagcagcagctgaggcgcgagcagcagctgaggcgcgagcagcagctgaggcgcgagcagcagctgaggcgcgagcagcagctgaggcgcgagcagcagctgaggcgcgagcagcagctgaggcgcgagcaggaggaggagaggcacgagcagaagcacgagcaggagaggcgcgagcagcggctgaagcgcgagcaggaggagaggcgcgattggctgaagcgcgaggaggagacggagaggcacgagcaggagaggcgcaagcagcagctgaagcgcgaccaggaggaggagaggcgcgaacgttggctgaagctcgaggaggaggagaggcgcgagcagcaggagaggcgcgagcagcaactaaggcgggagcaagaggagaggcgcgagcagcggctgaagcgccaggaggaggaagagaggctccagcagcggttgaggagcgagcaacaactaagacgcgagcaggaggagaggcgcgagcagctgctgaagcgcgaggaggagaagaggctcgagcaggagaggcgagagcagcggctgaagcgcgagcaggaggagaggcgcgatcagctgctgaagcgcgaggaggagaggcgccagcagcggctgaagcgcgagcaggaagagaggctcgagcagcgactgaagcgcgaggaggtggagagactcgagcaggaggagaggcgcgagcagcggctgaagcgcgaggagccggaggaagagaggcgccagcagctgctgaagagcgaggagcaggaggagaggcgccagcagcaactaaggcgcgagcagcaggaaaggcgcgagcagcggctgaagcgcgaggaggaggaagagaggctcgagcagcggctgaagcgcgagcatgaggaagagaggcgcgagcaggagctagctgaggaggagcaggaacaggcccgggagcggattaagagccgcatcccgaagtggcagtggcagctagaaagcgaggccgacgcacggcaaagcaaagtctactcgaggccccgcaagcaggaagggcagaggcgccgccaagagcaggaggaaaagaggcggcgccgggagagtgagctgcaatggcaggaggaggaacgggctcaccggcagcagcaggaagaggagcagcgccgggacttcacatggcagtggcaggcggaggaaaagagcgagaggggccgtcagaggctgtcggccaggcccccattgcgggagcagcgggagaggcagctgagggccgaggagcgccagcagcgggaacaacggtttctcccggaggaggaggagaaggagcagcggcgccgccagcgacgcgagagggagaaagagctgcagttcctggaggaagaggagcagctccagcggcgggagcgtgcccaacagctccaggaggaggaggacggcctccaggaggatcaggagaggaggcgaagccaggagcagcgccgcgaccaaaaatggaggtggcaactagaagaagaaaggaagagacgccgccacacgctgtacgccaagccagccctacaagagcagctgaggaaggaacagcagctgctgcaggaggaggaggaggagctacagagagaggagcgcgagaagagaaggcgccaagaacaggagagacaataccgcgaggaagagcagctgcagcaggaggaagagcagctgctgagagaggaacgggagaaaagaagacgccaggagcgggaaaggcaatatcggaaggataagaagctgcagcagaaggaagagcagctgctgggagaggaaccggagaagagaaggcgccaggagcgggagaaaaaataccgcgaggaagaggagttgcagcaggaggaagagcagctgctgagagaggaacgggagaagagaaggcgccaggagtgggagaggcagtaccgcaaaaaagacgagctgcagcaggaagaagagcagctgctgagagaggaacgggagaaaagaagactccaggagcgggagaggcaatatcgggaggaagaggagctgcagcaggaggaagagcagctgctgggagaggaacgggagacgagaaggcgccaggagctggagaggcaatatcggaaggaagaggagctgcagcaggaggaagagcagctgctgagagaggaaccggagaagagaaggcgccaggagcgggagaggcaatgtcgggaggaagaggagctgcagcaggaggaagagcagctgctgagagaggaacgggagaagagaaggcgccaggagctggagaggcaatatcgggaggaagaggaggtgcagcaggaggaagagcagctgctgagagaggaaccggagaagagaaggcgccaggagctggagaggcaataccgcgaggaagaggagctgcagcaggaggaagagcagctgctgagagaggaacaggagaaaaggcgccaggagcgggagaggcagtatcgggaggaggaagagcttcagcgccagaaaaggaagcagcgataccgggatgaggatcagcgcagtgatctgaaatggcagtgggaaccagaaaaagaaaatgcagttcgtgataacaaggtttactgcaaaggcagagagaatgaacagttccggcagttggaagattcccagctgcgcgacagacaatcccagcaagatctgcagcacctgctgggtgaacagcaagagcgagatcgtgagcaagagaggaggcgctggcagcagcgcgacaggcatttcccagaggaagaacagctggagcgagaagagcaaaaggaagccaaaaggcgcgacaggaagtcccaagaggaaaagcagttgctgagagaggaaagagaagagaagagacgccgtcaagagacagacagaaaattccgcgaggaggaacagctgctccaggaaagggaggaacagccgctgcgccgccaagagcgtgacagaaaattccgcgaagaggaactgcgccatcaggaacaagggagaaaattcctcgaggaggaacagcggctgcgccgccaggaacgggagagaaaattccttaaggaggaacagcagctgcgctgccaggagcgcgagcaacagctgcgtcaggaccgcgacagaaaattccgcgaggaggaacagcagctgagccgccaagagcgtgacagaaaattccgtgaagaggaacagcaggtgcgccgccaggaacgagagagaaaattcctggaggaggaacagcagctgcgccaggagcgtcacagaaaattccgcgaagaggaacagctgctccaggaaagggaagaacagcagctgcaccgccaagagcgtgacagaaaattcctggaggaggaacaacagctgcgccgccaagagcgtgacagaaaattccgcgaacaggaactgcgcagtcaggaaccagagagaaaattcctcgaggaggaacagcagctgcaccgccagcaacggcagagaaaattcctccaggaggaacagcagctgcgccgccaggagcgcgggcaacagcggcgtcaggaccgtgacagaaaattccgcgaggaggaacagctgcgccaggagagggaggaacagcagctgagccgccaagagcgtgacagaaaattccgtttagaggaacagaaagtgcgccgccaggaacaagagagaaaattcatggaggacgaacagcagctgcgccgccaggagggccaacaacagctgcgccaggagcggacagaaaattccgcgaagacgaacagctgctccaggaaagggaagaacagcagctgcaccgccaagagcgtgacagaaaattcctcgaggaggaaccgcagctgcgccgccaggagcgcgaacaacagctgcgtcacgaccgcgacagaaaattccgtgaagaggaacagctgctccaggaaggggaggaacagcagctgcgccgccaagagcgtgacagaaaattccgcgaagaggaacagcagctccgccgtcaggaacgagagagaaaattcctccaggaggaacagcagctgcgccgccaggaactggagagaaaattccgtgaggaggaacagctgcgccaagaaacggagcaagagcagctgcgccgccaagaacgctacagaaaaatcctagaggaagagcagctccgtccggaaagggaagaacagcagctgcgccgccaggagcgcgacagaaaattccgcgaggaggaacagctccgccaggagagggaggaacagcagctgcgcagccaagagtctgacagaaaattccgcgaggaggaacagctacgccaggagagggaagaacagcagctgcgcccccaacagcgtgacggaaagtatcgctgggaagaagagcagctccaacttgaggaacaagagcagaggctgcggcaggagcgagaccggcagtaccgggcggaggagcagtttgccacgcaggagaagagtcgtcgtgaggaacaagaactatggcaagaagaggagcagaaacgtcgccaggaacgggaaaggaaattacgggaagaacacatccgccgccagcagaaggaggaacagaggcaccgccaagtcggggagataaaatcccaagaagggaagggccatgggcggcttctggagcccggcactcatcagtttgccagtgtcccagtgcgctccagccctctctatgagtacatccaagagcagagatctcaataccgcccttaagtgatgttgccaatatcttgacacctgccaaagcttcgagcacgggaaaatgagaaacactgggtaccaagtgataactcagatgtttctggttgtgggaaaactctctgatattagaatgtcttttcttccaaaatcttaaactacgctcattttacgcactttgtacttctgctttttattcttcctcaagtagttctttactgcaagatgtctttcttttgctctttgatgcagatgtggtgtgcatttaaaaaaaatataaatcatttaatttgtttaagaaattttgtttgaggaacatgttcatttattgctttcagaagtaacaagagtaataggatgatttgagattctaaacaatgggtcggtttgtttaatgactgacccatcttgtggaaagtgcagatacttttaatgttcaagttgctatttcttcttgaacctaaattgatcattgcctccaaacagcatttcatcttttgtggcatagttagcacaaattccaggtaactaaatttttataacccttgaatagtgcagggggagtgacctctgcataaaaacttcctgtaaaatcagcccattactggaagaaatatctgttaagaataggtttagctttgaagatttagaatttaaattagattttttttaaactcaactccacttaaacacataatctcatgaagaaataatgaggtgtttctcaacttcagagttcaaattttaaaactgtgtctgttgtagtctatagtgttcattctacttccccaagttttgatgagtttcagaatattatgaacctttgttaattttagcttgttagaaggaagctgctcagaatcccataaacatctgtcttactctagggccaataagagatcacatagagcatgttgggggtgtaaaagggaaaaatgtgtgaacataggggcaaatttctagaggccctttgacaagacccatttgcccacaatcatttgaggcctattgataataccttagatatattcttgttgaaataattggactgtgaaaaattaataataaatgtttggc

SEQ ID NO: 59794 - DNA, 2709 bp, Homo sapiens
gggtcctgtcccatccatcctgacctgttccatctcagccccaggactcagtactgcggttgccaacactgctgccaggcatgatggatgggccacgttccgatgtgggccgttggggtggcaaccccttgcagccccctaccacgccatctccagagccagagccagagccagacggacgctctcgcagaggaggaggccgttccttctgggctcgctgctgtggctgctgttcatgccgaaatgcggcagatgacgactggggacctgaaccctctgactccaggggtcgagggtccagctctggcactcgaagacctggctcccggggctcagactcccgccggcctgtatcccggggcagcggtgtcaatgcagctggagatggcaccatccgagagggcatgctagtagtgaacggtgtggacttgctgagctcgcgctcggaccagaaccgccgagagcaccacacagacgagtatgagtacgacgagctgatagtgcgccgcgggcagcctttccatatgctcctcctcctgtcccggacctatgaatcctctgatcgcatcacccttgagttactcatcggaaacaaccccgaggtgggcaagggcacgcacgtgatcatcccagtgggcaaggggggcagtggaggctggaaagcccaggtggtcaaggccagtgggcagaatctgaacctgcgggtccacacttcccccaacgccatcatcggcaagtttcagttcacagtccgcacacaatcagacgctggggagttccagttgccctttgacccccgcaatgagatctacatcctcttcaacccctggtgcccagaggacattgtgtacgtggaccatgaggattggcggcaggagtatgttcttaatgagtctgggagaatttactacgggaccgaagcacagattggtgagcggacctggaactacggccagtttgaccacggggtgctggatgcctgcttatacatcctggaccggcgggggatgccatatggaggccgtggagacccagtcaatgtctcccgggtcatctctgccatggtgaactccctggatgacaatggagtcctgattgggaactggtctggtgattactcccgaggcaccaacccatcagcgtgggtgggcagcgtggagatcctgcttagctacctacgcacgggatattccgtcccctatggccagtgctgggtctttgctggagtgaccaccacagtgctgcgctgcctgggtctggccacccgtactgtcaccaacttcaactccgcccacgacacagacacatcccttaccatggacatctacttcgacgagaacatgaagcccctggagcacctgaaccatgattctgtctggaacttccatgtgtggaacgactgctggatgaagaggccggatctgccctcgggctttgatgggtggcaggtggtggatgccacaccccaagagactagcagtggcatcttctgctgcggcccctgctctgtggagtccatcaagaatggcctggtctacatgaagtacgacacgcctttcatttttgctgaggtgaatagtgacaaggtgtactggcagcggcaggatgatggcagcttcaagattgtttatgtggaggagaaggccatcggcacactcattgtcacaaaggccatcagctccaacatgcgggaggacatcacctacctctataagcacccagaaggctcagacgcagagcggaaggcagtagagacagcagcagcccacggcagcaaacccaatgtgtatgccaaccggggctcagcggaggatgtggccatgcaggtggaggcacaggacgcggtgatggggcaggatctgatggtctctgtgatgctgatcaatcacagcagcagccgccgcacagtgaaactgcacctctacctctcagtcactttctatactggtgtcagtggtaccatcttcaaggagaccaagaaggaagtggagctggcaccaggggcctcggaccgtgtgaccatgccagtggcctacaaggaataccggccccatcttgtggaccagggggccatgctgctcaatgtctcaggccacgtcaaggagagcgggcaggtgctggccaagcagcacaccttccgtctgcgcaccccagacctctccctcacgttactgggagcagcagtggttggccaggagtgtgaagtacagattgtcttcaagaacccccttcccgtcaccctcaccaatgtcgtcttccggctcgaaggctctgggttacagaggcccaagatcctcaacgttggggacattggaggcaatgaaacagtgacactgcgccagtcgtttgtgcctgtgcgaccaggcccccgccagctcattgccagcttggacagcccacagctctcccaggtgcacggtgtcatccaggtggatgtggccccagcccctggggatgggggcttcttctcagacgctggaggtgacagtcacttaggagagaccatccctatggcatctcgaggtggagcttagccctgtgccaggagcaatgggactggagtcagatgagcaaggacattgccccaagataggggcacactacagagcagctccccaggagctcaggtggggagtccagggctcccggagagggagtcagtcttcacttgcactgggggaacagatgctaataaactgttttttaatg

SEQ ID NO: 59795 - DNA, 1958 bp, Homo sapiens
cagctaccatggcccaagggctagaagtggccctcacagacctccagagctccagaaataatgtgcggcaccacacggaggagatcactgtggaccacctgcttgttcgccggggccaggccttcaacctcaccctgtacttcaggaaccggagcttccagccaggcctggacaacatcatcttcgtggttgaaactgaggatgctgtctacttggacagtgaaccccagaggcaggagtatgtcatgaatgattatggcttcatctaccaaggcagcaagaactggatccgcccatgtccctggaactatggacagtttgaagacaaaatcatagacatctgcctgaagctgctagacaagagcctgcacttccagactgacccagccacagactgtgctctgcggggaagccccgtctacgtcagcagagtggtgtgtgccatgatcaacagcaatgatgataatggggtgctcaatggaaactggagtgagaattacacagacggcgccaaccctgcggagtggacgggcagcgtggccatcctgaagcagtggaacgccacaggctgccagcccgtgcgctacgggcaatgctgggtctttgctgccgtcatgtgcacagtgatgaggtgtctggggatccctacccgtgtgatcaccaacttcgactctggccacgatacagatggaaacctgatcatagatgagtattatgacaacacaggcaggattttggggaataagaagaaggatactatctggaacttccatgtctggaatgagtgctggatggcccggaaggatctgccccctgcatatggaggctggcaggtgctggacgccacacctcaggagatgagcaacggcgtctactgctgtggccctgcctctgtcagagccatcaaagaaggagaagtggacctgaactatgacacgccctttgtgttttcgatggtgaatgctgactgcatgtcctggctcgtccagggagggaaggagcagaagcttcaccaggacacgagttctgttggcaattttatcagcacaaagagcatccagagtgacgagcgggatgacatcacagagaactacaagtatgaagaaggatccctccaggagaggcaggtgtttctgaaggctctgcagaagctgaaggctagaagcttccatggctcccaaagaggagcagagttgcaaccttccaggcccacatcactgagccaggacagccctcggagcctgcatacaccttcccttcgacccagtgatgtggtgcaagtctccctgaaattcaagctgctcgacccgcccaacatgggccaggatatatgctttgtcctgctggccctcaacatgtcctcccagttcaaggacctcaaagtgaacctgagtgcccagtctctgctgcacgatggcagccccctgtccccattctggcaggacacagcgttcatcacactctctcctaaagaagcaaagacctacccctgcaaaatctcctattcccagtacagccagtacctgtcaacagacaagctgatccgcatcagtgccctgggtgaagagaaaagcagtcctgagaaaatcctggtgaacaagatcatcaccttatcttatccaagcatcacgattaatgttctaggagcagccgttgtgaaccagccactctccatacaggtgatattttcaaaccccctctcggagcaggttgaggactgtgtgctgactgtggaaggaagtggcctcttcaagaaacagcagaaagtcttccttggagtcctcaaaccccaacaccaagcaagcatcattctggagaccgtccccttcaagagtggacaaaggcagatccaagctaatatgagaagcaacaagtttaaggacattaagggttacaggaatgtttatgtagactttgcattataaattctggaacaacgcgccagacgtgtgagtttc

SEQ ID NO: 59796 - DNA, 2204 bp, Homo sapiens
cagctaccatggcccaagggctagaagtggccctcacagacctccagagctccagaaataatgtgcggcaccacacggaggagatcactgtggaccacctgcttgttcgccggggccaggccttcaacctcaccctgtacttcaggaaccggagcttccagccaggcctggacaacatcatcttcgtggttgaaactggaccgctgtcagacctggccttggggactcgggctgtgttcagcctggcacgccatcacagccccagcccctggattgcctggctggagaccaatggggccacctccacagaggtgagcttgtgcgctcctcccacggcggccgtgggtcggtacctcttgaaaatccacatcgactccttccaggggtctgtgacggcctaccagctaggggagttcatcctgcttttcaatccctggtgcccagaggatgctgtctacttggacagtgaaccccagaggcaggagtatgtcatgaatgattatggcttcatctaccaaggcagcaagaactggatccgcccatgtccctggaactatggacagtttgaagacaaaatcatagacatctgcctgaagctgctagacaagagcctgcacttccagactgacccagccacagactgtgctctgcggggaagccccgtctacgtcagcagagtggtgtgtgccatgatcaacagcaatgatgataatggggtgctcaatggaaactggagtgagaattacacagacggcgccaaccctgcggagtggacgggcagcgtggccatcctgaagcagtggaacgccacaggctgccagcccgtgcgctacgggcaatgctgggtctttgctgccgtcatgtgcacagtgatgaggtgtctggggatccctacccgtgtgatcaccaacttcgactctggccacgatacagatggaaacctgatcatagatgagtattatgacaacacaggcaggattttggggaataagaagaaggatactatctggaacttccatgtctggaatgagtgctggatggcccggaaggatctgccccctgcatatggaggctggcaggtgctggacgccacacctcaggagatgagcaacggcgtctactgctgtggccctgcctctgtcagagccatcaaagaaggagaagtggacctgaactatgacacgccctttgtgttttcgatggtgaatgctgactgcatgtcctggctcgtccagggagggaaggagcagaagcttcaccaggacacgagttctgttggcaattttatcagcacaaagagcatccagagtgacgagcgggatgacatcacagagaactacaagtatgaagaaggatccctccaggagaggcaggtgtttctgaaggctctgcagaagctgaaggctagaagcttccatggctcccaaagaggagcagagttgcaaccttccaggcccacatcactgagccaggacagccctcggagcctgcatacaccttcccttcgacccagtgatgtggtgcaagtctccctgaaattcaagctgctcgacccgcccaacatgggccaggatatatgctttgtcctgctggccctcaacatgtcctcccagttcaaggacctcaaagtgaacctgagtgcccagtctctgctgcacgatggcagccccctgtccccattctggcaggacacagcgttcatcacactctctcctaaagaagcaaagacctacccctgcaaaatctcctattcccagtacagccagtacctgtcaacagacaagctgatccgcatcagtgccctgggtgaagagaaaagcagtcctgagaaaatcctggtgaacaagatcatcaccttatcttatccaagcatcacgattaatgttctaggagcagccgttgtgaaccagccactctccatacaggtgatattttcaaaccccctctcggagcaggttgaggactgtgtgctgactgtggaaggaagtggcctcttcaagaaacagcagaaagtcttccttggagtcctcaaaccccaacaccaagcaagcatcattctggagaccgtccccttcaagagtggacaaaggcagatccaagctaatatgagaagcaacaagtttaaggacattaagggttacaggaatgtttatgtagactttgcattataaattctggaacaacgcgccagacgtgtgagtttc

SEQ ID NO: 59797 - DNA, 2442 bp, Homo sapiens
agcctcgcctagctctctgaaagaaagcctgcaacagaagggagagaagcggccccaagtgcagctgaaagcactccttgggagtcagccaagaccctccatccaagcagggctggatccttgcacttggccatgataaggagatgcttccaggtggcagcaagacttggccaccacagaggccttcttgaggccccccgtatcctgcccagactcaaccctgcctcagcatttggatcctccacagactccatgttctcaagattcttgccagagaagacagacttgaaggattatgctcttcccaatgccagctggtgttcggacatgctgagcctgtaccaagaatttctggagaagactaagtctagcggctggatcaagctgccctccttcaagtccaacagagaccacatccggggactcaagctcccatctggactggcagtttcctcagacaaaggtgactgtcgcatcttcaccaggtgcatccaagtggaaggacaaggctttgagtatgtcatctttttccagccaacccagaagaagtcggtctgtcttttccaaccaggctcctacctggaggggcccccagggtttgctcacggcgggtccctggcagccatgatggacgagaccttttctaaaactgccttcctggctggagaggggctgttcacactaagtctcaacatcaggttcaaaaacttgatccccgtggactctctggttgtaatggacgtagaagtggacaagattgaggaccagaagctttacatgtcctgcatcgcccacagcagagaccagcagacagtttatgccaagtcctcaggtgttttccttcagctgcagttggaagaagagtctccccagtaacagtcactgtgcctgcaggagagccactgcctcccctgcctgcctcctgcctcctgcctcccctgcctgcctcctgcctcctgcctcccctgcctgcctcctgcctcctgcctcccctgcctgcctgggacccatcaaagagcagggaggggtcctcaagcagcaattggtgaggcgagggaaaggacccttttctctgagtaaataaagtctcacagtcccattctcggcccagggcctttctgtggttggaaatcaaaatccttccagggcatctcacatacccaccttcccattcagcaccgactgaaaagatttactgagtacccgccaggtgtcaggcactgtgtgaggcaccaggcacccagaagtgaaggacagggccccggtctcaagatgcacaatgcgggagccaggtgccaagtcagagtgccctatcacgctcctcccacacccaccctggcttccatcatgagtgcagtgtcatctcagcgggaggaagggctaattttactctacaaaagcaatcagaaaacatcttctagaagaagctcttcctgaactgtctcaaaagttaagtggtgttcattaggcaggcaggggagaggaggatatcccaggcagaagggaagtaagaagtaagacaaaggtgcagaggtgtgaaagtgtacagggactttggagaagagcaaggtgttgaggagggcaggcgtttagggaaagagaaggtgggcaggagcaaaccacaggaaggcttcataatccctgctggagagctggaactttgtcttgcaggcaacagggagcctccaaagggcttgggctggggagtgacagagctttgttatttagaaagatgactcagtggcagtaaggcgtcagcaagactgaaggcaggagtactagttaggagatccccacaggctttacactagagacagtaagggcctgcaggggtcagagctgcgaagctgagagatatgagaaaatgttacaaatacaggaagtgcaggactgtgccactagttatacaatgtggatctgtgaagacgagctccaagtttctggcttatgagtttccaggtggttatcactggaaatacagaaagaggtgggggtaaacaatgagctcagttttacatgcatcgagcttgaagtgcccatggaacttgtaccatgtggcaagtgccagcaggaacgtggatattgtgatatggagcttggagagataagctactgactcaaatcgtgagccaatataaaatgtgacatgaggccggacacggtggctcatgcctgtaatcccagcactttgggaggccgatgcgggctgatcacttgagcgattcgagagtcgagaggctggtcgggagttcgagaccagcctgaccaacatggagaaaccctatctctactaaaaacacaaaaaattagccgggtgtggtggcgcatgcctgtaatcccagcatttggatcctccacttgaacccgagaggcggaggttgcagtgagccgagatcacaccattgcactccagcctgggcaacaagagcaaaactccgtccc

SEQ ID NO: 59798 - DNA, 3324 bp, Homo sapiens
cgcccgggcaggttgagaagccaggggccaagatggatcttctcctcgacatcagctaagcctggaggactcttcccctcagagaccatggagagggacagccacgggaatgcatctccagcaagaacaccttcagctggagcatctccagcccaggcatctccagctgggacacctccaggccgggcatctccagcccaggcatctccagcccaggcatctccagctgggacacctccgggccgggcatctccagcccaggcatctccagctggtacacctccaggccgggcatctccaggccgggcatctccagcccaggcatctccagcccaggcatctccagcccaggcatctccagcccgggcatctccggctctggcatcactttccaggtcctcatccggcaggtcatcatccgccaggtcagcctcggtgacaacctccccaaccagagtgtaccttgttagagcaacaccagtgggggctgtacccatccgatcatctcctgccaggtcagcaccagcaaccagggccaccagggagagcccagtccagttctggcagggccacacagggatcaggtacaaggagcagagggagagctgtcccaagcacgctgttcgctgtgacggggtggtggactgcaagctgaagagtgacgagctgggctgcgtgaggtttgactgggacaagtctctgcttaaaatctactctgggtcctcccatcagtggcttcccatctgtagcagcaactggaatgactcctactcagagaagacctgccagcagctgggtttcgagagtgctcaccggacaaccgaggttgcccacagggattttgccaacagcttctcaatcttgagatacaactccaccatccaggaaagcctccacaggtctgaatgcccttcccagcggtatatctccctccagtgttcccactgcggactgagggccatgaccgggcggatcgtgggaggggcgctggcctcggatagcaagtggccttggcaagtgagtctgcacttcggcaccacccacatctgtggaggcacgctcattgacgcccagtgggtgctcactgccgcccactgcttcttcgtgacccgggagaaggtcctggagggctggaaggtgtacgcgggcaccagcaacctgcaccagttgcctgaggcagcctccattgccgagatcatcatcaacagcaattacaccgatgaggaggacgactatgacatcgccctcatgcggctgtccaagcccctgaccctgtccgctcacatccaccctgcttgcctccccatgcatggacagacctttagcctcaatgagacctgctggatcacaggctttggcaagaccagggagacagatgacaagacatcccccttcctccgggaggtgcaggtcaatctcatcgacttcaagaaatgcaatgactacttggtctatgacagttaccttaccccaaggatgatgtgtgctggggaccttcgtgggggcagagactcctgccagggagacagcggggggcctcttgtctgtgagcagaacaaccgctggtacctggcaggtgtcaccagctggggcacaggctgtggccagagaaacaaacctggtgtgtacaccaaagtgacagaagttcttccctggatttacagcaagatggagagcgaggtgcgattcagaaaatcctaaccagctggcctgctgctctgcacagcaccggctgctgtgaagactctggccatggtgactggccatgtgtggcatcatctgggctaatggccaccgggcaccatcagactcccacctccactgtctgctgcctctgtgtgtgtgtgtgtgtgtgtgtgtgtgcatatgtgtgcattgccactctcccaagtttttcagaaaccagcagagctgtcaactcttctcaaaatcccaggctggaaattacctggagacaagagttgagtaccgtggatgttcctacaggagtgtccatagatggatggaggaggtggagcccagagcccaaggaagagctgggaattcttgcttctctgaccctcacttacagactagcccagtgtgggcagatgccagcggcccaggtggcgccattgctgtcctgggatggatcgtgggttttggtggatgcagcttcccagggcctggaccgtcttcggtgaaaagctgctcccgttggctttatgagcatcaagtcctcacccagaccccctgctggtgccgtggatgtcaccagtcggactgtgctgtggctaaccaggctgacaactgagatgaggattcactgtactcatttggtcacaagctgctggggcgggttttattttattttatttttatatttaagaaatgaaaatacgggtatttttaaagattctccaaaaagtccagaagccttgagagctggcatcaatcagcccaagacccccaggggattcatgggaaatgtcgtattttagagtcctacagaatatttctggcctcaaggaactggatgaagagactggacaaagtccccaggatgggcatcccccaagtcactacagcatctggagcccctaggagatactcagggaagcaaatccttgtttgggctggcaagcaaatccgacacgacgaggtccacaaactgtttctgcatcccagggctctgacgaaggcgttaagaaacagatgctgttcccgcgtaggctcccaggggccccagggaggtccaggtggactgcctctctcattcccaggagctgtcctgggactttgggatttcttctcagctttctccacctttcagtttctcagttgtttcagaaacatagcaatgacataaaaactgctatggagagaaagctaacatggtcccatgccttccaggcagccctgctgaaggatctaagttggccctgttcctgcaaatcatcaacgtgcctggactcgccagctaaaagcctgggccttccccagccttttttctggggcacctattcctctgccagtcctgctcccctcaccttccttgggcccgtcagagtcttttgtggtgctgtgcttctcagaggcaggatccaagcagatcagcccagcctagcccagctcaggcaggccatggccgctcaagggaaagactgccccagaagagcaagctggagaggctgggcaggggctgatggggctgggtacactggggaatgttagcaagactgggaaggaggccacattcctgtctgcagcagcccccagcgatggtcttcagcaataaaagttgtgtgacctaaaaaaaaaaaaaaaaaaaaaaaaaaaaaaaaa

SEQ ID NO: 59799 - DNA, 4005 bp, Homo sapiens
gggcaacagtctgcccacctgtggacaccagatcctgggagctcctggttagcaagtgagatctctgggatgtcagtgaggctggttgaagaccagaggtaaactgcagaggtcaccacccccaccatgtcccaggtgatgtccagcccactgctggcaggaggccatgctgtcagcttggcgccttgtgatgagcccaggaggaccctgcacccagcacccagccccagcctgccaccccagtgttcttactacaccacggaaggctggggagcccaggccctgatggcccccgtgccctgcatggggccccctggccgactccagcaagccccacaggtggaggccaaagccacctgcttcctgccgtcccctggtgagaaggccttggggaccccagaggaccttgactcctacattgacttctcactggagagcctcaatcagatgatcctggaactggaccccaccttccagctgcttcccccagggactgggggctcccaggctgagctggcccagagcaccatgtcaatgagaaagaaggaggaatctgaagccttggacataaagtacatcgaggtgacctccgccagatcaaggtgccacgattggccccagcactgctccagcccctctgtcaccccgcccttcggctcccctcgcagtggtggcctcctcctttccagagacgtcccccgagagacacgaagcagcagtgagagcctcatcttctctgggaaccagggcagggggcaccagcgccctctgcccccctcagagggtctctcccctcgacccccaaattcccccagcatctcaatcccttgcatggggagcaaggcctcgagcccccatggtttgggctccccgctggtggcttctccaagactggagaagcggctgggaggcctggccccacagcggggcagcaggatctctgtgctgtcagccagcccagtgtctgatgtcagctatatgtttggaagcagccagtccctcctgcactccagcaactccagccatcagtcatcttccagatccttggaaagtccagccaactcttcctccagcctccacagccttggctcagtgtccctgtgtacaagacccagtgacttccaggctcccagaaaccccaccctaaccatgggccaacccagaacaccccactctccaccactggccaaagaacatgccagcatctgccccccatccatcaccaactccatggtggacatacccattgtgctgatcaacggctgcccagaaccagggtcttctccaccccagcggaccccaggacaccagaactccgttcaacctggagctgcttctcccagcaacccctgtccagccaccaggagcaacagccagaccctgtcagatgccccctttaccacatgcccagagggtcccgccagggacatgcagcccaccatgaagttcgtgatggacacatctaaatactggtttaagccaaacatcacccgagagcaagcaatcgagctgctgaggaaggaggagccaggggcttttgtcataagggacagctcttcataccgaggctccttcggcctggccctgaaggtgcaggaggttcccgcgtctgctcagaatcgaccaggtgaggacagcaatgacctcatccgacacttcctcatcgagtcgtctgccaaaggagtgcatctcaaaggagcagatgaggagccctactttgggagcctctctgccttcgtgtgccagcattccatcatggccctggccctgccctgcaaactcaccatcccacagagagaactgggaggtgcagatggggcctcggactctacagacagcccagcctcctgccagaagaaatctgcgggctgccacaccctgtacctgagctcagtgagcgtggagaccctgactggagccctggccgtgcagaaagccatctccaccacctttgagagggacatcctccccacgcccaccgtggtccacttcgaagtcacagagcagggcatcactctgactgatgtccagaggaaggtgtttttccggcgccattacccactcaccaccctccgcttctgtggtatggaccctgagcaacggaagtggcagaagtactgcaaaccctcctggatctttgggtttgtggccaagagccagacagagcctcaggagaacgtatgccacctctttgcggagtatgacatggtccagccagcctcgcaggtcatcggcctggtgactgctctgctgcaggacgcagaaaggatgtaggggagagactgcctgtgcacctaaccaacacctccaggggctcgctaaggagcccccctccaccccctgaatgggtgtggcttgtggccatattgacagaccaatctatgggactagggggattggcatcaagttgacacccttgaacctgctatggccttcagcagtcaccatcatccagaccccccgggcctcagtttcctcaatcatagaagaagaccaatagacaagatcagctgttcttagatgctggtgggcatttgaacatgctcctccatgattctgaagcatgcacacctctgaagacccctgcatgaaaataacctccaaggaccctctgaccccatcgacctgggccctgcccacacaacagtctgagcaagagacctgcagcccctgtttcgtggcagacagcaggtgcctggcggtgacccacggggctcctggcttgcagctggtgatggtcaagaactgactacaaaacaggaatggatagactctatttccttccatatctgttcctctgttccttttcccactttctgggtggctttttgggtccacccagccaggatgctgcaggccaagctgggtgtggtatttagggcagctcagcagggggaacttgtccccatggtcagaggagacccagctgtcctgcacccccttgcagatgagtatcaccccatcttttctttccacttggtttttatttttattttttttgagacagagtctcactgtcacccaggctgaactgcagtggtgtgatctaggctcactgcaacctccacctcccaggttcaagcaattatcctgcctcaggctcccgagtagctgggattacaggcatgtgcaactcacccagctaattttgtatttttagtagagacagggtttcaccatgttggccaggctggtcttgaactcctgaccgcaggtaatccacctgcttcggcctcccaaagtgctgggattacaggcgcaagccacccagcccagcttctttccattccttgataggcgagtattccaaagctggtatcgtagctgccctaatgttgcatattaggcggcgggggcagagataagggccatctctctgtgattctgcctcagctcctgtcttgctgagccctcccccaacccacgctccaacacacacacacacacacacacacacacacacacacacacacacacacacacgcccctctactgctatgtggcttcaaccagcctcacagccacacgggggaagcagagagtcaagaatgcaaagaggccgcttccctaagaggcttggaggagctgggctctatcccacacccacccccaccccacccccacccagcctccagaagctggaaccatttctcccgcaggcctgagttcctaaggaaaccaccctaccggggtggaagggagggtcagggaagaaacccactcttgctctacgaggagcaagtgcctgccccctcccagcagccagccctgccaaagttgcattatctttggccaaggctgggcctgacggttatgatttcagccctgggcctgcaggagaggctgagatcagcccacccagccagtggtcgagcactgccccgccgccaaagtctgcagaatgtgagatgaggttctcaaggtcacaggccccagtcccagcctgggggctggcagaggcccccatatactctgctacagctcctatcatgaaaaataaaatgt

SEQ ID NO: 59800 - DNA, 3018 bp, Homo sapiens
ctcctcacaggtgtgtctctagtcctcgtggttgcctgccccactccctgccgagacgcctgccagaaaggtcacctatcctgaaccccagcaagcctgaaacagctcagccaagcaccctgcgatggaagctgcagatgcctccaggagcaacgggtcgagcccagaagccagggatgcccggagcccgtcgggccccagtggcagcctggagaatggcaccaaggctgacggcaaggatgccaagaccaccaacgggcacggcggggaggcagctgagggcaagagcctgggcagcgccctgaagccaggggaaggtaggagcgccctgttcgcgggcaatgagtggcggcgacccatcatccagtttgtcgagtccggggacgacaagaactccaactacttcagcatggactctatggaaggcaagaggtcgccgtacgcagggctccagctgggggctgccaagaagccacccgttacctttgccgaaaagggcgagctgcgcaagtccattttctcggagtcccggaagcccacggtgtccatcatggagcccggggagacccggcggaacagctacccccgggccgacacgggccttttttcacggtccaagtccggctccgaggaggtgctgtgcgactcctgcatcggcaacaagcagaaggcggtcaagtcctgcctggtgtgccaggcctccttctgcgagctgcatctcaagccccacctggagggcgccgccttccgagaccaccagctgctcgagcccatccgggactttgaggcccgcaagtgtcccgtgcatggcaagacgatggagctcttctgccagaccgaccagacctgcatctgctacctttgcatgttccaggagcacaagaatcatagcaccgtgacagtggaggaggccaaggccgagaaggagacggagctgtcactgcaaaaggagcagctgcagctcaagatcattgagattgaggatgaagctgagaagtggcagaaggagaaggaccgcatcaagagcttcaccaccaatgagaaggccatcctggagcagaacttccgggacctggtgcgggacctggagaagcaaaaggaggaagtgagggctgcgctggagcagcgggagcaggatgctgtggaccaagtgaaggtgatcatggatgctctggatgagagagccaaggtgctgcatgaggacaagcagacccgggagcagctgcatagcatcagcgactctgtgttgtttctgcaggaatttggtgcattgatgagcaattactctctccccccacccctgcccacctatcatgtcctgctggagggggagggcctgggacagtcactaggcaacttcaaggacgacctgctcaatgtatgcatgcgccacgttgagaagatgtgcaaggcggacctgagccgtaacttcattgagaggaaccacatggagaacggtggtgaccatcgctatgtgaacaactacacgaacagcttcgggggtgagtggagtgcaccggacaccatgaagagatactccatgtacctgacacccaaaggtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgacctgcccgtcgtccaaggcagctcctccttctccctgaaaggctatccctccctcatgcggagccaaagccccaaggcccagccccagacttggaaatctggcaagcagactatgctgtctcactaccggccattctacgtcaacaaaggcaacgggattgggtccaacgaagccccatgagctcctggcggaaggaacgaggcgccacacccctgctcttcctcctgaccctgctgctcttgccttctaagctactgtgcttgtctgggtgggagggagcctggtcctgcacctgccctctgcagccctctgccagcctcttgggggcagttccggcctctccgacttccccactggccacactccattcagactcctttcctgccttgtgacctcagatggtcaccatcattcctgtgctcagaggccaacccatcacaggggtgagataggttggggcctgccctaacccgccagcctcctcctctcgggctggatctgggggctagcagtgagtacccgcatggtatcagcctgcctctcccgcccacgccctgctgtctccaggcctatagacgtttctctccaaggccctatcccccaatgttgtcagcagatgcctggacagcacagccacccatctcccattcacatggcccacctcctgcttcccagaggactggccctacgtgctctctctcgtcctacctatcaatgcccagcatggcagaacctgcagcccttggccactgcagatggaaacctctcagtgtcttgacatcaccctacccaggcggtgggtctccaccacagccactttgagtctgtggtccctggagggtggcttctcctgactggcaggatgaccttagccaagatattcctctgttccctctgctgagataaagaattcccttaacatgatataatccacccatgcaaatagctactggcccagctaccatttaccatttgcctacagaatttcattcagtctacactttggcattctctctggcgatggagtgtggctgggctgaccgcaaaaggtgccttacacactgcccccaccctcagccgttgccccatcagaggctgcctcctccttctgattaccccccatgttgcatatcagggtgctcaaggattggagaggagacaaaaccaggagcagcacagtggggacatctcccgtctcaacagccccaggcctatgggggctctggaaggatgggccagcttgcaggggttggggagggagacatccagcttgggctttcccctttggaataaaccattggtctgtc

SEQ ID NO: 59801 - DNA, 2196 bp, Homo sapiens
ctcctcacaggtgtgtctctagtcctcgtggttgcctgccccactccctgccgagacgcctgccagaaaggtcacctatcctgaaccccagcaagcctgaaacagctcagccaagcaccctgcgatggaagctgcagatgcctccaggagcaacgggtcgagcccagaagccagggatgcccggagcccgtcgggccccagtggcagcctggagaatggcaccaaggctgacggcaaggatgccaagaccaccaacgggcacggcggggaggcagctgagggcaagagcctgggcagcgccctgaagccaggggaaggtaggagcgccctgttcgcgggcaatgagtggcggcgacccatcatccagtttgtcgagtccggggacgacaagaactccaactacttcagcatggactctatggaaggcaagaggtcgccgtacgcagggctccagctgggggctgccaagaagccacccgttacctttgccgaaaagggcgagctgcgcaagtccattttctcggagtcccggaagcccacggtgtccatcatggagcccggggagacccggcggaacagctacccccgggccgacacgggccttttttcacggtccaagtccggctccgaggaggtgctgtgcgactcctgcatcggcaacaagcagaaggcggtcaagtcctgcctggtgtgccaggcctccttctgcgagctgcatctcaagccccacctggagggcgccgccttccgagaccaccagctgctcgagcccatccgggactttgaggcccgcaagtgtcccgtgcatggcaagacgatggagctcttctgccagaccgaccagacctgcatctgctacctttgcatgttccaggagcacaagaatcatagcaccgtgacagtggaggaggccaaggccgagaaggagacggagctgtcactgcaaaaggagcagctgcagctcaagatcattgagattgaggatgaagctgagaagtggcagaaggagaaggaccgcatcaagagcttcaccaccaatgagaaggccatcctggagcagaacttccgggacctggtgcgggacctggagaagcaaaaggaggaagtgagggctgcgctggagcagcgggagcaggatgctgtggaccaagtgaaggtgatcatggatgctctggatgagagagccaaggtgctgcatgaggacaagcagacccgggagcagctgcatagcatcagcgactctgtgttgtttctgcaggaatttggtgcattgatgagcaattactctctccccccacccctgcccacctatcatgtcctgctggagggggagggcctgggacagtcactaggcaacttcaaggacgacctgctcaatgtatgcatgcgccacgttgagaagatgtgcaaggcggacctgagccgtaacttcattgagaggaaccacatggagaacggtggtgaccatcgctatgtgaacaactacacgaacagcttcgggggtgagtggagtgcaccggacaccatgaagagatactccatgtacctgacacccaaaggtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgacctgcccgtcgtccaaggcagctcctccttctccctgaaaggctatccctccctcatgcggagccaaagccccaaggcccagccccagacttggaaatctggcaagcagactatgctggtggtttaagcaaggtctgagcatccctcaagtcctgctgtggaccacacaaaggcaaggagctgaccaggaggtgtcagttccctgagagacagggccaaaggcagtgtacccttgagtctcactaccggccattctacgtcaacaaaggcaacgggattgggtccaacgaagccccatgagctcctggcggaagggtgctcaaggattggagaggagacaaaaccaggagcagcacagtggggacatctcccgtctcaacagccccaggcctatgggggctctggaaggatgggccagcttgcaggggttggggagggagacatccagcttgggctttcccctttggaataaaccattggtctgtc

SEQ ID NO: 59802 - DNA, 2341 bp, Homo sapiens
agtgcctttggcgcactgaggtgcacagggtcccttagccgggcgcagggcgcgcagcccaggctgagatccgcggcttccgtagaagtgagcatggctgggcagcgagtgcttcttctagtgggcttccttctccctggggtcctgctctcagaggctgccaaaatcctgacaatatctacagtaggtggaagccattatctactgatggaccgggtttctcagattcttcaagatcacggtcataatgtcaccatgcttaaccacaaaagaggtccttttatgccagattttaaaaaggaagaaaaatcatatcaagttatcagttggcttgcacctgaagatcatcaaagagaatttaaaaagagttttgatttctttctggaagaaactttaggtggcagaggaaaatttgaaaacttattaaatgttctagaatacttggcgttgcagtgcagtcattttttaaatagaaaggatatcatggattccttaaagaatgagaacttcgacatggtgatagttgaaacttttgactactgtcctttcctgattgctgagaagcttgggaagccatttgtggccattctttccacttcattcggctctttggaatttgggctaccaatccccttgtcttatgttccagtattccgttccttgctgactgatcacatggacttctggggccgagtgaagaattttctgatgttctttagtttctgcaggaggcaacagcacatgcagtctacatttgacaacaccatcaaggaacatttcacagaaggctctaggccagttttgtctcatcttctactgaaagcagagttgtggttcattaactctgactttgcctttgattttgctcgacctctgcttcccaacactgtttatgttggaggcttgatggaaaaacctattaaaccagtaccacaagacttggagaacttcattgccaagtttgaggactctggttttgtccttgtgaccttgggctccatggtgaacacctgtcagaatccggaaatcttcaaggagatgaacaatgcctttgctcacctaccccaaggggtgatatggaagtgtcagtgttctcattggcccaaagatgtccacctggctgcaaatgtgaaaattgtggactggcttcctcagagtgacctcctggctcacccaagcatccgtctgtttgtcacccacggcgggcagaatagcataatggaggccatccagcatggtgtgcccatggtggggatccctctctttggagaccagcctgaaaacatggtccgagtagaagccaaaaagtttggtgtttctattcagttaaagaagctcaaggcagagacattggctcttaagatgaaacaaatcatggaagacaagagatacaagtccgcggcagtggctgccagtgtcatcctgcgctcccacccgctcagccccacacagcggctggtgggctggattgaccacgtcctccagacagggggcgcgacgcacctcaagccctatgtctttcagcagccctggcatgagcagtacctgctcgacgtttttgtgtttctgctggggctcactctggggactctatggctttgtgggaagctgctgggcatggctgtctggtggctgcgtggggccagaaaggtgaaggagacataaggccaggtgcagccttggcggggtctgtttggtgggcgatgtcaccatttctagggagcttcccactagttctggcagccccattctctagtccttctagttatctcctgttttcttgaagaacaggaaaaatggccaaaaatcatcctttccacttgctaattttgctacaaattcatccttactagctcctgcctgctagcagaattctttccagtcctcttgtcctcctttgtttgccatcagcaagggctatgctgtgattctgtctctgagtgacttggaccactgaccctcagatttccagccttaaaatccaccttccttctcatgcgcctctccgaatcacaccctgactcttccagcctccatgtccagacctagtcagcctctctcactcctgcccctactatctatcatggaataacatccaagaaagacaccttgcatattctttcagtttctgttttgttctcccacatattctcttcaatgctcaggaagcctgccctgtgcttgagagttcagggccggacacaggctcacaggtctccacattgggtccctgtctctggtgcccacagtgagctccttcttggctgagcaggcatggagactgtaggtttccagatttcctgaaaaataaaagtttacagcgttatctctccccaacctc

SEQ ID NO: 59803 - DNA, 415 bp, Homo sapiens
aaacttgacgccatgaagatcccggtccttcctgccgtggtgctcctctccctcctggtgctccactctgcccagggagccaccctgggtggtcctgaggaagaaagcaccattgagaattatgcgtcacgacccgaggcctttaacaccccgttcctgaacatcgacaaattgcgatctgcgtttaaggctgatgagttcctgaactggcacgccctctttgagtctatcaaaaggaaacttcctttcctcaactgggatgcctttcctaagctgaaaggactgaggagcgcaactcctgatgcccagtgaccatgacctccactggaagagggggctagcgtgagcgctgattctcaacctaccataactctttcctgcctcaggaactccaataaaacattttccatccaaa

SEQ ID NO: 59804 - DNA, 1796 bp, Homo sapiens
ggtcagctgagttcgccggcccagggcaggcggggcccgagcctagcggtaacccccgggcagggcggggccgctcgcagactccatatgagattcacctcgcaggtggttccctcattcgagtgctccggcgcacagacccgcgccccgccgtctgcgagcctcccgagagccgtcccttcgtccggccctggagcattgcgtttgtcgccggtgtcgcagtgcgaggatggcgccgcgggtgtagcggctctctgcgcaggccgagtgggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtcatggtatgggcattccttctatctcaatcatgttgcatgagctcataaagctgctgtactatgcccggtgctccaacgtcactatcatccgcattggcacttctggtgggataggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaaatcccctgttgtgtggactttgagcacactttacacaagaatctagaaaatcagatcgcgattaagagacagagaatcttggattaaccgcatgggagatgttcttccttttgaagtttcattggagcattttcaatgatgttagcctgatttggggtttcttcaagaacattctaccaaatttttgtactatttctagggaaatttttcagactttaaaattctaatggtagtcagatttcatgtcactaaacaagaaatctgacaatagtgccaggaaactaatttcctgatacattaaaaaaattccatgcaaaaaaaaaaaaaaaaaaaa

SEQ ID NO: 59805 - DNA, 1857 bp, Homo sapiens
caccgggccagggctggttccacgctgtcatttctctccgctggccccagccgcggggccaccgccagacagacagaccggggatcctgcctggcggcgtgaccttgggttagtcctagagccgcttctagcccggtttcctccgccccaggttaggaccacgtgggtggttccctcattcgagtgctccggcgcacagacccgcgccccgccgtctgcgagcctcccgagagccgtcccttcgtccggccctggagcattgcgtttgtcgccggtgtcgcagtgcgaggatggcgccgcgggtgtagcggctctctgcgcaggccgagtgggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtcatggtatgggcattccttctatctcaatcatgttgcatgagctcataaagctgctgtactatgcccggtgctccaacgtcactatcatccgcattggcacttctggtgggataggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaaatcccctgttgtgtggactttgagcacactttacacaagaatctagaaaatcagatcgcgattaagagacagagaatcttggattaaccgcatgggagatgttcttccttttgaagtttcattggagcattttcaatgatgttagcctgatttggggtttcttcaagaacattctaccaaatttttgtactatttctagggaaatttttcagactttaaaattctaatggtagtcagatttcatgtcactaaacaagaaatctgacaatagtgccaggaaactaatttcctgatacattaaaaaaattccatgcaaaaaaaaaaaaaaaaaaaa

SEQ ID NO: 59806 - DNA, 1861 bp, Homo sapiens
actgtggcgtgggagcatctacaaactcctgtggcgagagctgctctgcttccttgggttctacatggcgctgagtgctgcctaccgctttgtgctgaccgaagggcagaagcgctacttcgagaagcttgtgatttattgtgaccagtatgccagcctcatccctgtctccttcgtgcttggcttttatgtgacgctggtggtgaaccgctggtggagccagtacctatgcatgccgctgcccgacgcgctcatgtgcgtggtggcgggcaccgtgcacggacgcgacgaccgcggccgcctctaccggcgcacactcatgcgctacgcagggctctcggccgtgctcatcctgcgctccgtcagcaccgcggtgttcaagcgcttccccaccatagaccacgtggtggaggctgggtttatgacccgcgaggagcgcaagaagtttgaaaacctgaactcatcctacaacaagtactgggtgccctgcgtctggttctccaacctggcggcacaggcccgacgcgagggccgcatccgcgacaacagcgcccttaagctgctgctcgaggagctgaatgtttttcggggcaaatgtggaatgctctttcactatgactggattagcgtacccctcgtgtacacgcaggtggtgaccatcgcactgtacagctacttcctggcttgcctcattggtcgccagttcctggacccggctcagggttacaaagaccacgacctagacctgtgtgtgcccatcttcaccctcttgcagttcttcttctacgccggctggctcaaggtagctgagcagctcatcaaccccttcggagaggacgatgatgactttgagaccaactttctgatcgatagaaacttccaggtgtccatgctggcagtggacgagatgtatgatgacctggctgtgctggagaaggacttgtactgggatgcagccgaggctcgcgccccatacacagcggctactgtcttccagctgcggcagccttccttccagggctccacctttgacatcacgctggccaaagaagacatgcagttccagcggctggacggcttggatggaccgatgggaggggcgcccggcgacttcctgcagcgcctcctgccggcgggcgcgggcatggtcgcgggaggcccgctggggcggcgcctgtcctttctactccgcaagaacagctgcgtgtcggaggcgtctactggggccagctgctcatgcgcggttgtccccgaaggcgcggccccggagtgcagctgcggggacccgctgctcgaccccggcctgccggagcccgaggccccgccccctgcgggtcccgaaccgcttaccctcatccctgggcctgtcgagcccttcagcatcgtgaccatgcccgggccccggggtccggcgccaccctggctgcccagccctattggcgaggaggaggagaatctggcctgagatcttagagcccagccccctaaggacagggaaccaggtccctgcacggcacccacgcaggtgtcccggtctgcataagcctcgtatgcctttgtaaagtccacctacacttttgaccagctctcgctgcccgcatgtgtttggcgctgtgctaggggcgggagttcttccagactcttggaccagcccgccctgaccaccagctctacttcccaacccccactgcctgagaggtctctatcagtgtcctgcctgaattctttccttcaagtgaagatgtgactgactacctcctcgagttgtcatgaggatgaaagaatggcattaaagcatttggtatacagtaggtgctcaataaattgctagtgatttttactcaaaaaaaaaaaaaaaaaa

SEQ ID NO: 59807 - DNA, 1818 bp, Homo sapiens
actcattgcaccttcctgccaccccaggcagtgtctgggccctcagctccccctccctccacctaccccctcacacccaccactacgaccccacgggatacccagcccagacggaggaaacaccgagcctagagacatgagagttggaggagcattccaccttctactcgtgtgcctgagcccagcactgctgtctgctgtgcggatcaacggggatggacaggaggtcctgtacctggcagaaggtgataatgtgaggctgggctgcccctacgtcctggaccctgaggactatggtcccaatgggctggacatcgagtggatgcaggtcaactcagaccccgcccaccaccgagagaacgtgttccttagttaccaggacaagaggatcaaccatggcagccttccccatctgcagcagagggtccgctttgcagcctcagacccaagccagtacgatgcctccatcaacctcatgaacctgcaggtatctgatacagccacttatgagtgccgggtgaagaagaccaccatggccacccggaaggtcattgtcactgtccaagcacgacctgcagtgcccatgtgctggacagagggccacatgacatatggcaacgatgtggtgctgaagtgctatgccagtgggggctcccagcccctctcctacaagtgggccaagatcagtgggcaccattacccctatcgagctgggtcttacacctcccagcacagctaccactcagagctgtcctaccaggagtccttccacagctccataaaccaaggcctgaacaatggggacctggtgttgaaggatatctccagagcagatgatgggctgtatcagtgcacagtggccaacaacgtgggctacagtgtttgtgtggtggaggtgaaggtctcagactcccggcgtataggcgtgatcatcggcatcgtcctgggctctctgctcgcgctgggctgcctggccgtaggcatctgggggctcgtctgctgctgctgcgggggctccggggctggcggcgcccgcggtgccttcggctacggcaacggcggcggggtcggcggaggggcctgcggcgacttggctagtgagatcagagaggacgccgtggcgcccgggtgcaaggccagcgggcgcggcagccgcgtcacccacctcctggggtacccgacgcagaacgtcagccgctccctgcgccgcaagtacgcgcctcccccctgcggcggccccgaggacgtggccctggcgccctgcaccgccgccgccgcctgcgaagcgggcccctccccggtctacgtcaaggtcaagagcgcggagccggctgactgcgccgaggggccggtgcagtgcaagaacggcctcttggtgtgagcgcgcgcgccgggccgggctgcgccccagccaggaggagggcgcggggctctctgtctgcagctggggacacgtcggggctggggacgacctcgctcgccccaggctgccaggcggctgggggtgaaggcatttccctaaggaaatgcgtagggaggcagagcctcctccccaaaagtgggaaggggcgggcgagggcggaggaaggcgatcctgagccttctccgcacccccgggaccgaaggcttgggggagagggagggaggaggaggctgagtgtcctagagcggctgaggccggaggcctggtgtccccagcctaagcagagggccccgggggccgggtgggtgggggtctgtctggacgaattgttctgtgtgtgaggtctgagctctgaggcagcagtgttagcacaataaagaaacattgagacgtga

SEQ ID NO: 59808 - DNA, 1008 bp, Homo sapiens
ctgactaagtttctctggcttccctgaggctgcaggtgttaatctggggggccctgggccctgagccggcagcagaaatatgaggacccagagccttctcctcctgggggccctcctggctgtggggagtcagctgcctgctgtctttggcaggaagaagggagagaaatcggggggctgcccgccagatgatgggccctgcctcctatcggtgcctgaccagtgcgtggaagacagccagtgtcccttgaccaggaagtgctgctacagagcttgcttccgccagtgtgtccccagggtctctgtgaagctgggcagctgcccagaggaccaactgcgctgcctcagccccatgaaccacctgtgtcacaaggactcagactgctcgggcaaaaagcgatgctgccacagcgcctgcgggcgggattgccgggatcctgccagaggctaattctgatttaggatctgtggctctgcacctaagctggggaccaacggaaagagttcacgatgggaggcctggggccctgcccgctggacagcactatctctaccagcggtggttccagccttctgataatcactggcctgctgacacttccctgcaacccatccacccctggtttctcctcctgggagtcaaagtccatagcctgagctcggaggaaggcctctgtatcaccccagtactctgcaccactgccatacgagcttcccacccttcctaacgctttcacaccaatccgtacatgctgcttcctccaccaaaaatgcccaattcaggcagaccctgacctctccctcaggcagcccaaccatccagaatgaatattcttgcagagttttccaaacatcagtcattcacctctttcatgattttcaccatacctacaaaatagcaccatgataggttgcacgctgcctgtaccaccatttacttaatgttttctttaaatggctcacttttgtatataaataaattcatttcaaaagaaaattgatatcact

SEQ ID NO: 59809 - DNA, 2894 bp, Homo sapiens
agcctgcaaaaaccacagagggcaaagccagaaagatggaaaggcacccatgcagctcaccacttgcctcagggagaccctcttcacaggggcttctcaaaagacctccctatggtggttgggcattgcctccttcggggttccagagaagctgggctgcgccaatttgccgctgaacagccgccagaaggagctgtgcaagaggaaaccgtacctgctgccgagcatccgagagggcgcccggctgggcattcaggagtgcgggagccagttcagacacgagagatggaactgcatgatcaccgccgccgccactaccgccccgatgggcgccagccccctctttggctacgagctgagcagcggcaccaaagagacagcatttatttatgctgtgatggctgcaggcctggtgcattctgtgaccaggtcatgcagtgcaggcaacatgacagagtgttcctgtgacaccaccttgcagaacggcggctcagcaagtgaaggctggcactgggggggctgctccgatgatgtccagtatggcatgtggttcagcagaaagttcctagatttccccatcggaaacaccacgggcaaagaaaacaaagtactattagcaatgaacctacataacaatgaagctggaaggcaggctgtcgccaagttgatgtcagtagactgccgctgccacggagtttccggctcctgtgctgtgaaaacatgctggaaaaccatgtcttcttttgaaaagattggccatttgttgaaggataaatatgaaaacagtatccagatatcagacaaaacaaagaggaaaatgcgcaggagagaaaaagatcagaggaaaataccaatccataaggatgatctgctctatgttaataagtctcccaactactgtgtagaagataagaaactgggaatcccagggacacaaggcagagaatgcaaccgtacatcagagggtgcagatggctgcaacctcctctgctgtggccgaggttacaacacccatgtggtcaggcacgtggagaggtgtgagtgtaagttcatctggtgctgctatgtccgttgcaggaggtgtgaaagcatgactgatgtccacacttgcaagtaaccactccatccagccttgggcaagatgcctcagcaatatacaatggcattgcaaccagagaggtgcccatccctgtgcagcgctagtaaagttgactcttgcagtggaatccctagaaccttggacctgagagtttcccttacctgatcgacatattttcctttatctgatcaacccatcaatcatgtggatttcttgggattctaatgttgaaaaggtttatattcaccttttgatgatttggggaatatatattgacatacaaggaagataatctgtttcctaagcaagaaataacaggaaagatcccttatgccaggaggcctgccatactcaggataagatccttgaatatggaacttagttacaggactcaataatggtgggtgaacattagtcatttttaaaagacacctcttatagcaataaggagacattaacatgaatctcatttattctctcagtattttaactgaagaaattatactgtttgtgtgtggatagaagatgttgaaaagttaacataagcattgggtgctgacttaccctttcatgtacttccaaagaaaggtaatcaaaaagaatcttcttaagtgatataatatccctaaaaaaatgatcattacagatgtttagtgacaaagaatcaatatgtaaaaagtataatgaatgatttagattttaagtgccttttcactgggagaatctggaaaaacctccataaggtatatagcaatctttgatctttagattcatacttttatcacagatcagtttcaactgttaaaaacccacctctgagatactggggggaggatcctgaaacatgcgggaaaaggagaggtaaacagtggaggtaaaaatataatttcatacattgtaaagaaaagcaccctttaaatgtgtaaagacagtgttttgtaaagaattttgtttaaaaagtttctattttgtaaatacagtacttaagttatatgatttatattaaaacatttattgacaaagcctaagagctaaggcagtaaaattatctcataaataatattagcttattttttttcatactattaatgctatttttttggacatcgaagagaatttaacttagcagttagttatatggatgtgtatttcttgctaaaatgacagttttatatgttatagattaaaatatgttgcaaaatatcaaaaatttgtgttatttcagcagtaagattaattgaattctcttttcacattagttatgcttaactcataaggttattataataaattatattagtaaaagtcttaactggaaaaaagaatctaaatcagaatagtgatcaatttgtggatttgatatcctggatatttattatattttatgtaatgctgcatttctatttgaatgttaagtggtctttcttgtttttaatattcatgcatgtatattcatcatattttacaaggttcctggtaaaaattacagggctctatttaaggatgtattttaatgtaaatgcttatgttttttatgaattgttaaatatttcagtattatatagaaaaaaatagatttttaaaattcagaatggacaaagagaatattcattttcttattaataagataaagaaatgtttccctgccccacagtcttcattctatttctctttaattttattcactgaggcagagaaacaatttttgaaaaagagcaaacccatggaaaatgtctcagatctaatattaaaatcaagactaagcatttaactgtgaaaaaaaaaaaaaaaaaaa

SEQ ID NO: 59810 - DNA, 3132 bp, Homo sapiens
cccgcatctcctgcacatctccacccctgcgcaggaggagatccccaggctgctctctccatctctcctacagctccctgcaaacgagggggaagctgctgagagtccctatcactgctggccttttaatgttgtatgcaaggaggaagagggcgagggataacttggtgctggacaactgacctgcggcccgaagggcctctggggagggggtgcaaaagaggagcggctgggctgggggactccatgcgggggcgatggacagggcggcgctcctgggactggcccgcttgtgcgcgctgtgggcagccctgctcgtgctgttcccctacggagcccaaggaaactggatgtggttgggcattgcctccttcggggttccagagaagctgggctgcgccaatttgccgctgaacagccgccagaaggagctgtgcaagaggaaaccgtacctgctgccgagcatccgagagggcgcccggctgggcattcaggagtgcgggagccagttcagacacgagagatggaactgcatgatcaccgccgccgccactaccgccccgatgggcgccagccccctctttggctacgagctgagcagcggcaccaaagagacagcatttatttatgctgtgatggctgcaggcctggtgcattctgtgaccaggtcatgcagtgcaggcaacatgacagagtgttcctgtgacaccaccttgcagaacggcggctcagcaagtgaaggctggcactgggggggctgctccgatgatgtccagtatggcatgtggttcagcagaaagttcctagatttccccatcggaaacaccacgggcaaagaaaacaaagtactattagcaatgaacctacataacaatgaagctggaaggcaggctgtcgccaagttgatgtcagtagactgccgctgccacggagtttccggctcctgtgctgtgaaaacatgctggaaaaccatgtcttcttttgaaaagattggccatttgttgaaggataaatatgaaaacagtatccagatatcagacaaaacaaagaggaaaatgcgcaggagagaaaaagatcagaggaaaataccaatccataaggatgatctgctctatgttaataagtctcccaactactgtgtagaagataagaaactgggaatcccagggacacaaggcagagaatgcaaccgtacatcagagggtgcagatggctgcaacctcctctgctgtggccgaggttacaacacccatgtggtcaggcacgtggagaggtgtgagtgtaagttcatctggtgctgctatgtccgttgcaggaggtgtgaaagcatgactgatgtccacacttgcaagtaaccactccatccagccttgggcaagatgcctcagcaatatacaatggcattgcaaccagagaggtgcccatccctgtgcagcgctagtaaagttgactcttgcagtggaatccctagaaccttggacctgagagtttcccttacctgatcgacatattttcctttatctgatcaacccatcaatcatgtggatttcttgggattctaatgttgaaaaggtttatattcaccttttgatgatttggggaatatatattgacatacaaggaagataatctgtttcctaagcaagaaataacaggaaagatcccttatgccaggaggcctgccatactcaggataagatccttgaatatggaacttagttacaggactcaataatggtgggtgaacattagtcatttttaaaagacacctcttatagcaataaggagacattaacatgaatctcatttattctctcagtattttaactgaagaaattatactgtttgtgtgtggatagaagatgttgaaaagttaacataagcattgggtgctgacttaccctttcatgtacttccaaagaaaggtaatcaaaaagaatcttcttaagtgatataatatccctaaaaaaatgatcattacagatgtttagtgacaaagaatcaatatgtaaaaagtataatgaatgatttagattttaagtgccttttcactgggagaatctggaaaaacctccataaggtatatagcaatctttgatctttagattcatacttttatcacagatcagtttcaactgttaaaaacccacctctgagatactggggggaggatcctgaaacatgcgggaaaaggagaggtaaacagtggaggtaaaaatataatttcatacattgtaaagaaaagcaccctttaaatgtgtaaagacagtgttttgtaaagaattttgtttaaaaagtttctattttgtaaatacagtacttaagttatatgatttatattaaaacatttattgacaaagcctaagagctaaggcagtaaaattatctcataaataatattagcttattttttttcatactattaatgctatttttttggacatcgaagagaatttaacttagcagttagttatatggatgtgtatttcttgctaaaatgacagttttatatgttatagattaaaatatgttgcaaaatatcaaaaatttgtgttatttcagcagtaagattaattgaattctcttttcacattagttatgcttaactcataaggttattataataaattatattagtaaaagtcttaactggaaaaaagaatctaaatcagaatagtgatcaatttgtggatttgatatcctggatatttattatattttatgtaatgctgcatttctatttgaatgttaagtggtctttcttgtttttaatattcatgcatgtatattcatcatattttacaaggttcctggtaaaaattacagggctctatttaaggatgtattttaatgtaaatgcttatgttttttatgaattgttaaatatttcagtattatatagaaaaaaatagatttttaaaattcagaatggacaaagagaatattcattttcttattaataagataaagaaatgtttccctgccccacagtcttcattctatttctctttaattttattcactgaggcagagaaacaatttttgaaaaagagcaaacccatggaaaatgtctcagatctaatattaaaatcaagactaagcatttaactgtgaaaaaaaaaaaaaaaaaaa

SEQ ID NO: 59811 - DNA, 607 bp, Homo sapiens
aagcacatgaacatgaagccggccactgcctctgctctgctcctgctcctgctgggcctggcctggacccaggggagccacggctggggtgcggacgcgtcatcactgcagaaacgtgcaggcagagccgatcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagcatctttctgtacctcctccctttggtgacctgaagtcactgtgacagttctccaggaaggaggagcttcctacttttgagtttctctgtggaaataaaacatgaatcttgtttccctaaaaaaaaaa

SEQ ID NO: 59812 - DNA, 1982 bp, Homo sapiens
tctgagaagcccaggcagttgaggacaggagagagaaggctgcagacccagagggagggaggacagggagtcggaaggaggaggacagaggagggcacagagacgcagagcaagggcggcaaggaggagaccctggtgggaggaagacactctggagagagagggggctgggcagagatgaagttccaggggcccctggcctgcctcctgctggccctctgcctgggcagtggggaggctggccccctgcagagcggagaggaaagcactgggacaaatattggggaggcccttggacatggcctgggagacgccctgagcgaaggggtgggaaaggccattggcaaagaggccggaggggcagctggctctaaagtcagtgaggcccttggccaagggaccagagaagcagttggcactggagtcaggcaggttccaggctttggcgcagcagatgctttgggcaacagggtcggggaagcagcccatgctctgggaaacactgggcacgagattggcagacaggcagaagatgtcattcgacacggagcagatgctgtccgcggctcctggcagggggtgcctggccacaatggtgcttgggaaacttctggaggccatggcatctttggctctcaaggtggccttggaggccagggccagggcaatcctggaggtctggggactccgtgggtccacggataccccggaaactcagcaggcagctttggaatgaatcctcagggagctccctggggtcaaggaggcaatggagggccaccaaactttgggaccaacactcagggagctgtggcccagcctggctatggttcagtgagagccagcaaccagaatgaagggtgcacgaatcccccaccatctggctcaggtggaggctccagcaactctgggggaggcagcggctcacagtcgggcagcagtggcagtggcagcaatggtgacaacaacaatggcagcagcagtggtggcagcagcagtggcagcagcagtggcggcagcagtggcggcagcagtggtggcagcagtggcaacagtggtggcagcagaggtgacagcggcagtgagtcctcctggggatccagcaccggctcctcctccggcaaccacggtgggagcggcggaggaaatggacataaacccgggtgtgaaaagccagggaatgaagcccgcgggagcggggaatctgggattcagaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagccgatcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagcatctttctgtacctcctccctttggtgacctgaagtcactgtgacagttctccaggaaggaggagcttcctacttttgagtttctctgtggaaataaaacatgaatcttgtttccctaaaaaaaaaaaaaaaaaaaaaaaaaaaaaaaaaaaaaaaaaaaaaaaaaaaaaaaa

SEQ ID NO: 59813 - DNA, 3614 bp, Homo sapiens
gctacaagatgaccactgaggattacaagaagctgtgagtatgcaacgccaggcaccctacaatatcaggcgcagctctacatcaggggacaccgaggaggaggaggaggaggaggtggtgccattctcctcagatgaacagaaacggaggtcagaggctgcaagcggtgttctgaggaggacagctccccgggagcactcctacgtcctgtcagcggccaagaagagcactggcagtcctacccaggagacacaggcaccgtttatcgcgaagagggtggaggtggtggaagaggacgggccttctgagaagagccaggacccacctgctctggcaagatccactcctggctcaaacagctcaagaggtgaggaaattgtccgcctgcagatcctgacacccagggcaggactccgcctggtggccccagacgtggaaggcatgagctccagtgccacttcagtctctgctgtccctgctgataggaagagcaacagcacagcagcccaggaggatgcaaaggcagacccaaagggggccttggctgattgtgaggggaaggatgtacccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagtagcgtgttgactgattttgaggggaaggatgtggccaccaaggtcggagaggcctggcaggacaggcctagagccccaagaggtggccaaggagacccagctgtacccactcagcaacctgcagatcccagtaccccagaacagcagaacagccccagcggatctgagcaattcgtcagacgagagagctgcaccagcagggtgaggagcccctcgagctgcatggtcactgttactgtcactgccacatctgagcagcctcacatttatattccagcccccgcaagtgaattggactccagctctaccaccaaagggattctcttcgtgaaggagtacgtgaatgctagtgaagtgtcttctgggaagccagtatctgcacgctatagcaacgtcagcagcattgaggactcattcgccatggagaagaagcctccatgtggcagcactccatactctgagaggacaactggagggatctgtacttactgcaaccgtgagatccgagactgtccaaagattaccctagaacatcttggtatctgctgccatgaatattgctttaagtgtgggatttgcagtaaaccgatgggcgatctcctggatcagatcttcattcaccgtgacaccattcactgtgggaaatgctatgagaagctcttctagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctatttttttaaatttccatacacttgtaaaagtagttagttgcttttgattgagttatatagcagtttttcatttggtcttccactcaccgttcactatatttgagtgttcccttacaggtatgttggcatgtgttggaaaatttacacaattaggtttaaattcagtaggatgtgattttgggggtggactgatcaaagtgatatctgtgtctgttggaatcttgatagctgattaatttgccctcaattctgctccctgaacttcacacataaatcttcccaagtgggttttagggtgtatagatcccagcaggattaaggaagtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagagggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccccgttggtgagaaggtgcctatccccctgagtcctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatgctaaaatatcaaaaaaaaaa

SEQ ID NO: 59814 - protein, 2277 aa, Homo sapiens
MFTYIKIITSGDSDNITHVWNEDDGQTLSPSSLAAQLLILENFEDALLNISANSPYIPYLACVRNVTDSLARGSPENLRLLQSTIRFKKSFLRNGSYEDYFPPVPEVLKSKLSQLRNLTELLCESETFSLIEKSCQLSDMSFGSLCEESEFDLQLLEAAELGTEIAASLLYHDNVISKKVRDLLTGDPSKINLNMDQFLEQALQMNYLENITQLIPIIEAMLHVNNSADASEKPGQLLEMFKNVEELKEDLRRTTGMSNRTIDKLLAIPIPDNRAEIISQVFWLHSCDTNITTPKLEDAMKEFCNLSLSERSRQSYLIGLTLLHYLNIYNFTYKVFFPRKDQKPVEKMMELFIRLKEILNQMASGTHPLLDKMRSLKQMHLPRSVPLTQAMYRSNRMNTPQGSFSTISQALCSQGITTEYLTAMLPSSQRPKGNHTKDFLTYKLTKEQIASKYGIPINSTPFCFSLYKDIINMPAGPVIWAFLKPMLLGRILYAPYNPVTKAIMEKSNVTLRQLAELREKSQEWMDKSPLFMNSFHLLNQAIPMLQNTLRNPFVQVFVKFSVGLDAVELLKQIDELDILRLKLENNIDIIDQLNTLSSLTVNISSCVLYDRIQAAKTIDEMEREAKRLYKSNELFGSVIFKLPSNRSWHRGYDSGNVFLPPVIKYTIRMSLKTAQTTRSLRTKIWAPGPHNSPSHNQIYGRAFIYLQDSIERAIIELQTGRNSQEIAVQVQAIPYPCFMKDNFLTSVSYSLPIVLMVAWVVFIAAFVKKLVYEKDLRLHEYMKMMGVNSCSHFFAWLIESVGFLLVTIVILIIILKFGNILPKTNGFILFLYFSDYSFSVIAMSYLISVFFNNTNIAALIGSLIYIIAFFPFIVLVTVENELSYVLKVFMSLLSPTAFSYASQYIARYEEQGIGLQWENMYTSPVQDDTTSFGWLCCLILADSFIYFLIAWYVRNVFPGTYGMAAPWYFPILPSYWKERFGCAEVKPEKSNGLMFTNIMMQNTNPSASPEYMFSSNIEPEPKDLTVGVALHGVTKIYGSKVAVDNLNLNFYEGHITSLLGPNGAGKTTTISMLTGLFGASAGTIFVYGKDIKTDLHTVRKNMGVCMQHDVLFSYLTTKEHLLLYGSIKVPHWTKKQLHEEVKRTLKDTGLYSHRHKRVGTLSGGMKRKLSISIALIGGSRVVILDEPSTGVDPCSRRSIWDVISKNKTARTIILSTHHLDEAEVLSDRIAFLEQGGLRCCGSPFYLKEAFGDGYHLTLTKKKSPNLNANAVCDTMAVTAMIQSHLPEAYLKEDIGGELVYVLPPFSTKVSGAYLSLLRALDNGMGDLNIGCYGISDTTVEEVFLNLTKESQKNSAMSLEHLTQKKIGNSNANGISTPDDLSVSSSNFTDRDDKILTRGERLDGFGLLLKKIMAILIKRFHHTRRNWKGLIAQVILPIVFVTTAMGLGTLRNSSNSYPEIQISPSLYGTSEQTAFYANYHPSTEALVSAMWDFPGIDNMCLNTSDLQCLNKDSLEKWNTSGEPITNFGVCSCSENVQECPKFNYSPPHRRTYSSQVIYNLTGQRVENYLISTANEFVQKRYGGWSFGLPLTKDLRFDITGVPANRTLAKVWYDPEGYHSLPAYLNSLNNFLLRVNMSKYDAARHGIIMYSHPYPGVQDQEQATISSLIDILVALSILMGYSVTTASFVTYVVREHQTKAKQLQHISGIGVTCYWVTNFIYDMVFYLVPVAFSIGIIAIFKLPAFYSENNLGAVSLLLLLFGYATFSWMYLLAGLFHETGMAFITYVCVNLFFGINSIVSLSVVYFLSKEKPNDPTLELISETLKRIFLIFPQFCFGYGLIELSQQQSVLDFLKAYGVEYPNETFEMNKLGAMFVALVSQGTMFFSLRLLINESLIKKLRLFFRKFNSSHVRETIDEDEDVRAERLRVESGAAEFDLVQLYCLTKTYQLIHKKIIAVNNISIGIPAGECFGLLGVNGAGKTTIFKMLTGDIIPSSGNILIRNKTGSLGHVDSHSSLVGYCPQEDALDDLVTVEEHLYFYARVHGIPEKDIKETVHKLLRRLHLMPFKDRATSMCSYGTKRKLSTALALIGKPSILLLDEPSSGMDPKSKRHLWKIISEEVQNKCSVILTSHSMEECEALCTRLAIMVNGKFQCIGSLQHIKSRFGRGFTVKVHLKNNKVTMETLTKFMQLHFPKTYLKDQHLSMLEYHVPVTAGGVANIFDLLETNKTALNITNFLVSQTTLEEVFINFAKDQKSYETADTSSQGSTISVDSQDDQMES

SEQ ID NO: 59815 - protein, 2595 aa, Homo sapiens
MASLFHQLQILVWKNWLGVKRQPLWTLVLILWPVIIFIILAITRTKFPPTAKPTCYLAPRNLPSTGFFPFLQTLLCDTDSKCKDTPYGPQDLLRRKGIDDALFKDSEILRKSSNLDKDSSLSFQSTQVPERRHASLATVFPSPSSDLEIPGTYTFNGSQVLARILGLEKLLKQNSTSEDIRRELCDSYSGYIVDDAFSWTFLGRNVFNKFCLSNMTLLESSLQELNKQFSQLSSDPNNQKIVFQEIVRMLSFFSQVQEQKAVWQLLSSFPNVFQNDTSLSNLFDVLRKANSVLLVVQKVYPRFATNEGFRTLQKSVKHLLYTLDSPAQGDSDNITHVWNEDDGQTLSPSSLAAQLLILENFEDALLNISANSPYIPYLACVRNVTDSLARGSPENLRLLQSTIRFKKSFLRNGSYEDYFPPVPEVLKSKLSQLRNLTELLCESETFSLIEKSCQLSDMSFGSLCEESEFDLQLLEAAELGTEIAASLLYHDNVISKKVRDLLTGDPSKINLNMDQFLEQALQMNYLENITQLIPIIEAMLHVNNSADASEKPGQLLEMFKNVEELKEDLRRTTGMSNRTIDKLLAIPIPDNRAEIISQVFWLHSCDTNITTPKLEDAMKEFCNLSLSERSRQSYLIGLTLLHYLNIYNFTYKVFFPRKDQKPVEKMMELFIRLKEILNQMASGTHPLLDKMRSLKQMHLPRSVPLTQAMYRSNRMNTPQGSFSTISQALCSQGITTEYLTAMLPSSQRPKGNHTKDFLTYKLTKEQIASKYGIPINSTPFCFSLYKDIINMPAGPVIWAFLKPMLLGRILYAPYNPVTKAIMEKSNVTLRQLAELREKSQEWMDKSPLFMNSFHLLNQAIPMLQNTLRNPFVQVFVKFSVGLDAVELLKQIDELDILRLKLENNIDIIDQLNTLSSLTVNISSCVLYDRIQAAKTIDEMEREAKRLYKSNELFGSVIFKLPSNRSWHRGYDSGNVFLPPVIKYTIRMSLKTAQTTRSLRTKIWAPGPHNSPSHNQIYGRAFIYLQDSIERAIIELQTGRNSQEIAVQVQAIPYPCFMKDNFLTSVSYSLPIVLMVAWVVFIAAFVKKLVYEKDLRLHEYMKMMGVNSCSHFFAWLIESVGFLLVTIVILIIILKFGNILPKTNGFILFLYFSDYSFSVIAMSYLISVFFNNTNIAALIGSLIYIIAFFPFIVLVTVENELSYVLKVFMSLLSPTAFSYASQYIARYEEQGIGLQWENMYTSPVQDDTTSFGWLCCLILADSFIYFLIAWYVRNVFPGTYGMAAPWYFPILPSYWKERFGCAEVKPEKSNGLMFTNIMMQNTNPSASPEYMFSSNIEPEPKDLTVGVALHGVTKIYGSKVAVDNLNLNFYEGHITSLLGPNGAGKTTTISMLTGLFGASAGTIFVYGKDIKTDLHTVRKNMGVCMQHDVLFSYLTTKEHLLLYGSIKVPHWTKKQLHEEVKRTLKDTGLYSHRHKRVGTLSGGMKRKLSISIALIGGSRVVILDEPSTGVDPCSRRSIWDVISKNKTARTIILSTHHLDEAEVLSDRIAFLEQGGLRCCGSPFYLKEAFGDGYHLTLTKKKSPNLNANAVCDTMAVTAMIQSHLPEAYLKEDIGGELVYVLPPFSTKVSGAYLSLLRALDNGMGDLNIGCYGISDTTVEEVFLNLTKESQKNSAMSLEHLTQKKIGNSNANGISTPDDLSVSSSNFTDRDDKILTRGERLDGFGLLLKKIMAILIKRFHHTRRNWKGLIAQVILPIVFVTTAMGLGTLRNSSNSYPEIQISPSLYGTSEQTAFYANYHPSTEALVSAMWDFPGIDNMCLNTSDLQCLNKDSLEKWNTSGEPITNFGVCSCSENVQECPKFNYSPPHRRTYSSQVIYNLTGQRVENYLISTANEFVQKRYGGWSFGLPLTKDLRFDITGVPANRTLAKVWYDPEGYHSLPAYLNSLNNFLLRVNMSKYDAARHGIIMYSHPYPGVQDQEQATISSLIDILVALSILMGYSVTTASFVTYVVREHQTKAKQLQHISGIGVTCYWVTNFIYDMVFYLVPVAFSIGIIAIFKLPAFYSENNLGAVSLLLLLFGYATFSWMYLLAGLFHETGMAFITYVCVNLFFGINSIVSLSVVYFLSKEKPNDPTLELISETLKRIFLIFPQFCFGYGLIELSQQQSVLDFLKAYGVEYPNETFEMNKLGAMFVALVSQGTMFFSLRLLINESLIKKLRLFFRKFNSSHVRETIDEDEDVRAERLRVESGAAEFDLVQLYCLTKTYQLIHKKIIAVNNISIGIPAGECFGLLGVNGAGKTTIFKMLTGDIIPSSGNILIRNKTGSLGHVDSHSSLVGYCPQEDALDDLVTVEEHLYFYARVHGIPEKDIKETVHKLLRRLHLMPFKDRATSMCSYGTKRKLSTALALIGKPSILLLDEPSSGMDPKSKRHLWKIISEEVQNKCSVILTSHSMEECEALCTRLAIMVNGKFQCIGSLQHIKSRFGRGFTVKVHLKNNKVTMETLTKFMQLHFPKTYLKDQHLSMLEYHVPVTAGGVANIFDLLETNKTALNITNFLVSQTTLEEVFINFAKDQKSYETADTSSQGSTISVDSQDDQMES

SEQ ID NO: 59816 - protein, 385 aa, Homo sapiens
MKDEPRSTNLFMKLDSVFIWKEPFGLVLIIAPWNYPLNLTLVLLVGALAAGSCVVLKPSEISQGTEKVLAEVLPQYLDQSCFAVVLGGPQETGQLLEHKLDYIFFTGSPRVGKIVMTAATKHLTPVTLELGGKNPCYVDDNCDPQTVANRVAWFCYFNAGQTCVAPDYVLCSPEMQERLLPALQSTITRFYGDDPQSSPNLGRIINQKQFQRLRALLGCGRVAIGGQSNESDRYIAPTVLVDVQETEPVMQEEIFGPILPIVNVQSVDEAIKFINRQEKPLALYAFSNSSQVVNQMLERTSSGSFGGNEGFTYISLLSVPFGGVGHSGMGRYHGKFTFDTFSHHRTCLLAPSGLEKLKEIHYPPYTDWNQQLLRWGMGSQSCTLL

SEQ ID NO: 59817 - protein, 385 aa, Homo sapiens; identical to SEQ ID NO: 59816

SEQ ID NO: 59818 - protein, 663 aa, Homo sapiens
MGRYRIRVATGAWLFSGSYNRVQLWLVGTRGEAELELQLRPARGEEEEFDHDVAEDLGLLQFVRLRKHHWLVDDAWFCDRITVQGPGACAEVAFPCYRWVQGEDILSLPEGTARLPGDNALDMFQKHREKELKDRQQIYCWATWKEGLPLTIAADRKDDLPPNMRFHEEKRLDFEWTLKAGALEMALKRVYTLLSSWNCLEDFDQIFWGQKSALAEKVRQCWQDDELFSYQFLNGANPMLLRRSTSLPSRLVLPSGMEELRAQLEKELQNGSLFEADFILLDGIPANVIRGEKQYLAAPLVMLKMEPNGKLQPMVIQIQPPNPSSPTPTLFLPSDPPLAWLLAKSWVRNSDFQLHEIQYHLLNTHLVAEVIAVATMRCLPGLHPIFKFLIPHIRYTMEINTRARTQLISDGGIFDKAVSTGGGGHVQLLRRAAAQLTYCSLCPPDDLADRGLLGLPGALYAHDALRLWEIIARYVEGIVHLFYQRDDIVKGDPELQAWCREITEVGLCQAQDRGFPVSFQSQSQLCHFLTMCVFTCTAQHAAINQGQLDWYAWVPNAPCTMRMPPPTTKEDVTMATVMGSLPDVRQACLQMAISWHLSRRQPDMVPLGHHKEKYFSGPKPKAVLNQFRTDLEKLEKEITARNEQLDWPYEYLKPSCIENSVTI

SEQ ID NO: 59819 - protein, 701 aa, Homo sapiens
MATYKVRVATGTDLLSGTRDSISLTIVGTQGESHKQLLNHFGRDFATGAVGQYTVQCPQDLGELIIIRLHKERYAFFPKDPWYCNYVQICAPNGRIYHFPAYQWMDGYETLALREATGKTTADDSLPVLLEHRKEEIRAKQDFYHWRVFLPGLPSYVHIPSYRPPVRRHRNPNRPEWNGYIPGFPILINFKATKFLNLNLRYSFLKTASFFVRLGPMALAFKVRGLLDCKHSWKRLKDIRKIFPGKKSVVSEYVAEHWAEDTFFGYQYLNGVNPGLIRRCTRIPDKFPVTDDMVAPFLGEGTCLQAELEKGNIYLADYRIMEGIPTVELSGRKQHHCAPLCLLHFGPEGKMMPIAIQLSQTPGPDCPIFLPSDSEWDWLLAKTWVRYAEFYSHEAIAHLLETHLIAEAFCLALLRNLPMCHPLYKLLIPHTRYTVQINSIGRAVLLNEGGLSAKGMSLGVEGFAGVMVRALSELTYDSLYLPNDFVERGVQDLPGYYYRDDSLAVWNALEKYVTEIITYYYPSDAAVEGDPELQSWVQEIFKECLLGRESSGFPRCLRTVPELIRYVTIVIYTCSAKHAAVNTGQMEFTAWMPNFPASMRNPPIQTKGLTTLETFMDTLPDVKTTCITLLVLWTLSREPDDRRPLGHFPDIHFVEEAPRRSIEAFRQRLNQISHDIRQRNKCLPIPYYYLDPVLIENSISI

SEQ ID NO: 59820 - protein, 711 aa, Homo sapiens
MAVYRLCVTTGPYLRAGTLDNISVTLVGTCGESPKQRLDRMGRDFAPGSVQKYKVRCTAELGELLLLRVHKERYAFFRKDSWYCSRICVTEPDGSVSHFPCYQWIEGYCTVELRPGTARTICQDSLPLLLDHRTRELRARQECYRWKIYAPGFPRMVDVNSFQEMESDKKFALTKTTTCVDQGDSSGNRYLPGFPMKIDIPSLMYMEPNVRYSATKTISLLFNAIPASLGMKLRGLLDRKGSWKKLDDMQNIFWCHKTFTTKYVTEHWCEDHFFGYQYLNGVNPVMLHCISSLPSKLPVTNDMVAPLLGQDTCLQTELERGNIFLADYWILAEAPTHCLNGRQQYVAAPLCLLWLSPQGALVPLAIQLSQTPGPDSPIFLPTDSEWDWLLAKTWVRNSEFLVHENNTHFLCTHLLCEAFAMATLRQLPLCHPIYKLLLPHTRYTLQVNTIARATLLNPEGLVDQVTSIGRQGLIYLMSTGLAHFTYTNFCLPDSLRARGVLAIPNYHYRDDGLKIWAAIESFVSEIVGYYYPSDASVQQDSELQAWTGEIFAQAFLGRESSGFPSRLCTPGEMVKFLTAIIFNCSAQHAAVNSGQHDFGAWMPNAPSSMRQPPPQTKGTTTLKTYLDTLPEVNISCNNLLLFWLVSQEPKDQRPLGTYPDEHFTEEAPRRSIAAFQSRLAQISRDIQERNQGLALPYTYLDPPLIENSVSI

SEQ ID NO: 59821 - protein, 252 aa, Homo sapiens
MRAPLLPPAPVVLSLLILGSGHYAAGLDLNDTYSGKREPFSGDHSADGFEVTSRSEMSSGSEISPVSEMPSSSEPSSGADYDYSEEYDNEPQIPGYIVDDSVRVEQVVKPPQNKTESENTSDKPKRKKKGGKNGKNRRNRKKKNPCNAEFQNFCIHGECKYIEHLEAVTCKCQQEYFGERCGEKSMKTHSMIDSSLSKIALAAIAAFMSAVILTAVAVITVQLRRQYVRKYEGEAEERKKLRQENGNVHAIA

SEQ ID NO: 59822 - protein, 507 aa, Homo sapiens
MCTKTIPVLWGCFLLWNLYVSSSQTIYPGIKARITQRALDYGVQAGMKMIEQMLKEKKLPDLSGSESLEFLKVDYVNYNFSNIKISAFSFPNTSLAFVPGVGIKALTNHGTANISTDWGFESPLFQDTGGADLFLSGVYFTGIIILTRNDFGHPTLKLQDCYAQLSHAHVSFSGELSVLYNSFAEPMEKPILKNLNEMLCPIIASEVKALNANLSTLEVLTKIDNYTLLDYSLISSPEITENYLDLNLKGVFYPLENLTDPPFSPVPFVLPERSNSMLYIGIAEYFFKSASFAHFTAGVFNVTLSTEEISNHFVQNSQGLGNVLSRIAEIYILSQPFMVRIMATEPPIINLQPGNFTLDIPASIMMLTQPKNSTVETIVSMDFVASTSVGLVILGQRLVCSLSLNRFRLALPESNRSNIEVLRFENILSSILHFGVLPLANAKLQQGFPLSNPHKFLFVNSDIEVLEGFLLISTDLKYETSSKQQPSFHVWEGLNLISRQWRGKSAP

SEQ ID NO: 59823 - protein, 255 aa, Homo sapiens
MLGIWHTVPSCRGEDAKGKDCCWYEAALRDGNPIIVYLHGSAEHRAASHRLKLVKVLSDGGFHVLSVDYRGFGDSTGKPTEEGLTTDAICVYEWTKARSGITPVCLWGHSLGTGVATNAAKVLEEKGCPVDAIVLEAPFTNMWVASINYPLLKIYRNIPGFLRTLMDALRKDKIIFPNDENVKFLSSPLLILHGEDDRTVPLEYGKKLYEIARNAYRNKERVKMVIFPPGFQHNLLCKSPTLLITVRDFLSKQWS

SEQ ID NO: 59824 - protein, 579 aa, Homo sapiens
MCDQQQIQCRLPLQQCCVKGPSFCSSQSPFAQSQVVVQAPCEMQIVDCPASCPVQVCQVSDQAPCQSQTTQVKCQSKTKQVKGQAQCQSKTTQVKGQAASQSQTSSVQSQAPCQSEVSYVQCEASQPVQTCFVECAPVCYTETCYVECPVQNYVPCPAPQPVQMYRGRPAVCQPQGRFSTQCQYQGSYSSCGPQFQSRATCNNYTPQFQLRPSYSSCFPQYRSRTSFSPCVPQCQTQGSYGSFTEQHRSRSTSRCLPPPRRLQLFPRSCSPPRRFEPCSSSYLPLRPSEGFPNYCTPPRRSEPIYNSRCPRRPISSCSQRRGPKCRIEISSPCCPRQVPPQRCPVEIPPIRRRSQSCGPQPSWGASCPELRPHVEPRPLPSFCPPRRLDQCPESPLQRCPPPAPRPRLRPEPCISLEPRPRPLPRQLSEPCLYPEPLPALRPTPRPVPLPRPGQCEIPEPRPCLQPCEHPEPCPRPEPIPLPAPCPSPEPCRETWRSPSPCWGPNPVPYPGDLGCHESSPHRLDTEAPYCGPSSYNQGQESGAGCGPGDVFPERRGQDGHGDQGNAFAGVKGEAKSAYF

SEQ ID NO: 59825 - protein, 747 aa, Homo sapiens
MFGGPGPGVLGAQGMAGPLRGRVEELKLPWWRESSPLVLRHSEAARLAADALLERGEAAYLRVISEERELPFLSALDVDYMTSHVRGGPELSEAQGQEASGPDRLSLLSEVTSGTYFPMASDIDPPDLDLGWPEVPQATGFSPTQAVVHFQRDKAKNIKDLLRFLFSQAHTVVAVVMDIFTDMELLCDLMEASSRRGVPVYLLLAQEHLRHFLEMCYKMDLNGEHLPNMRVRSTCGDTYCSKAGRRFTGQALEKFVLIDCEQVVAGSYSFTWLCSQAHTSMVLQLRGRIVEDFDREFRCLYAESQPVEGFCGGEDPLSPRALRPPPVALAFRPDVPSPTSSLPSSTSLSSIKQSPLMGRSSYLALPGGGDCSDTGVVSSSLGPARREASGQPSLHRQLSDPNHGSPPGLYRANLGKLGAYPWSQSSPALNHNSTSPLTLAVGSPLLPRSRPLLQFHRGAPALSRFPENGLPGSQEPSPLRGRWVPGTTLETVEEKEKKASPSQSRGQLDLLVPFPRAREVGDPDSGVTPNSGPLRPGEQAPEDRRLSPSQADSQLDLLSRALGTGGAPELGSLRPGDRALEDRRLSLNQSRGQSDLLMQYPKAQGSRVPLETNSSARPARRAPDERRQTLGHSQLDLITKFGPFRGEGPGPNGLPISSPARTAGAGSGDEKRLTLGHSKLDLITKYHQLHGARQGTEPGGPKGGHLNGGNSDLVRDEKRLTLGHSKLDLITKYNKSKFKQLRSRFES

SEQ ID NO: 59826 - protein, 328 aa, Homo sapiens
MTVEKEAPDAHFTVDKQNISLWPREPPPKSGPSLVPGKTPTVRAALICLTLVLVASVLLQAVLYPRFMGTISDVKTNVQLLKGRVDNISTLDSEIKKNSDGMEAAGVQIQMVNESLGYVRSQFLKLKTSVEKANAQIQILTRSWEEVSTLNAQIPELKSDLEKASALNTKIRALQGSLENMSKLLKRQNDILQVVSQGWKYFKGNFYYFSLIPKTWYSAEQFCVSRNSHLTSVTSESEQEFLYKTAGGLIYWIGLTKAGMEGDWSWVDDTPFNKVQSARFWIPGEPNNAGNNEHCGNIKAPSLQAWNDAPCDKTFLFICKRPYVPSEP

SEQ ID NO: 59827 - protein, 836 aa, Homo sapiens
MAGLNCGVSIALLGVLLLGAARLPRGAEAFEIALPRESNITVLIKLGTPTLLAKPCYIVISKRHITMLSIKSGERIVFTFSCQSPENHFVIEIQKNIDCMSGPCPFGEVQLQPSTSLLPTLNRTFIWDVKAHKSIGLELQFSIPRLRQIGPGESCPDGVTHSISGRIDATVVRIGTFCSNGTVSRIKMQEGVKMALHLPWFHPRNVSGFSIANRSSIKRLCIIESVFEGEGSATLMSANYPEGFPEDELMTWQFVVPAHLRASVSFLNFNLSNCERKEERVEYYIPGSTTNPEVFKLEDKQPGNMAGNFNLSLQGCDQDAQSPGILRLQFQVLVQHPQNESNKIYVVDLSNERAMSLTIEPRPVKQSRKFVPGCFVCLESRTCSSNLTLTSGSKHKISFLCDDLTRLWMNVEKTISCTDHRYCQRKSYSLQVPSDILHLPVELHDFSWKLLVPKDRLSLVLVPAQKLQQHTHEKPCNTSFSYLVASAIPSQDLYFGSFCPGGSIKQIQVKQNISVTLRTFAPSFQQEASRQGLTVSFIPYFKEEGVFTVTPDTKSKVYLRTPNWDRGLPSLTSVSWNISVPRDQVACLTFFKERSGVVCQTGRAFMIIQEQRTRAEEIFSLDEDVLPKPSFHHHSFWVNISNCSPTSGKQLDLLFSVTLTPRTVDLTVILIAAVGGGVLLLSALGLIICCVKKKKKKTNKGPAVGIYNDNINTEMPRQPKKFQKGRKDNDSHVYAVIEDTMVYGHLLQDSSGSFLQPEVDTYRPFQGTMGVCPPSPPTICSRAPTAKLATEEPPPRSPPESESEPYTFSHPNNGDVSSKDTDIPLLNTQEPMEPAE

SEQ ID NO: 59828 - protein, 916 aa, Homo sapiens
MTAGAGVLLLLLSLSGALRAHNEDLTTRETCKAGFSEDDYTALISQNILEGEKLLQVKFSSCVGTKGTQYETNSMDFKVGADGTVFATRELQVPSEQVAFTVTAWDSQTAEKWDAVVRLLVAQTSSPHSGHKPQKGKKVVALDPSPPPKDTLLPWPQHQNANGLRRRKRDWVIPPINVPENSRGPFPQQLVRIRSDKDNDIPIRYSITGVGADQPPMEVFSIDSMSGRMYVTRPMDREEHASYHLRAHAVDMNGNKVENPIDLYIYVIDMNDNRPEFINQVYNGSVDEGSKPGTYVMTVTANDADDSTTANGMVRYRIVTQTPQSPSQNMFTINSETGDIVTVAAGLDREKVQQYTVIVQATDMEGNLNYGLSNTATAIITVTDVNDNPPEFTASTFAGEVPENRVETVVANLTVMDRDQPHSPNWNAVYRIISGDPSGHFSVRTDPVTNEGMVTVVKAVDYELNRAFMLTVMVSNQAPLASGIQMSFQSTAGVTISIMDINEAPYFPSNHKLIRLEEGVPPGTVLTTFSAVDPDRFMQQAVRYSKLSDPASWLHINATNGQITTAAVLDRESLYTKNNVYEATFLAADNGIPPASGTGTLQIYLIDINDNAPELLPKEAQICEKPNLNAINITAADADVDPNIGPYVFELPFVPAAVRKNWTITRLNGDYAQLSLRILYLEAGMYDVPIIVTDSGNPPLSNTSIIKVKVCPCDDNGDCTTIGAVAAAGLGTGAIVAILICILILLTMVLLFVMWMKRREKERHTKQLLIDPEDDVRDNILKYDEEGGGEEDQDYDLSQLQQPEAMGHVPSKAPGVRRVDERPVGAEPQYPIRPMVPHPGDIGDFINEGLRAADNDPTAPPYDSLLVFDYEGSGSTAGSVSSLNSSSSGDQDYDYLNDWGPRFKKLADMYGGGEED

SEQ ID NO: 59829 - protein, 529 aa, Homo sapiens
MGSSRAPWMGRVGGHGMMALLLAGLLLPGTLAKSIGTFSDPCKDPTRITSPNDPCLTGKGDSSGFSSYSGSSSSGSSISSARSSGGGSSGSSSGSSIAQGGSAGSFKPGTGYSQVSYSSGSGSSLQGASGSSQLGSSSSHSGSSGSHSGSSSSHSSSSSSFQFSSSSFQVGNGSALPTNDNSYRGILNPSQPGQSSSSSQTFGVSSSGQSVSSNQRPCSSDIPDSPCSGGPIVSHSGPYIPSSHSVSGGQRPVVVVVDQHGSGAPGVVQGPPCSNGGLPGKPCPPITSVDKSYGGYEVVGGSSDSYLVPGMTYSKGKIYPVGYFTKENPVKGSPGVPSFAAGPPISEGKYFSSNPIIPSQSAASSAIAFQPVGTGGVQLCGGGSTGSKGPCSPSSSRVPSSSSISSSSGLPYHPCGSASQSPCSPPGTGSFSSSSSSQSSGKIILQPCGSKSSSSGHPCMSVSSLTLTGGPDGSPHPDPSAGAKPCGSSSAGKIPCRSIRDILAQVKPLGPQLADPEVFLPQGELLNSP

SEQ ID NO: 59830 - protein, 112 aa, Homo sapiens
MSYPVTSQPQCATTSCYQTQLSDWHTGLTDCCNDMPVCLCGTFAPLCLACRISDDFGECCCAPYLPGGLHSIRTGMRERYHIQGSVGHDWAALTFCLPCALCQMARELKIRE

SEQ ID NO: 59831 - protein, 1497 aa, Homo sapiens; identical to SEQ ID NO: 59347

SEQ ID NO: 59832 - protein, 98 aa, Homo sapiens
MIPGGLSEAKPATPEIQEIVDKVKPQLEEKTNETYGKLEAVQYKTQVVAGTNYYIKVRAGDNKYMHLKVFKSLPGQNEDLVLTGYQVDKNKDDELTGF

SEQ ID NO: 59833 - protein, 110 aa, Homo sapiens
MRFMTLLFLTALAGALVCAYDPEAASAPGSGNPCHEASAAQKENAGEDPGLARQAPKPRKQRSSLLEKGLDGAKKAVGGLGKLGKDAVEDLESVGKGAVHDVKDVLDSVL

SEQ ID NO: 59834 - protein, 67 aa, Homo sapiens
MRIHYLLFALLFLFLVPVPGHGGIINTLQKYYCRVRGGRCAVLSCLPKEEQIGKCSTRGRKCCRRKK

SEQ ID NO: 59835 - protein, 333 aa, Homo sapiens
MLLPSKKDLKTALDVFAVFQWSFSALLITTTVIAVNLYLVVFTPYWPVTVLILTWLAFDWKTPQRGGRRFTCVRHWRLWKHYSDYFPLKLLKTHDICPSRNYILVCHPHGLFAHGWFGHFATEASGFSKIFPGITPYILTLGAFFWMPFLREYVMSTGACSVSRSSIDFLLTHKGTGNMVIVVIGGLAECRYSLPGSSTLVLKNRSGFVRMALQHGVPLIPAYAFGETDLYDQHIFTPGGFVNRFQKWFQSMVHIYPCAFYGRGFTKNSWGLLPYSRPVTTIVGEPLPMPKIENPSQEIVAKYHTLYIDALRKLFDQHKTKFGISETQELEII

SEQ ID NO: 59836 - protein, 337 aa, Homo sapiens
MAFFSRLNLQEGLQTFFVLQWIPVYIFLGAIPILLIPYFLLFSKFWPLAVLSLAWLTYDWNTHSQGGRRSAWVRNWTLWKYFRNYFPVKLVKTHDLSPKHNYIIANHPHGILSFGVFINFATEATGIARIFPSITPFVGTLERIFWIPIVREYVMSMGVCPVSSSALKYLLTQKGSGNAVVIVVGGAAEALLCRPGASTLFLKQRKGFVKMALQTGAYLVPSYSFGENEVFNQETFPEGTWLRLFQKTFQDTFKKILGLNFCTFHGRGFTRGSWGFLPFNRPITTVVGEPLPIPRIKRPNQKTVDKYHALYISALRKLFDQHKVEYGLPETQELTIT

SEQ ID NO: 59837 - protein, 287 aa, Homo sapiens
MSGSFDRKLSSILTDISSSLSCHAGSKDSPTLPESSVTDLGYYSAPQHDYYSGQPYGQTVNPYTYHHQFNLNGLAGTGAYSPKSEYTYGASYRQYGAYREQPLPAQDPVSVKEEPEAEVRMVNGKPKKVRKPRTIYSSYQLAALQRRFQKAQYLALPERAELAAQLGLTQTQVKIWFQNRRSKFKKLYKNGEVPLEHSPNNSDSMACNSPPSPALWDTSSHSTPAPARSQLPPPLPYSASPSYLDDPTNSWYHAQNLSGPHLQQQPPQPATLHHASPGPPPNPGAVY

SEQ ID NO: 59838 - protein, 840 aa, Homo sapiens
MALASAAPGSIFCKQLLFSLLVLTLLCDACQKVYLRVPSHLQAETLVGKVNLEECLKSASLIRSSDPAFRILEDGSIYTTHDLILSSERKSFSIFLSDGQRREQQEIKVVLSARENKSPKKRHTKDTALKRSKRRWAPIPASLMENSLGPFPQHVQQIQSDAAQNYTIFYSISGPGVDKEPFNLFYIEKDTGDIFCTRSIDREKYEQFALYGYATTADGYAPEYPLPLIIKIEDDNDNAPYFEHRVTIFTVPENCRSGTSVGKVTATDLDEPDTLHTRLKYKILQQIPDHPKHFSIHPDTGVITTTTPFLDREKCDTYQLIMEVRDMGGQPFGLFNTGTITISLEDENDNPPSFTETSYVTEVEENRIDVEILRMKVQDQDLPNTPHSKAVYKILQGNENGNFIISTDPNTNEGVLCVVKPLNYEVNRQVILQVGVINEAQFSKAASSQTPTMCTTTVTVKIIDSDEGPECHPPVKVIQSQDGFPAGQELLGYKALDPEISSGEGLRYQKLGDEDNWFEINQHTGDLRTLKVLDRESKFVKNNQYNISVVAVDAVGRSCTGTLVVHLDDYNDHAPQIDKEVTICQNNEDFAVLKPVDPDGPENGPPFQFFLDNSASKNWNIEEKDGKTAILRQRQNLDYNYYSVPIQIKDRHGLVATHMLTVRVCDCSTPSECRMKDKSTRDVRPNVILGRWAILAMVLGSVLLLCILFTCFCVTAKRTVKKCFPEDIAQQNLIVSNTEGPGEEVTEANIRLPMQTSNICDTSMSVGTVGGQGIKTQQSFEMVKGGYTLDSNKGGGHQTLESVKGVGQGDTGRYAYTDWQSFTQPRLGEESIRGHTLIKN

SEQ ID NO: 59839 - protein, 894 aa, Homo sapiens
MALASAAPGSIFCKQLLFSLLVLTLLCDACQKVYLRVPSHLQAETLVGKVNLEECLKSASLIRSSDPAFRILEDGSIYTTHDLILSSERKSFSIFLSDGQRREQQEIKVVLSARENKSPKKRHTKDTALKRSKRRWAPIPASLMENSLGPFPQHVQQIQSDAAQNYTIFYSISGPGVDKEPFNLFYIEKDTGDIFCTRSIDREKYEQFALYGYATTADGYAPEYPLPLIIKIEDDNDNAPYFEHRVTIFTVPENCRSGTSVGKVTATDLDEPDTLHTRLKYKILQQIPDHPKHFSIHPDTGVITTTTPFLDREKCDTYQLIMEVRDMGGQPFGLFNTGTITISLEDENDNPPSFTETSYVTEVEENRIDVEILRMKVQDQDLPNTPHSKAVYKILQGNENGNFIISTDPNTNEGVLCVVKPLNYEVNRQVILQVGVINEAQFSKAASSQTPTMCTTTVTVKIIDSDEGPECHPPVKVIQSQDGFPAGQELLGYKALDPEISSGEGLRYQKLGDEDNWFEINQHTGDLRTLKVLDRESKFVKNNQYNISVVAVDAVGRSCTGTLVVHLDDYNDHAPQIDKEVTICQNNEDFAVLKPVDPDGPENGPPFQFFLDNSASKNWNIEEKDGKTAILRQRQNLDYNYYSVPIQIKDRHGLVATHMLTVRVCDCSTPSECRMKDKSTRDVRPNVILGRWAILAMVLGSVLLLCILFTCFCVTAKRTVKKCFPEDIAQQNLIVSNTEGPGEEVTEANIRLPMQTSNICDTSMSVGTVGGQGIKTQQSFEMVKGGYTLDSNKGGGHQTLESVKGVGQGDTGRYAYTDWQSFTQPRLGEKVYLCGQDEEHKHCEDYVCSYNYEGKGSLAGSVGCCSDRQEEEGLEFLDHLEPKFRTLAKTCIKK

SEQ ID NO: 59840 - protein, 896 aa, Homo sapiens
MAAAGPRRSVRGAVCLHLLLTLVIFSRDGEACKKVILNVPSKLEADKIIGRVNLEECFRSADLIRSSDPDFRVLNDGSVYTARAVALSDKKRSFTIWLSDKRKQTQKEVTVLLEHQKKVSKTRHTRETVLRRAKRRWAPIPCSMQENSLGPFPLFLQQVESDAAQNYTVFYSISGRGVDKEPLNLFYIERDTGNLFCTRPVDREEYDVFDLIAYASTADGYSADLPLPLPIRVEDENDNHPVFTEAIYNFEVLESSRPGTTVGVVCATDRDEPDTMHTRLKYSILQQTPRSPGLFSVHPSTGVITTVSHYLDREVVDKYSLIMKVQDMDGQFFGLIGTSTCIITVTDSNDNAPTFRQNAYEAFVEENAFNVEILRIPIEDKDLINTANWRVNFTILKGNENGHFKISTDKETNEGVLSVVKPLNYEENRQVNLEIGVNNEAPFARDIPRVTALNRALVTVHVRDLDEGPECTPAAQYVRIKENLAVGSKINGYKAYDPENRNGNGLRYKKLHDPKGWITIDEISGSIITSKILDREVETPKNELYNITVLAIDKDDRSCTGTLAVNIEDVNDNPPEILQEYVVICKPKMGYTDILAVDPDEPVHGAPFYFSLPNTSPEISRLWSLTKVNDTAARLSYQKNAGFQEYTIPITVKDRAGQAATKLLRVNLCECTHPTQCRATSRSTGVILGKWAILAILLGIALLFSVLLTLVCGVFGATKGKRFPEDLAQQNLIISNTEAPGDDRVCSANGFMTQTTNNSSQGFCGTMGSGMKNGGQETIEMMKGGNQTLESCRGAGHHHTLDSCRGGHTEVDNCRYTYSEWHSFTQPRLGEKLHRCNQNEDRMPSQDYVLTYNYEGRGSPAGSVGCCSEKQEEDGLDFLNNLEPKFITLAEACTKR

SEQ ID NO: 59841 - protein, 839 aa, Homo sapiens
MAAAGPRRSVRGAVCLHLLLTLVIFSRDGEACKKVILNVPSKLEADKIIGRVNLEECFRSADLIRSSDPDFRVLNDGSVYTARAVALSDKKRSFTIWLSDKRKQTQKEVTVLLEHQKKVSKTRHTRETVLRRAKRRWAPIPCSMQENSLGPFPLFLQQVESDAAQNYTVFYSISGRGVDKEPLNLFYIERDTGNLFCTRPVDREEYDVFDLIAYASTADGYSADLPLPLPIRVEDENDNHPVFTEAIYNFEVLESSRPGTTVGVVCATDRDEPDTMHTRLKYSILQQTPRSPGLFSVHPSTGVITTVSHYLDREVVDKYSLIMKVQDMDGQFFGLIGTSTCIITVTDSNDNAPTFRQNAYEAFVEENAFNVEILRIPIEDKDLINTANWRVNFTILKGNENGHFKISTDKETNEGVLSVVKPLNYEENRQVNLEIGVNNEAPFARDIPRVTALNRALVTVHVRDLDEGPECTPAAQYVRIKENLAVGSKINGYKAYDPENRNGNGLRYKKLHDPKGWITIDEISGSIITSKILDREVETPKNELYNITVLAIDKDDRSCTGTLAVNIEDVNDNPPEILQEYVVICKPKMGYTDILAVDPDEPVHGAPFYFSLPNTSPEISRLWSLTKVNDTAARLSYQKNAGFQEYTIPITVKDRAGQAATKLLRVNLCECTHPTQCRATSRSTGVILGKWAILAILLGIALLFSVLLTLVCGVFGATKGKRFPEDLAQQNLIISNTEAPGDDRVCSANGFMTQTTNNSSQGFCGTMGSGMKNGGQETIEMMKGGNQTLESCRGAGHHHTLDSCRGGHTEVDNCRYTYSEWHSFTQPRLGEESIRGHTG

SEQ ID NO: 59842 - protein, 1049 aa, Homo sapiens
MDWSFFRVVAVLFIFLVVVEVNSEFRIQVRDYNTKNGTIKWHSIRRQKREWIKFAAACREGEDNSKRNPIAKIHSDCAANQQVTYRISGVGIDQPPYGIFVINQKTGEINITSIVDREVTPFFIIYCRALNSMGQDLERPLELRVRVLDINDNPPVFSMATFAGQIEENSNANTLVMILNATDADEPNNLNSKIAFKIIRQEPSDSPMFIINRNTGEIRTMNNFLDREQYGQYALAVRGSDRDGGADGMSAECECNIKILDVNDNIPYMEQSSYTIEIQENTLNSNLLEIRVIDLDEEFSANWMAVIFFISGNEGNWFEIEMNERTNVGILKVVKPLDYEAMQSLQLSIGVRNKAEFHHSIMSQYKLKASAISVTVLNVIEGPVFRPGSKTYVVTGNMGSNDKVGDFVATDLDTGRPSTTVRYVMGNNPADLLAVDSRTGKLTLKNKVTKEQYNMLGGKYQGTILSIDDNLQRTCTGTININIQSFGNDDRTNTEPNTKITTNTGRQESTSSTNYDTSTTSTDSSQVYSSEPGNGAKDLLSDNVHFGPAGIGLLIMGFLVLGLVPFLMICCDCGGAPRSAAGFEPVPECSDGAIHSWAVEGPQPEPRDITTVIPQIPPDNANIIECIDNSGVYTNEYGGREMQDLGGGERMTGFELTEGVKTSGMPEICQEYSGTLRRNSMRECREGGLNMNFMESYFCQKAYAYADEDEGRPSNDCLLIYDIEGVGSPAGSVGCCSFIGEDLDDSFLDTLGPKFKKLADISLGKESYPDLDPSWPPQSTEPVCLPQETEPVVSGHPPISPHFGTTTVISESTYPSGPGVLHPKPILDPLGYGNVTVTESYTTSDTLKPSVHVHDNRPASNVVVTERVVGPISGADLHGMLEMPDLRDGSNVIVTERVIAPSSSLPTSLTIHHPRESSNVVVTERVIQPTSGMIGSLSMHPELANAHNVIVTERVVSGAGVTGISGTTGISGGIGSSGLVGTSMGAGSGALSGAGISGGGIGLSSLGGTASIGHMRSSSDHHFNQTIGSASPSTARSRITKYSTVQYSK

SEQ ID NO: 59843 - protein, 999 aa, Homo sapiens
MMGLFPRTTGALAIFVVVILVHGELRIETKGQYDEEEMTMQQAKRRQKREWVKFAKPCREGEDNSKRNPIAKITSDYQATQKITYRISGVGIDQPPFGIFVVDKNTGDINITAIVDREETPSFLITCRALNAQGLDVEKPLILTVKILDINDNPPVFSQQIFMGEIEENSASNSLVMILNATDADEPNHLNSKIAFKIVSQEPAGTPMFLLSRNTGEVRTLTNSLDREQASSYRLVVSGADKDGEGLSTQCECNIKVKDVNDNFPMFRDSQYSARIEENILSSELLRFQVTDLDEEYTDNWLAVYFFTSGNEGNWFEIQTDPRTNEGILKVVKALDYEQLQSVKLSIAVKNKAEFHQSVISRYRVQSTPVTIQVINVREGIAFRPASKTFTVQKGISSKKLVDYILGTYQAIDEDTNKAASNVKYVMGRNDGGYLMIDSKTAEIKFVKNMNRDSTFIVNKTITAEVLAIDEYTGKTSTGTVYVRVPDFNDNCPTAVLEKDAVCSSSPSVVVSARTLNNRYTGPYTFALEDQPVKLPAVWSITTLNATSALLRAQEQIPPGVYHISLVLTDSQNNRCEMPRSLTLEVCQCDNRGICGTSYPTTSPGTRYGRPHSGRLGPAAIGLLLLGLLLLLLAPLLLLTCDCGAGSTGGVTGGFIPVPDGSEGTIHQWGIEGAHPEDKEITNICVPPVTANGADFMESSEVCTNTYARGTAVEGTSGMEMTTKLGAATESGGAAGFATGTVSGAASGFGAATGVGICSSGQSGTMRTRHSTGGTNKDYADGAISMNFLDSYFSQKAFACAEEDDGQEANDCLLIYDNEGADATGSPVGSVGCCSFIADDLDDSFLDSLGPKFKKLAEISLGVDGEGKEVQPPSKDSGYGIESCGHPIEVQQTGFVKCQTLSGSQGASALSASGSVQPAVSIPDPLQHGNYLVTETYSASGSLVQPSTAGFDPLLTQNVIVTERVICPISSVPGNLAGPTQLRGSHTMLCTEDPCSRLI

SEQ ID NO: 59844 - protein, 270 aa, Homo sapiens
MVTAMNVSHEVNQLFQPYNFELSKDMRPFFEEYWATSFPIALIYLVLIAVGQNYMKERKGFNLQGPLILWSFCLAIFSILGAVRMWGIMGTVLLTGGLKQTVCFINFIDNSTVKFWSWVFLLSKVIELGDTAFIILRKRPLIFIHWYHHSTVLVYTSFGYKNKVPAGGWFVTMNFGVHAIMYTYYTLKAANVKPPKMLPMLITSLQILQMFVGAIVSILTYIWRQDQGCHTTMEHLFWSFILYMTYFILFAHFFCQTYIRPKVKAKTKSQ

SEQ ID NO: 59845 - protein, 4061 aa, Homo sapiens
MSTLLENIFAIINLFKQYSKKDKNTDTLSKKELKELLEKEFRQILKNPDDPDMVDVFMDHLDIDHNKKIDFTEFLLMVFKLAQAYYESTRKENLPISGHKHRKHSHHDKHEDNKQEENKENRKRPSSLERRNNRKGNKGRSKSPRETGGKRHESSSEKKERKGYSPTHREEEYGKNHHNSSKKEKNKTENTRLGDNRKRLSERLEEKEDNEEGVYDYENTGRMTQKWIQSGHIATYYTIQDEAYDTTDSLLEENKIYERSRSSDGKSSSQVNRSRHENTSQVPLQESRTRKRRGSRVSQDRDSEGHSEDSERHSGSASRNHHGSAWEQSRDGSRHPRSHDEDRASHGHSADSSRQSGTRHAETSSRGQTASSHEQARSSPGERHGSGHQQSADSSRHSATGRGQASSAVSDRGHRGSSGSQASDSEGHSENSDTQSVSGHGKAGLRQQSHQESTRGRSGERSGRSGSSLYQVSTHEQPDSAHGRTGTSTGGRQGSHHEQARDSSRHSASQEGQDTIRGHPGSSRGGRQGSHHEQSVNRSGHSGSHHSHTTSQGRSDASHGQSGSRSASRQTRNEEQSGDGTRHSGSRHHEASSQADSSRHSQVGQGQSSGPRTSRNQGSSVSQDSDSQGHSEDSERWSGSASRNHHGSAQEQSRDGSRHPRSHHEDRAGHGHSADSSRKSGTRHTQNSSSGQAASSHEQARSSAGERHGSRHQLQSADSSRHSGTGHGQASSAVRDSGHRGSSGSQATDSEGHSEDSDTQSVSGHGQAGHHQQSHQESARDRSGERSRRSGSFLYQVSTHKQSESSHGWTGPSTGVRQGSHHEQARDNSRHSASQDGQDTIRGHPGSSRRGRQGSHHEQSVDRSGHSGSHHSHTTSQGRSDASRGQSGSRSASRTTRNEEQSRDGSRHSGSRHHEASSHADISRHSQAGQGQSEGSRTSRRQGSSVSQDSDSEGHSEDSERWSGSASRNHRGSAQEQSRHGSRHPRSHHEDRAGHGHSADSSRQSGTPHAETSSGGQAASSHEQARSSPGERHGSRHQQSADSSRHSGIPRRQASSAVRDSGHWGSSGSQASDSEGHSEESDTQSVSGHGQDGPHQQSHQESARDWSGGRSGRSGSFIYQVSTHEQSESAHGRTRTSTGRRQGSHHEQARDSSRHSASQEGQDTIRAHPGSRRGGRQGSHHEQSVDRSGHSGSHHSHTTSQGRSDASHGQSGSRSASRQTRKDKQSGDGSRHSGSRHHEAASWADSSRHSQVGQEQSSGSRTSRHQGSSVSQDSDSERHSDDSERLSGSASRNHHGSSREQSRDGSRHPGFHQEDRASHGHSADSSRQSGTHHTESSSHGQAVSSHEQARSSPGERHGSRHQQSADSSRHSGIGHRQASSAVRDSGHRGSSGSQVTNSEGHSEDSDTQSVSAHGQAGPHQQSHKESARGQSGESSGRSRSFLYQVSSHEQSESTHGQTAPSTGGRQGSRHEQARNSSRHSASQDGQDTIRGHPGSSRGGRQGSYHEQSVDRSGHSGYHHSHTTPQGRSDASHGQSGPRSASRQTRNEEQSGDGSRHSGSRHHEPSTRAGSSRHSQVGQGESAGSKTSRRQGSSVSQDRDSEGHSEDSERRSESASRNHYGSAREQSRHGSRNPRSHQEDRASHGHSAESSRQSGTRHAETSSGGQAASSQEQARSSPGERHGSRHQQSADSSTDSGTGRRQDSSVVGDSGNRGSSGSQASDSEGHSEESDTQSVSAHGQAGPHQQSHQESTRGQSGERSGRSGSFLYQVSTHEQSESAHGRTGPSTGGRQRSRHEQARDSSRHSASQEGQDTIRGHPGSSRGGRQGSHYEQSVDSSGHSGSHHSHTTSQERSDVSRGQSGSRSVSRQTRNEKQSGDGSRHSGSRHHEASSRADSSRHSQVGQGQSSGPRTSRNQGSSVSQDSDSQGHSEDSERWSGSASRNHLGSAWEQSRDGSRHPGSHHEDRAGHGHSADSSRQSGTRHTESSSRGQAASSHEQARSSAGERHGSHHQLQSADSSRHSGIGHGQASSAVRDSGHRGYSGSQASDSEGHSEDSDTQSVSAQGKAGPHQQSHKESARGQSGESSGRSGSFLYQVSTHEQSESTHGQSAPSTGGRQGSHYDQAQDSSRHSASQEGQDTIRGHPGPSRGGRQGSHQEQSVDRSGHSGSHHSHTTSQGRSDASRGQSGSRSASRKTYDKEQSGDGSRHSGSHHHEASSWADSSRHSLVGQGQSSGPRTSRPRGSSVSQDSDSEGHSEDSERRSGSASRNHHGSAQEQSRDGSRHPRSHHEDRAGHGHSAESSRQSGTHHAENSSGGQAASSHEQARSSAGERHGSHHQQSADSSRHSGIGHGQASSAVRDSGHRGSSGSQASDSEGHSEDSDTQSVSAHGQAGPHQQSHQESTRGRSAGRSGRSGSFLYQVSTHEQSESAHGRTGTSTGGRQGSHHKQARDSSRHSTSQEGQDTIHGHPGSSSGGRQGSHYEQLVDRSGHSGSHHSHTTSQGRSDASHGHSGSRSASRQTRNDEQSGDGSRHSGSRHHEASSRADSSGHSQVGQGQSEGPRTSRNWGSSFSQDSDSQGHSEDSERWSGSASRNHHGSAQEQLRDGSRHPRSHQEDRAGHGHSADSSRQSGTRHTQTSSGGQAASSHEQARSSAGERHGSHHQQSADSSRHSGIGHGQASSAVRDSGHRGYSGSQASDNEGHSEDSDTQSVSAHGQAGSHQQSHQESARGRSGETSGHSGSFLYQVSTHEQSESSHGWTGPSTRGRQGSRHEQAQDSSRHSASQDGQDTIRGHPGSSRGGRQGYHHEHSVDSSGHSGSHHSHTTSQGRSDASRGQSGSRSASRTTRNEEQSGDGSRHSGSRHHEASTHADISRHSQAVQGQSEGSRRSRRQGSSVSQDSDSEGHSEDSERWSGSASRNHHGSAQEQLRDGSRHPRSHQEDRAGHGHSADSSRQSGTRHTQTSSGGQAASSHEQARSSAGERHGSHHQQSADSSRHSGIGHGQASSAVRDSGHRGYSGSQASDNEGHSEDSDTQSVSAHGQAGSHQQSHQESARGRSGETSGHSGSFLYQVSTHEQSESSHGWTGPSTRGRQGSRHEQAQDSSRHSASQYGQDTIRGHPGSSRGGRQGYHHEHSVDSSGHSGSHHSHTTSQGRSDASRGQSGSRSASRTTRNEEQSGDSSRHSVSRHHEASTHADISRHSQAVQGQSEGSRRSRRQGSSVSQDSDSEGHSEDSERWSGSASRNHRGSVQEQSRHGSRHPRSHHEDRAGHGHSADRSRQSGTRHAETSSGGQAASSHEQARSSPGERHGSRHQQSADSSRHSGIPRGQASSAVRDSRHWGSSGSQASDSEGHSEESDTQSVSGHGQAGPHQQSHQESARDRSGGRSGRSGSFLYQVSTHEQSESAHGRTRTSTGRRQGSHHEQARDSSRHSASQEGQDTIRGHPGSSRRGRQGSHYEQSVDRSGHSGSHHSHTTSQGRSDASRGQSGSRSASRQTRNDEQSGDGSRHSWSHHHEASTQADSSRHSQSGQGQSAGPRTSRNQGSSVSQDSDSQGHSEDSERWSGSASRNHRGSAQEQSRDGSRHPTSHHEDRAGHGHSAESSRQSGTHHAENSSGGQAASSHEQARSSAGERHGSHHQQSADSSRHSGIGHGQASSAVRDSGHRGSSGSQASDSEGHSEDSDTQSVSAHGQAGPHQQSHQESTRGRSAGRSGRSGSFLYQVSTHEQSESAHGRAGPSTGGRQGSRHEQARDSSRHSASQEGQDTIRGHPGSRRGGRQGSYHEQSVDRSGHSGSHHSHTTSQGRSDASHGQSGSRSASRETRNEEQSGDGSRHSGSRHHEASTQADSSRHSQSGQGESAGSRRSRRQGSSVSQDSDSEAYPEDSERRSESASRNHHGSSREQSRDGSRHPGSSHRDTASHVQSSPVQSDSSTAKEHGHFSSLSQDSAYHSGIQSRGSPHSSSSYHYQSEGTERQKGQSGLVWRHGSYGSADYDYGESGFRHSQHGSVSYNSNPVVFKERSDICKASAFGKDHPRYYATYINKDPGLCGHSSDISKQLGFSQSQRYYYYE

SEQ ID NO: 59846 - protein, 723 aa, Homo sapiens
MSLLKERKPKKPHYIPRPPGKPFKYKCFQCPFTCNEKSHLFNHMKYGLCKNSITLVSEQDRVPKCPKSNSLDPKQTNQPDATAKPASSKSVANGLSAFDSKLQHSSAREDIKENLELQARGTHRCLGQKPALHRASPCKSPAPEAALGAQPALEGAARPSAFVPVGEHRLKGPDNAEPPETLALHNPTAKAVSFHTKSAFHTPGYPWKAGSPFLPPEFPHKISSTKGLGAISPYMHPTIPEYPPHFYTEHGLATIYSPYLLAGSSPECDAPLLSVYGTQDPRHFLPHPGPIPKHLAPSPATYDHYRFFQQYPSNLPIPYGFYRPESAFSSYGLRLPPVTGLTRDQSSHLLEEATLVYPASSPSRLNPSDPNRKHVEFESPIPEAKDSSKAGQRDTEGSKMSPRAGSAATGSPGRPSPTDFMQTSQTCEGLYDLSNKAASSALGRLYPPEQSLTAFRPVKKSTECLPAQAAETTAESPVSLNVVNGDPPAPTGSASLVSEAAPSSPDDSSGMGPLNLSKKSEINLAATHEPTYQGSPQAETASFSELQDLPLNLSVKDPCNTQAPRPAFPGRPRAAEPAAAVPQKTGTEGSEDGPSHPETKPGSLDGDGAPPTGPGEEAPDACAVDSSEEQKQTAAVALCQLAAYSPRNIRVGDGDAAAPEPACRQDTPTLSSMESQEAQCDLRPKGQKRTSLRDAGKSQQGAKKAKLQDTARVFTLRRRARVS

SEQ ID NO: 59847 - protein, 343 aa, Homo sapiens
MGSPGASLGIKKALQSEQATALPASAPAVSQPTAPAPSCLPKAGQVIPALLREAPFSSVIAPTLLCGFLFLAWVAAEVPEESSRMAGSGARSEEGRRQHAFVPEPFDGANVVPNLWLHSFEVINDLNHWDHITKLRFLKESLRGEALGVYNRLSPQDQGDYGTVKEALLKAFGVPGAAPSHLPKEIVFANSMGKGYYLKGKIGKVPVRFLVDSGAQVSVVHPNLWEEVTDGDLDTLQPFENVVKVANGAEMKILGVWDTAVSLGKLKLKAQFLVANASAEEAIIGTDVLQDHNAILDFEHRTCTLKGKKFRLLPVGGSLEDEFDLELIEEDPSSEEGRQELSH

SEQ ID NO: 59848 - protein, 311 aa, Homo sapiens
MQTFTMVLEEIWTSLFMWFFYALIPCLLTDEVAILPAPQNLSVLSTNMKHLLMWSPVIAPGETVYYSVEYQGEYESLYTSHIWIPSSWCSLTEGPECDVTDDITATVPYNLRVRATLGSQTSAWSILKHPFNRNSTILTRPGMEITKDGFHLVIELEDLGPQFEFLVAYWRREPGAEEHVKMVRSGGIPVHLETMEPGAAYCVKAQTFVKAIGRYSAFSQTECVEVQGEAIPLVLALFAFVGFMLILVVVPLFVWKMGRLLQYSCCPVVVLPDTLKITNSPQKLISCRREEVDACATAVMSPEELLRAWIS

SEQ ID NO: 59849 - protein, 270 aa, Homo sapiens
MDWKTLQALLSGVNKYSTAFGRIWLSVVFVFRVLVYVVAAERVWGDEQKDFDCNTKQPGCTNVCYDNYFPISNIRLWALQLIFVTCPSLLVILHVAYREERERRHRQKHGDQCAKLYDNAGKKHGGLWWTYLFSLIFKLIIEFLFLYLLHTLWHGFNMPRLVQCANVAPCPNIVDCYIARPTEKKIFTYFMVGASAVCIVLTICELCYLICHRVLRGLHKDKPRGGCSPSSSASRASTCRCHHKLVEAGEVDPDPGNNKLQASAPNLTPI

SEQ ID NO: 59850 - protein, 270 aa, Homo sapiens; identical to SEQ ID NO: 59849

SEQ ID NO: 59851 - protein, 1288 aa, Homo sapiens [sequence omitted]

SEQ ID NO: 59852 - protein, 1288 aa, Homo sapiens
MAQPFPPKDLLLNFVSMCLKGTSPSSFSFILRKAAPCVEVVAANILAELSSQPSHFCWKDLREYGGDGTRASGGLVGFYVVVMNFMINAPIELALLTQGLSLCLFPKPKLPEEEELSEGEGPTDLSPVQATCLLELHPQMPRKQPAGCIFLLTFLGLSGLVGTVTRTYYIGIVEEYWNYVPQGKNVITGKSFTEDKLATLFLERGPNRIGSIYKKAVYRRFTDGTYSIEIPKPPWLGFLGPILRAEVGDVIVIHLKNFASRPYSLHPHGVFYNKDSEGALYPDGTSGRNKNDDMVPPGKNYTYVWPVREEYAPTPADANCLTWVYHSHIDAPKDICSGLIGPLLVCKEGILNRYSGTRNDVDREFVIMFTLVDENQSWYLNENIKHFCTDPDSVDKKDAVFQRSNKMHALNGYLFGNFPEPDMCVGESVSWHLFGMGNEIDIHSIYFYGNTFISRGHRTDVVNLFPATFLTTEMIAENPGKWMITCQVSDHLQAGMLGQYNVDNCKSDIFYPKMKGQQRRYFIAAEKILWDYAPQGSYNGDSDLYFTQGDNRIGGKYWKVRYTEFVDATFTKRKRLSAEEAHLGILGPVIKAEVGDTLLVTFANKADKVYSILPHGVIYDKASDAAPNLDGFVKPGAHVKPGETFTYKWTVPESVSPTAGDPPCLTYLYFSAVDPIKDTSSGLVGPLLVCKKGVLNADGTQKGIDKEFYLLFTVFDENLSRYFDENIQKFIWHPFSIDKEDKEFVKSNRMHAVNGYMYGNQPGLNMCKRDRVSWHLIGLGTDTDMHGIVFQGNTIHLRGTHRDSLALFPHMATTAFMQPDHAGIFRVFCATMPHLSRGMGQIYEVSSCDNRDPSEQRYGMIRTFYIAAEEVEWDYAPNKNWEFEKQHVDARGERHGDIFMNRTENWIGSQYKKVVYREYTDGEFVEIKARPPREEHLELLGPMIHAEVGNTVLIIFKNKASRPYSISAQGVEEMDSGKQFQVPMTKPGEVKTYRWNIPKRSGPGPSDPNCIPWVYYSTVNFVKDTYSGLMGPLITCRKGVLNEKGRRSDVDYEFALLFLVFNENESWYLDDNIKKYLNKDPRDFKRTDDFEESNRMHAINGKIFGNLHGLIMNEDTMTNWYLLGIGSEVDIHTIHYHAESFLFKIDKSYREDVYDLFPGTFQTIELFADHPGTWLLHCHVSDHIHAGMETTYTVLRNIDNRIPYSTTSPGVASHPATVPSNERPGKEQLYFFGKNLGPTGAKAALVILFIIGLLLLITTVILSLRLCSAMKQTDYQQVQSCALPTDAL

SEQ ID NO: 59853 - protein, 231 aa, Homo sapiens
MSWKMALQIPGGFWAAAVTVMLVMLSTPVAEARDFPKDFLVQFKGMCYFTNGTERVRGVARYIYNREEYGRFDSDVGEFQAVTELGRSIEDWNNYKDFLEQERAAVDKVCRHNYEAELRTTLQRQVEPTVTISPSRTEALNHHNLLVCSVTDFYPAQIKVQWFRNDQEETAGVVSTSLIRNGDWTFQILVMLEITPQRGDIYTCQVEHPSLQSPITVEWRPRGPPPAGLLH

SEQ ID NO: 59854 - protein, 92 aa, Homo sapiens
MSARGEGAGQPSTSAQGQPAAPAPQKRGRGRPRKQQQEPTGEPSPKRPRGRPKGSKNKSPSKAAQKKAEATGEKRPRGRPRKWWLLMKSPCW

SEQ ID NO: 59855 - protein, 109 aa, Homo sapiens
MSARGEGAGQPSTSAQGQPAAPAPQKRGRGRPRKQQQEPTGEPSPKRPRGRPKGSKNKSPSKAAQKKAEATGEKRPRGRPRKWPQQVVQKKPAQEETEETSSQESAEED

SEQ ID NO: 59856 - protein, 330 aa, Homo sapiens
MTTSLLLHPRWPESLMYVYEDSAAESGIGGGGGGGGGGTGGAGGGCSGASPGKAPSMDGLGSSCPASHCRDLLPHPVLGRPPAPLGAPQGAVYTDIPAPEAARQCAPPPAPPTSSSATLGYGYPFGGSYYGCRLSHNVNLQQKPCAYHPGDKYPEPSGALPGDDLSSRAKEFAFYPSFASSYQAMPGYLDVSVVPGISGHPEPRHDALIPVEGYQHWALSNGWDSQVYCSKEQSQSAHLWKSPFPDVVPLQPEVSSYRRGRKKRVPYTKVQLKELEKEYAASKFITKEKRRRISATTNLSERQVTIWFQNRRVKEKKVVSKSKAPHLHST

SEQ ID NO: 59857 - protein, 1189 aa, Homo sapiens
MESTPSFLKGTPTWEKTAPENGIVRQEPGSPPRDGLHHGPLCLGEPAPFWRGVLSTPDSWLPPGFPQGPKDMLPLVEGEGPQNGERKVNWLGSKEGLRWKEAMLTHPLAFCGPACPPRCGPLMPEHSGGHLKSDPVAFRPWHCPFLLETKILERAPFWVPTCLPPYLVSGLPPEHPCDWPLTPHPWVYSGGQPKVPSAFSLGSKGFYYKDPSIPRLAKEPLAAAEPGLFGLNSGGHLQRAGEAERPSLHQRDGEMGAGRQQNPCPLFLGQPDTVPWTSWPACPPGLVHTLGNVWAGPGDGNLGYQLGPPATPRCPSPEPPVTQRGCCSSYPPTKGGGLGPCGKCQEGLEGGASGASEPSEEVNKASGPRACPPSHHTKLKKTWLTRHSEQFECPRGCPEVEERPVARLRALKRAGSPEVQGAMGSPAPKRPPDPFPGTAEQGAGGWQEVRDTSIGNKDVDSGQHDEQKGPQDGQASLQDPGLQDIPCLALPAKLAQCQSCAQAAGEGGGHACHSQQVRRSPLGGELQQEEDTATNSSSEEGPGSGPDSRLSTGLAKHLLSGLGDRLCRLLRREREALAWAQREGQGPAVTEDSPGIPRCCSRCHHGLFNTHWRCPRCSHRLCVACGRVAGTGRAREKAGFQEQSAEECTQEAGHAACSLMLTQFVSSQALAELSTAMHQVWVKFDIRGHCPCQADARVWAPGDAGQQKESTQKTPPTPQPSCNGDTHRTKSIKEETPDSAETPAEDRAGRGPLPCPSLCELLASTAVKLCLGHERIHMAFAPVTPALPSDDRITNILDSIIAQVVERKIQEKALGPGLRAGPGLRKGLGLPLSPVRPRLPPPGALLWLQEPQPCPRRGFHLFQEHWRQGQPVLVSGIQRTLQGNLWGTEALGALGGQVQALSPLGPPQPSSLGSTTFWEGFSWPELRPKSDEGSVLLLHRALGDEDTSRVENLAASLPLPEYCALHGKLNLASYLPPGLALRPLEPQLWAAYGVSPHRGHLGTKNLCVEVADLVSILVHADTPLPAWHRAQKDFLSGLDGEGLWSPGSQVSTVWHVFRAQDAQRIRRFLQMVCPAGAGALEPGAPGSCYLDAGLRRRLREEWGVSCWTLLQAPGEAVLVPAGAPHQVQGLVSTVSVTQHFLSPETSALSAQLCHQGPSLPPDCHLLYAQMDWAVFQAVKVAVGTLQEAK

SEQ ID NO: 59858 - protein, 1134 aa, Homo sapiens
MESTPSFLKGTPTWEKTAPENGIVRQEPGSPPRDGLHHGPLCLGEPAPFWRGVLSTPDSWLPPGFPQGPKDMLPLVEGEGPQNGERKVNWLGSKEGLRWKEAMLTHPLAFCGPACPPRCGPLMPEHSGGHLKSDPVAFRPWHCPFLLETKILERAPFWVPTCLPPYLVSGLPPEHPCDWPLTPHPWVYSGGQPKVPSAFSLGSKGFYYKDPSIPRLAKEPLAAAEPGLFGLNSGGHLQRAGEAERPSLHQRDGEMGAGRQQNPCPLFLGQPDTVPWTSWPACPPGLVHTLGNVWAGPGDGNLGYQLGPPATPRCPSPEPPVTQRGCCSSYPPTKGGGLGPCGKCQEGLEGGASGASEPSEEVNKASGPRACPPSHHTKLKKTWLTRHSEQFECPRGCPEVEERPVARLRALKRAGSPEVQGAMGSPAPKRPPDPFPGTAEQGAGGWQEVRDTSIGNKDVDSGQHDEQKGPQDGQASLQDPGLQDIPCLALPAKLAQCQSCAQAAGEGGGHACHSQQVRRSPLGGELQQEEDTATNSSSEEGPGSGPDSRLSTGLAKHLLSGLGDRLCRLLRREREALAWAQREGQGPAVTEDSPGIPRCCSRCHHGLFNTHWRCPRCSHRLCVACGRVAGTGRAREKAGFQEQSAEECTQEAGHAACSLMLTQFVSSQALAELSTAMHQVWVKFDIRGHCPCQADARVWAPGDAGQQKESTQKTPPTPQPSCNGDTHRTKSIKEETPDSAETPAEDRAGRGPLPCPSLCELLASTAVKLCLGHERIHMAFAPVTPALPSDDRITNILDSIIAQVVERKIQEKALGPGLRAGPGLRKGLGLPLSPVRPRLPPPGALLWLQEPQPCPRRGFHLFQEHWRQGQPVLVSGIQRTLQGNLWGTEALGALGGQVQALSPLGPPQPSSLGSTTFWEGFSWPELRPKSDEGSVLLLHRALGDEDTSRVENLAASLPLPEYCALHGKLNLASYLPPGLALRPLEPQLWAAYGVSPHRGHLGTKNLCVEVADLVSILVHADTPLPAWHRAQKDFLSGLDGEGLWSPGSQVSTVWHVFRAQDAQRIRRFLQMVQGLVSTVSVTQHFLSPETSALSAQLCHQGPSLPPDCHLLYAQMDWAVFQAVKVAVGTLQEAK

SEQ ID NO: 59859 - protein, 311 aa, Homo sapiens
MLLVALVLGAYCLCALPGRCPPAARAPAPAPAPSEPSSSVHRPGAPGLPLASGPGRRRFPQALIVGVKKGGTRALLEFLRLHPDVRALGSEPHFFDRCYERGLAWYRSLMPRTLDGQITMEKTPSYFVTREAPRRIHAMSPDTKLIVVVRNPVTRAISDYTQTLSKTPGLPSFRALAFRHGLGPVDTAWSAVRIGLYAQHLDHWLRYFPLSHFLFVSGERLVSDPAGEVGRVQDFLGLKRVVTDKHFYFNATKGFPCLKKAQGGSRPRCLGKSKGRPHPRVPQAVVRRLQEFYRPFNRRFYQMTGQDFGWG

SEQ ID NO: 59860 - protein, 110 aa, Homo sapiens
MAPRGCIVAVFAIFCISRLLCSHGAPVAPMTPYLMLCQPHKRCGDKFYDPLQHCCYDDAVVPLARTQTCGNCTFRVCFEQCCPWTFMVKLINQNCDSARTSDDRLCRSVS

SEQ ID NO: 59861 - protein, 123 aa, Homo sapiens
MRTDYPRSVLAPAYVSVCLLLLCPREVIAPAGSEPWLCQPAPRCGDKIYNPLEQCCYNDAIVSLSETRQCGPPCTFWPCFELCCLDSFGLTNDFVVKLKVQGVNSQCHSSPISSKCESRRRFP

SEQ ID NO: 59862 - protein, 125 aa, Homo sapiens
MRPRCCILALVCWITVFLLQCSKGTTDAPVGSGLWLCQPTPRCGNKIYNPSEQCCYDDAILSLKETRRCGSTCTFWPCFELCCPESFGPQQKFLVKLRVLGMKSQCHLSPISRSCTRNRRHVLYP

SEQ ID NO: 59863 - protein, 155 aa, Homo sapiens
MVLSGALCFRMKDSALKVLYLHNNQLLAGGLHAGKVIKGEEISVVPNRWLDASLSPVILGVQGGSQCLSCGVGQEPTLTLEPVNIMELYLGAKESKSFTFYRRDMGLTSSFESAAYPGWFLCTVPEADQPVRLTQLPENGGWNAPITDFYFQQCD

SEQ ID NO: 59864 - protein, 155 aa, Homo sapiens; identical to SEQ ID NO: 59863

SEQ ID NO: 59865 - protein, 218 aa, Homo sapiens
MSFVGENSGVKMGSEDWEKDEPQCCLEDPAGSPLEPGPSLPTMNFVHTSPKVKNLNPKKFSIHDQDHKVLVLDSGNLIAVPDKNYIRPEIFFALASSLSSASAEKGSPILLGVSKGEFCLYCDKDKGQSHPSLQLKKEKLMKLAAQKESARRPFIFYRAQVGSWNMLESAAHPGWFICTSCNCNEPVGVTDKFENRKHIEFSFQPVCKAEMSPSEVSD

SEQ ID NO: 59866 - protein, 197 aa, Homo sapiens
MSFVGENSGVKMGSEDWEKDEPQCCLEGPKVKNLNPKKFSIHDQDHKVLVLDSGNLIAVPDKNYIRPEIFFALASSLSSASAEKGSPILLGVSKGEFCLYCDKDKGQSHPSLQLKKEKLMKLAAQKESARRPFIFYRAQVGSWNMLESAAHPGWFICTSCNCNEPVGVTDKFENRKHIEFSFQPVCKAEMSPSEVSD

SEQ ID NO: 59867 - protein, 157 aa, Homo sapiens
MSFVGENSGVKMGSEDWEKDEPQCCLEEIFFALASSLSSASAEKGSPILLGVSKGEFCLYCDKDKGQSHPSLQLKKEKLMKLAAQKESARRPFIFYRAQVGSWNMLESAAHPGWFICTSCNCNEPVGVTDKFENRKHIEFSFQPVCKAEMSPSEVSD

SEQ ID NO: 59868 - protein, 178 aa, Homo sapiens
MSFVGENSGVKMGSEDWEKDEPQCCLEDPAGSPLEPGPSLPTMNFVHTKIFFALASSLSSASAEKGSPILLGVSKGEFCLYCDKDKGQSHPSLQLKKEKLMKLAAQKESARRPFIFYRAQVGSWNMLESAAHPGWFICTSCNCNEPVGVTDKFENRKHIEFSFQPVCKAEMSPSEVSD

SEQ ID NO: 59869 - protein, 192 aa, Homo sapiens
MSGCDRRETETKGKNSFKKRLRGPKVKNLNPKKFSIHDQDHKVLVLDSGNLIAVPDKNYIRPEIFFALASSLSSASAEKGSPILLGVSKGEFCLYCDKDKGQSHPSLQLKKEKLMKLAAQKESARRPFIFYRAQVGSWNMLESAAHPGWFICTSCNCNEPVGVTDKFENRKHIEFSFQPVCKAEMSPSEVSD

SEQ ID NO: 59870 - protein, 1822 aa, Homo sapiens
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTGCGWKFEPLLGEELDLRRVTWRLPPELIPRLSASSGRSSDAEAPHGPPDDGGAGGKGGSLPRSATPGPPGEHLVNGRMDFAFPGSTNSLHRMTTTSAAAYGTHLSPHVPHRVLSTSSTLTRDYNSLTRSEHSHSTTLPRDYSTLTSVSSHDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 59871 - protein, 1805 aa, Homo sapiens
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTEHLVNGRMDFAFPGSTNSLHRMTTTSAAAYGTHLSPHVPHRVLSTSSTLTRDYNSLTRSEHSHSTTLPRDYSTLTSVSSHGLPPIWEHGRSRLPLSWALGSRSRAQMKGFPPSRGPRDSIILAGRPAAPSWGPDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 59872 - protein, 1752 aa, Homo sapiens
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTEHLVNGRMDFAFPGSTNSLHRMTTTSAAAYGTHLSPHVPHRVLSTSSTLTRDYNSLTRSEHSHSTTLPRDYSTLTSVSSHDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 59873 - protein, 585 aa, Homo sapiens
MSQQHTLPVTLSPALSQELLKTVPPPVNTHQEQMKQPTPLPPPCQKVPVELPVEVPSKQEEKHMTAVKGLPEQECEQQQKEPQEQELQQQHWEQHEEYQKAENPEQQLKQEKTQRDQQLNKQLEEEKKLLDQQLDQELVKRDEQLGMKKEQLLELPEQQEGHLKHLEQQEGQLKHPEQQEGQLELPEQQEGQLELPEQQEGQLELPEQQEGQLELPEQQEGQLELPEQQEGQLELPQQQEGQLELSEQQEGQLELSEQQEGQLKHLEHQEGQLEVPEEQMGQLKYLEQQEGQLKHLDQQEKQPELPEQQMGQLKHLEQQEGQPKHLEQQEGQLEQLEEQEGQLKHLEQQEGQLEHLEHQEGQLGLPEQQVLQLKQLEKQQGQPKHLEEEEGQLKHLVQQEGQLKHLVQQEGQLEQQERQVEHLEQQVGQLKHLEEQEGQLKHLEQQQGQLEVPEQQVGQPKNLEQEEKQLELPEQQEGQVKHLEKQEAQLELPEQQVGQPKHLEQQEKHLEHPEQQDGQLKHLEQQEGQLKDLEQQKGQLEQPVFAPAPGQVQDIQPALPTKGEVLLPVEHQQQKQEVQWPPKHK

SEQ ID NO: 59874 - protein, 520 aa, Homo sapiens
MSLSPCRAQRGFSARSACSARSRGRSRGGFSSRGGFSSRSLNSFGGCLEGSRGSTWGSGGRLGVRFGEWSGGPGLSLCPPGGIQEVTINQNPLTPLKIEIDPQFQVVRTQETQEIRTLNNQFASFIDKVRFLEQQNKVLETKWHLLQQQGLSGSQQGLEPVFEACLDQLRKQLEQLQGERGALDAELKACRDQEEEYKSKYEEEAHRRATLENDFVVLKKDVDGVFLSKMELEGKLEALREYLYFLKHLNEEELGQLQAQASDTSVVLSMDNNRYLDFSSIITEVRARYEEIARSSKAEAEALYQTKYQELQVSAQLHGDRMQETKVQISQLHQEIQRLQSQTENLKKQNASLQAAITDAEQRGELALKDAQAKVDELEAALRMAKQNLARLLCEYQELTSTKLSLDVEIATYRRLLEGEECRMSGECTSQVTISSVGGSAVMSGGVGGGLGSTCGLGSGKGSPGSCCTSIVTGGSNIILGSGKDPVLDSCSVSGSSAGSSCHTILKKTVESSLKTSITY

SEQ ID NO: 59875 - protein, 529 aa, Homo sapiens
MSRQLNIKSSGDKGNFSVHSAVVPRKAVGSLASYCAAGRGAGAGFGSRSLYSLGGNRRISFNVAGGGVRAGGYGFRPGSGYGGGRASGFAGSMFGSVALGPACLSVCPPGGIHQVTVNKSLLAPLNVELDPEIQKVRAQEREQIKVLNDKFASFIDKVRFLEQQNQVLETKWELLQQLDLNNCKKNLEPILEGYISNLRKQLETLSGDRVRLDSELRSMRDLVEDYKKRYEVEINRRTTAENEFVVLKKDADAAYAVKVELQAKVDSLDKDIKFLKCLYDAEIAQIQTHASETSVILSMDNNRDLDLDSIIAEVRMHYEEIALKSKAEAEALYQTKIQELQLAASRHGDDLKHTRSEMVELNRLIQRIRCEIGNVKKQRASLETAIADAEQRGDNALKDAQAKLDELEGALHQAKEELARMLREYQELMSLKLALDMEIATYRKLLEGEECRMSGENPSSVSISVISSSSYSYHHPSSAGVDLGASAVAGSSGSTQSGQTKTTEARGGDLKDTQGKSTPASIPARKATR

SEQ ID NO: 59876 - protein, 433 aa, Homo sapiens
MTAASRANPYSIVSSEEDGLHLVTMSGANGFGNGKVHTRRRCRNRFVKKNGQCNIEFANMDEKSQRYLADMFTTCVDIRWRYMLLIFSLAFLASWLLFGIIFWVIAVAHGDLEPAEGRGRTPCVMQVHGFMAAFLFSIETQTTIGYGLRCVTEECPVAVFMVVAQSIVGCIIDSFMIGAIMAKMARPKKRAQTLLFSHNAVVALRDGKLCLMWRVGNLRKSHIVEAHVRAQLIKPRVTEEGEYIPLDQIDIDVGFDKGLDRIFLVSPITILHEIDEASPLFGISRQDLETDDFEIVVILEGMVEATAMTTQARSSYLANEILWGHRFEPVLFEEKNQYKIDYSHFHKTYEVPSTPRCSAKDLVENKFLLPSANSFCYENELAFLSRDEEDEADGDQDGRSRDGLSPQARHDFDRLQAGGGVLEQRPYRRESEI

SEQ ID NO: 59877 - protein, 518 aa, Homo sapiens
MIPQTPHHCSPGAAMSVQVAAPGSAGLGPERLSPEELVRQTRQVVQGLEALRAEHHGLAGHLAEALAGQGPAAGLEMLEEKQQVVSHSLEAIELGLGEAQVLLALSAHVGALEAEKQRLRSQARRLAQENVWLREELEETQRRLRASEESVAQLEEEKRHLEFLGQLRQYDPPAESQQSESPPRRDSLASLFPSEEEERKGPEAAGAAAAQQGGYEIPARLRTLHNLVIQYAGQGRYEVAVPLCRQALEDLERSSGHCHPDVATMLNILALVYRDQNKYKEATDLLHDALQIREQTLGPEHPAVAATLNNLAVLYGKRGRYREAEPLCQRALEIREKVLGADHPDVAKQLNNLALLCQNQGKFEDAERHYARALSIYEALGGPHDPNVAKTKNNLASAYLKQNKYQQAEELYKEILHKEDLPAPLGAPNTGTAGDAEQALRRSSSLSKIRESIRRGSEKLVSRLRGEAAAGAAGMKRAMSLNTLNVDAPRAPGTQFPSWHLDKAPRTLSASTQDLSPH

SEQ ID NO: 59878 - protein, 293 aa, Homo sapiens
MATARPPWMWVLCALITALLLGVTEHVLANNDVSCDHPSNTVPSGSNQDLGAGAGEDARSDDSSSRIINGSDCDMHTQPWQAALLLRPNQLYCGAVLVHPQWLLTAAHCRKKVFRVRLGHYSLSPVYESGQQMFQGVKSIPHPGYSHPGHSNDLMLIKLNRRIRPTKDVRPINVSSHCPSAGTKCLVSGWGTTKSPQVHFPKVLQCLNISVLSQKRCEDAYPRQIDDTMFCAGDKAGRDSCQGDSGGPVVCNGSLQGLVSWGDYPCARPNRPGVYTNLCKFTKWIQETIQANS

SEQ ID NO: 59879 - protein, 253 aa, Homo sapiens
MARSLLLPLQILLLSLALETAGEEAQGDKIIDGAPCARGSHPWQVALLSGNQLHCGGVLVNERWVLTAAHCKMNEYTVHLGSDTLGDRRAQRIKASKSFRHPGYSTQTHVNDLMLVKLNSQARLSSMVKKVRLPSRCEPPGTTCTVSGWGTTTSPDVTFPSDLMCVDVKLISPQDCTKVYKDLLENSMLCAGIPDSKKNACNGDSGGPLVCRGTLQGLVSWGTFPCGQPNDPGVYTQVCKFTKWINDTMKKHR

SEQ ID NO: 59880 - protein, 253 aa, Homo sapiens; identical to SEQ ID NO: 59879

SEQ ID NO: 59881 - protein, 260 aa, Homo sapiens
MGRPRPRAAKTWMFLLLLGGAWAGHSRAQEDKVLGGHECQPHSQPWQAALFQGQQLLCGGVLVGGNWVLTAAHCKKPKYTVRLGDHSLQNKDGPEQEIPVVQSIPHPCYNSSDVEDHNHDLMLLQLRDQASLGSKVKPISLADHCTQPGQKCTVSGWGTVTSPRENFPDTLNCAEVKIFPQKKCEDAYPGQITDGMVCAGSSKGADTCQGDSGGPLVCDGALQGITSWGSDPCGRSDKPGVYTNICRYLDWIKKIIGSKG

SEQ ID NO: 59882 - protein, 305 aa, Homo sapiens
MGRPRPRAAKTWMFLLLLGGAWAACGSLDLLTKLYAENLPCVHLNPQWPSQPSHCPRGWRSNPLPPAAGHSRAQEDKVLGGHECQPHSQPWQAALFQGQQLLCGGVLVGGNWVLTAAHCKKPKYTVRLGDHSLQNKDGPEQEIPVVQSIPHPCYNSSDVEDHNHDLMLLQLRDQASLGSKVKPISLADHCTQPGQKCTVSGWGTVTSPRENFPDTLNCAEVKIFPQKKCEDAYPGQITDGMVCAGSSKGADTCQGDSGGPLVCDGALQGITSWGSDPCGRSDKPGVYTNICRYLDWIKKIIGSKG

SEQ ID NO: 59883 - protein, 119 aa, Homo sapiens
MGRPRPRAAKTWMFLLLLGGAWAENFPDTLNCAEVKIFPQKKCEDAYPGQITDGMVCAGSSKGADTCQGDSGGPLVCDGALQGITSWGSDPCGRSDKPGVYTNICRYLDWIKKIIGSKG

SEQ ID NO: 59884 - protein, 32 aa, Homo sapiens
MGRPRPRAAKTWMFLLLLGGAWAGRFWRPPGV

SEQ ID NO: 59885 - protein, 250 aa, Homo sapiens
MKLGLLCALLSLLAGHGWADTRAIGAEECRPNSQPWQAGLFHLTRLFCGATLISDRWLLTAAHCRKPYLWVRLGEHHLWKWEGPEQLFRVTDFFPHPGFNKDLSANDHNDDIMLIRLPRQARLSPAVQPLNLSQTCVSPGMQCLISGWGAVSSPKALFPVTLQCANISILENKLCHWAYPGHISDSMLCAGLWEGGRGSCQGDSGGPLVCNGTLAGVVSGGAEPCSRPRRPAVYTSVCHYLDWIQEIMEN

SEQ ID NO: 59886 - protein, 644 aa, Homo sapiens
MSRQFSSRSGYRSGGGFSSGSAGIINYQRRTTSSSTRRSGGGGGRFSSCGGGGGSFGAGGGFGSRSLVNLGGSKSISISVARGGGRGSGFGGGYGGGGFGGGGFGGGGFGGGGIGGGGFGGFGSGGGGFGGGGFGGGGYGGGYGPVCPPGGIQEVTINQSLLQPLNVEIDPEIQKVKSREREQIKSLNNQFASFIDKVRFLEQQNQVLQTKWELLQQVDTSTRTHNLEPYFESFINNLRRRVDQLKSDQSRLDSELKNMQDMVEDYRNKYEDEINKRTNAENEFVTIKKDVDGAYMTKVDLQAKLDNLQQEIDFLTALYQAELSQMQTQISETNVILSMDNNRSLDLDSIIAEVKAQYEDIAQKSKAEAESLYQSKYEELQITAGRHGDSVRNSKIEISELNRVIQRLRSEIDNVKKQISNLQQSISDAEQRGENALKDAKNKLNDLEDALQQAKEDLARLLRDYQELMNTKLALDLEIATYRTLLEGEESRMSGECAPNVSVSVSTSHTTISGGGSRGGGGGGYGSGGSSYGSGGGSYGSGGGGGGGRGSYGSGGSSYGSGGGSYGSGGGGGGHGSYGSGSSSGGYRGGSGGGGGGSSGGRGSGGGSSGGSIGGRGSSSGGVKSSGGSSSVRFVSTTYSGVTR

SEQ ID NO: 59887 - protein, 584 aa, Homo sapiens
MSVRYSSSKHYSSSRSGGGGGGGGCGGGGGVSSLRISSSKGSLGGGFSSGGFSGGSFSRGSSGGGCFGGSSGGYGGLGGFGGGSFRGSYGSSSFGGSYGGSFGGGSFGGGSFGGGSFGGGGFGGGGFGGGFGGGFGGDGGLLSGNEKVTMQNLNDRLASYLDKVRALEESNYELEGKIKEWYEKHGNSHQGEPRDYSKYYKTIDDLKNQILNLTTDNANILLQIDNARLAADDFRLKYENEVALRQSVEADINGLRRVLDELTLTKADLEMQIESLTEELAYLKKNHEEEMKDLRNVSTGDVNVEMNAAPGVDLTQLLNNMRSQYEQLAEQNRKDAEAWFNEKSKELTTEIDNNIEQISSYKSEITELRRNVQALEIELQSQLALKQSLEASLAETEGRYCVQLSQIQAQISALEEQLQQIRAETECQNTEYQQLLDIKIRLENEIQTYRSLLEGEGSSGGGGRGGGSFGGGYGGGSSGGGSSGGGYGGGHGGSSGGGYGGGSSGGGSSGGGYGGGSSSGGHGGSSSGGYGGGSSGGGGGGYGGGSSGGGSSSGGGYGGGSSSGGHKSSSSGSVGESSSKGPRY

SEQ ID NO: 59888 - protein, 456 aa, Homo sapiens
MTTTFLQTSSSTFGGGSTRGGSLLAGGGGFGGGSLSGGGGSRSISASSARFVSSGSGGGYGGGMRVCGFGGGAGSVFGGGFGGGVGGGFGGGFGGGDGGLLSGNEKITMQNLNDRLASYLDKVRALEEANADLEVKIHDWYQKQTPTSPECDYSQYFKTIEELRDKIMATTIDNSRVILEIDNARLAADDFRLKYENELALRQGVEADINGLRRVLDELTLARTDLEMQIEGLNEELAYLKKNHEEEMKEFSSQLAGQVNVEMDAAPGVDLTRVLAEMREQYEAMAEKNRRDVEAWFFSKTEELNKEVASNTEMIQTSKTEITDLRRTMQELEIELQSQLSMKAGLENSLAETECRYATQLQQIQGLIGGLEAQLSELRCEMEAQNQEYKMLLDIKTRLEQEIATYRSLLEGQDAKMAGIGIREASSGGGGSSSNFHINVEESVDGQVVSSHKREI

SEQ ID NO: 59889 - protein, 473 aa, Homo sapiens
MTTCSRQFTSSSSMKGSCGIGGGIGGGSSRISSVLAGGSCRAPSTYGGGLSVSSRFSSGGACGLGGGYGGGFSSSSSFGSGFGGGYGGGLGAGFGGGLGAGFGGGFAGGDGLLVGSEKVTMQNLNDRLASYLDKVRALEEANADLEVKIRDWYQRQRPSEIKDYSPYFKTIEDLRNKIIAATIENAQPILQIDNARLAADDFRTKYEHELALRQTVEADVNGLRRVLDELTLARTDLEMQIEGLKEELAYLRKNHEEEMLALRGQTGGDVNVEMDAAPGVDLSRILNEMRDQYEQMAEKNRRDAETWFLSKTEELNKEVASNSELVQSSRSEVTELRRVLQGLEIELQSQLSMKASLENSLEETKGRYCMQLSQIQGLIGSVEEQLAQLRCEMEQQSQEYQILLDVKTRLEQEIATYRRLLEGEDAHLSSQQASGQSYSSREVFTSSSSSSSRQTRPILKEQSSSSFSQGQSS

SEQ ID NO: 59890 - protein, 432 aa, Homo sapiens
MTTSIRQFTSSSSIKGSSGLGGGSSRTSCRLSGGLGAGSCRLGSAGGLGSTLGGSSYSSCYSFGSGGGYGSSFGGVDGLLAGGEKATMQNLNDRLASYLDKVRALEEANTELEVKIRDWYQRQAPGPARDYSQYYRTIEELQNKILTATVDNANILLQIDNARLAADDFRTKFETEQALRLSVEADINGLRRVLDELTLARADLEMQIENLKEELAYLKKNHEEEMNALRGQVGGEINVEMDAAPGVDLSRILNEMRDQYEKMAEKNRKDAEDWFFSKTEELNREVATNSELVQSGKSEISELRRTMQALEIELQSQLSMKASLEGNLAETENRYCVQLSQIQGLIGSVEEQLAQLRCEMEQQNQEYKILLDVKTRLEQEIATYRRLLEGEDAHLTQYKKEPVTTRQVRTIVEEVQDGKVISSREQVHQTTR

SEQ ID NO: 59891 - protein, 450 aa, Homo sapiens
MSLRLSSASRRSCPRPTTGSLRLYGGGTSFGTGNSCGISGIGSGFSSAFGGSSSGGNTGGGNPCAGFTVNERGLLSGNEKVTMQNLNDRLASYLDSVHALEEANADLEQKIKGWYEKFGPGSCRGLDHDYSRYFPIIDDLKNQIIASTTSNANAVLQIDNARLTADDFRLKYENELALHQSVEADVNGLRRVLDEITLCRTDLEIQYETLSEEMTYLKKNHKEEMQVLQCAAGGNVNVEMNAAPGVDLTVLLNNMRAEYEALAEQNRRDAEAWFNEKSASLQQQISEDVGATTSARNELTEMKRTLQTLEIELQSLLATKHSLECSLTETESNYCAQLAQIQAQIGALEEQLHQVRTETEGQKLEYEQLLDIKLHLEKEIETYCLLIGGDDGACKSGGYKSKDYGSGNVGSQVKDPAKAIVVKKVLEEVDQRSKILTTRLHSLEEKSQSN

SEQ ID NO: 59892 - protein, 459 aa, Homo sapiens
MSVRFSSTSRRLGSCGGTGSVRLSSGGAGFGAGNTCGVPGIGSGFSCAFGGTSSAGGYGGGLGGGSASCAAFTGNEHGLLSGNEKVTMQNLNDRLASYLENVRALEEANADLEQKIKGWYEKFGPGSCRGLDHDYSRYFPIIDKLKNQIISATTSNAHVVLQNDNARLTADDFRLKFENELALHQSVEADINGLRRVLDELTLCRTDLEIQLETLSEELAYLKKNHEEEMKALQCAAGGNVNVEMNAAPGVDLTVLLNNMRAEYEALAEQNRRDAEAWFNEKSASLQQQISDDAGATTSARNELTEMKRTLQTLEIELQSLLATKHSLECSLTETESNYCAQLAQIQAQIGALEEQLHQVRTETEGQKLEYEQLLDIKVHLEKEIETYCLLIDGEDGSCSKSKGYGGPGNQTKDSSKTTIVKTVVEEIDPRGKVLSSRVHTVEEKSTKVNNKNEQRVSS

SEQ ID NO: 59893 - protein, 639 aa, Homo sapiens
MSCQISCKSRGRGGGGGGFRGFSSGSAVVSGGSRRSTSSFSCLSRHGGGGGGFGGGGFGSRSLVGLGGTKSISISVAGGGGGFGAAGGFGGRGGGFGGGSSFGGGSGFSGGGFGGGGFGGGRFGGFGGPGGVGGLGGPGGFGPGGYPGGIHEVSVNQSLLQPLNVKVDPEIQNVKAQEREQIKTLNNKFASFIDKVRFLEQQNQVLQTKWELLQQMNVGTRPINLEPIFQGYIDSLKRYLDGLTAERTSQNSELNNMQDLVEDYKKKYEDEINKRTAAENDFVTLKKDVDNAYMIKVELQSKVDLLNQEIEFLKVLYDAEISQIHQSVTDTNVILSMDNSRNLDLDSIIAEVKAQYEEIAQRSKEEAEALYHSKYEELQVTVGRHGDSLKEIKIEISELNRVIQRLQGEIAHVKKQCKNVQDAIADAEQRGEHALKDARNKLNDLEEALQQAKEDLARLLRDYQELMNVKLALDVEIATYRKLLEGEECRMSGDLSSNVTVSVTSSTISSNVASKAAFGGSGGRGSSSGGGYSSGSSSYGSGGRQSGSRGGSGGGGSISGGGYGSGGGSGGRYGSGGGSKGGSISGGGYGSGGGKHSSGGGSRGGSSSGGGYGSGGGGSSSVKGSSGEAFGSSVTFSFR

SEQ ID NO: 59894 - protein, 534 aa, Homo sapiens
MIARQQCVRGGPRGFSCGSAIVGGGKRGAFSSVSMSGGAGRCSSGGFGSRSLYNLRGNKSISMSVAGSRQGACFGGAGGFGTGGFGAGGFGAGFGTGGFGGGFGGSFSGKGGPGFPVCPAGGIQEVTINQSLLTPLHVEIDPEIQKVRTEEREQIKLLNNKFASFIDKVQFLEQQNKVLETKWNLLQQQTTTTSSKNLEPLFETYLSVLRKQLDTLGNDKGRLQSELKTMQDSVEDFKTKYEEEINKRTAAENDFVVLKKDVDAAYLNKVELEAKVDSLNDEINFLKVLYDAELSQMQTHVSDTSVVLSMDNNRNLDLDSIIAEVRAQYEEIAQRSKAEAEALYQTKVQQLQISVDQHGDNLKNTKSEIAELNRMIQRLRAEIENIKKQCQTLQVSVADAEQRGENALKDAHSKRVELEAALQQAKEELARMLREYQELMSVKLALDIEIATYRKLLEGEEYRMSGECQSAVSISVVSGSTSTGGISGGLGSGSGFGLSSGFGSGSGSGFGFGGSVSGSSSSKIISTTTLNKRR

SEQ ID NO: 59895 - protein, 590 aa, Homo sapiens
MSRQSSVSFRSGGSRSFSTASAITPSVSRTSFTSVSRSGGGGGGGFGRVSLAGACGVGGYGSRSLYNLGGSKRISISTRGGSFRNRFGAGAGGGYGFGGGAGSGFGFGGGAGGGFGLGGGAGFGGGFGGPGFPVCPPGGIQEVTVNQSLLTPLNLQIDPSIQRVRTEEREQIKTLNNKFASFIDKVRFLEQQNKVLDTKWTLLQEQGTKTVRQNLEPLFEQYINNLRRQLDSIVGERGRLDSELRNMQDLVEDFKNKYEDEINKRTTAENEFVMLKKDVDAAYMNKVELEAKVDALMDEINFMKMFFDAELSQMQTHVSDTSVVLSMDNNRNLDLDSIIAEVKAQYEEIANRSRTEAESWYQTKYEELQQTAGRHGDDLRNTKHEITEMNRMIQRLRAEIDNVKKQCANLQNAIADAEQRGELALKDARNKLAELEEALQKAKQDMARLLREYQELMNTKLALDVEIATYRKLLEGEECRLSGEGVGPVNISVVTSSVSSGYGSGSGYGGGLGGGLGGGLGGGLAGGSSGSYYSSSSGGVGLGGGLSVGGSGFSASSGRGLGVGFGSGGGSSSSVKFVSTTSSSRKSFKS

SEQ ID NO: 59896 - protein, 523 aa, Homo sapiens
MSRQFTCKSGAAAKGGFSGCSAVLSGGSSSSFRAGSKGLSGGFGSRSLYSLGGVRSLNVASGSGKSGGYGFGRGRASGFAGSMFGSVALGPVCPTVCPPGGIHQVTVNESLLAPLNVELDPEIQKVRAQEREQIKALNNKFASFIDKVRFLEQQNQVLETKWELLQQLDLNNCKNNLEPILEGYISNLRKQLETLSGDRVRLDSELRNVRDVVEDYKKRYEEEINKRTAAENEFVLLKKDVDAAYANKVELQAKVESMDQEIKFFRCLFEAEITQIQSHISDMSVILSMDNNRNLDLDSIIDEVRTQYEEIALKSKAEAEALYQTKFQELQLAAGRHGDDLKNTKNEISELTRLIQRIRSEIENVKKQASNLETAIADAEQRGDNALKDARAKLDELEGALHQAKEELARMLREYQELMSLKLALDMEIATYRKLLESEECRMSGEFPSPVSISIISSTSGGSVYGFRPSMVSGGYVANSSNCISGVCSVRGGEGRSRGSANDYKDTLGKGSSLSAPSKKTSR

SEQ ID NO: 59897 - protein, 535 aa, Homo sapiens
MRSSVSRQTYSTKGGFSSNSASGGSGSQARTSFSSVTVSRSSGSGGGAHCGPGTGGFGSRSLYNLGGHKSISVSVAGGALLGRALGGFGFGSRAFMGQGAGRQTFGPACPPGGIQEVTVNQSLLTPLHVEIDPEIQRVRTQEREQIKTLNNKFASFIDKVRFLEQQNKVLETKWALLQEQGQNLGVTRNNLEPLFEAYLGSMRSTLDRLQSERGRLDSELRNVQDLVEDFKNKYEDEINKHTAAENEFVVLKKDVDAAYMGRMDLHGKVGTLTQEIDFLQQLYEMELSQVQTHVSNTNVVLSMDNNRNLDLDSIIAEVKAQYELIAQRSRAEAEAWYQTKYEELQVTAGKHGDNLRDTKNEIAELTRTIQRLQGEADAAKKQCQQLQTAIAEAEQRGELALKDAQKKLGDLDVALHQAKEDLTRLLRDYQELMNVKLALDVEIATYRKLLESEESRMSGECPSAVSISVTGNSTTVCGGGAASFGGGISLGGSGGATKGGFSTNVGYSTVKGGPVSAGTSILRKTTTVKTSSQRY

SEQ ID NO: 59898 - protein, 177 aa, Homo sapiens
MACCQTSFCGFPSCSTSGTCGSSCCQPSCCETSSCQPRCCETSCCQPSCCQTSFCGFPSFSTGGTCDSSCCQPSCCETSCCQPSCYQTSSCGTGCGIGGGIGYGQEGSSGAVSTRIRWCRPDCRVEGTCLPPCCVVSCTPPSCCQLHHAEASCCRPSYCGQSCCRPVCCCYCSEPTC

SEQ ID NO: 59899 - protein, 174 aa, Homo sapiens
MTCCQTSFCGYPSFSISGTCGSSCCQPSCCETSCCQPRSCQTSFCGFPSFSTSGTCSSSCCQPSCCETSCCQPSCCETSCCQPSCCQISSCGTGCGIGGGISYGQEGSSGAVSTRIRWCRPDSRVEGTYLPPCCVVSCTPPSCCQLHHAQASCCRPSYCGQSCCRPVCCCEPTC

SEQ ID NO: 59900 - protein, 163 aa, Homo sapiens
MSFNCSTRNCSSRPIGGRCIVPVAQVTTTSTTDADCLGGICLPSSFQTGSWLLDHCQETCCEPTACQPTCYRRTSCVSNPCQVTCSRQTTCISNPCSTTYSRPLTFVSSGCQPLGGISSVCQPVGGISTVCQPVGGVSTVCQPACGVSRTYQQSCVSSCRRTC

SEQ ID NO: 59901 - protein, 105 aa, Homo sapiens
MGCCPGDCFTCCTQEQNCCEECCCQPGCCGCCGSCCGCGGSGCGGSGCGGSCCGSSCCGSGCGGCGGCGGCGGGCCGSSCCGSSCCGSGCCGPVCCQPTPICDTK

SEQ ID NO: 59902 - protein, 98 aa, Homo sapiens
MYCCALRSCSVPTGPATTFCSFDKSCRCGVCLPSTCPHEISLLQPICCDTCPPPCCKPDTYVPTCWLLNNCHPTPGLSGINLTTYVQPGCESPCEPRC

SEQ ID NO: 59903 - protein, 98 aa, Homo sapiens
MDCCASRSCSVPTGPATTICSSDKSCRCGVCLPSTCPHTVWLLEPICCDNCPPPCHIPQPCVPTCFLLNSCQPTPGLETLNLTTFTQPCCEPCLPRGC

SEQ ID NO: 59904 - protein, 127 aa, Homo sapiens
MVNSCCGSVCSDQGCDQGLCQETCCRPSCCQTTCCCPSCVVSSCCRPSCSQTTCCQTTCCRPSCCRPVCCQTTCRPSCGVSSCCRPLCCQTTCRPSCGVSSCCRPLCCQTTCCRTTCCRPSCCGSSC

SEQ ID NO: 59905 - protein, 201 aa, Homo sapiens
MVNSCCGSVCSDQGCGLENCCRPSCCQTTCCRTTCCRPSCCVSSCCRPQCCQSVCCQPTCCRPSCCQTTCCRTTCCRPSCCVSSCCRPQCCQSVCCQPTCCRPSCCQTTCCRTTCCRPSCCVSSCCRPQCCQSVCCQPTCCRPSCCISSSCCPSCCESSCCRPCCCLRPVCGRVSCHTTCYRPTCVISTCPRPLCCASSCC

SEQ ID NO: 59906 - protein, 186 aa, Homo sapiens
MVSSCCGSVSSEQSCGLENCCRPSCCQTTCCRTTCCRPSCCKPQCCQSVCYQPTCCHPSCCISSCCHPYCCESSCCRPCCCRPSCCQTTCCRTTCCRTTCCCPSCCVSSCCRPQCCQSVCCQPTCCRPSCCISSCCHPSCCESSCCRPCCCVRPVCGRVSCHTTCYRPTCVISTCPRPLCCASSCC

SEQ ID NO: 59907 - protein, 177 aa, Homo sapiens
MGCCGCSRGCGSGCGGCGSSCGGCGSGCGGCGSGRGGCGSGCGGCSSSCGGCGSRCYVPVCCCKPVCSWVPACSCTSCGSCGGSKGGCGSCGGSKGGCGSCGGSKGGCGSCGCSQSSCCKPCCCSSGCGSSCCQSSCCKPCCCQSSCCVPVCCQSSCCKPCCCQSNCCVPVCCQCKI

SEQ ID NO: 59908 - protein, 174 aa, Homo sapiens
MTHCCSPCCQPTCCRTTCCRTTCWKPTTVTTCSSTPCCQPACCVSSCCQPCCRPTCCQNTCCRTTCCQPTCVTSCCQPSCCSTPCCQPTCCGSSCCGQTSCGSSCGQSSSCAPVYCRRTCYYPTTVCLPGCLNQSCGSNCCQPCCRPACCETTCCRTTCFQPTCVSSCCQPSCC

SEQ ID NO: 59909 - protein, 159 aa, Homo sapiens
MTHCCSPCCQPTCCRTTCWQPTTVTTCSSTPCCQPSCCVSSCCQPCCHPTCCQNTCCRTTCCQPICVTSCCQPSCCSTPCCQPTCCGSSCGQSSSCAPVYCRRTCYHPTSVCLPGCLNQSCGSNCCQPCCRPACCETTCCRTTCFQPTCVYSCCQPSCC

SEQ ID NO: 59910 - protein, 154 aa, Homo sapiens
MTHCCSPCCQPTCCRTTCCRTTCWKPTTVTTCSSTPCCQPSCCVSSCCQPCCRPTCCQNTCCQPTCVTSCCQPSCCSTPCCQPTCCGSSCDQSSSCAPVYCRRTCYYPTTVCLPGCLNQSCGSNCCQPCCRPACCETTCFQPTCVSSCCQPFCC

SEQ ID NO: 59911 - protein, 159 aa, Homo sapiens
MTHCCSPCCQPTCCRTTCWKPTTVTTCSSTPCCQPSCCVSSCCQPCCRPTCCQNTCCQPICVTSCCQPSCCSTPCCQPTCCGQTSCGSSCGQSSSCAPVYCRRTCYHPTTVCLPGCLNQSCGSSCCQPCCRPACCETTCCRTTCFQPTCVYSCCQPSCC

SEQ ID NO: 59912 - protein, 416 aa, Homo sapiens [sequence omitted]

SEQ ID NO: 59913 - protein, 448 aa, Homo sapiens
MTSSCCVTNNLQASLKSCPRPASVCSSGVNCRPELCLGYVCQPMACLPSVCLPTTFRPASCLSKTYLSSSCQAASGISGSMGPGSWYSEGAFNGNEKETMQFLNDRLASYLTRVRQLEQENAELESRIQEASHSQVLTMTPDYQSHFRTIEELQQKILCTKAENARMVVNIDNAKLAADDFRAKYEAELAMRQLVEADINGLRRILDDLTLCKADLEAQVESLKEELMCLKKNHEEEVGSLRCQLGDRLNIEVDAAPPVDLTRVLEEMRCQYEAMVEANRRDVEEWFNMQMEELNQQVATSSEQLQNYQSDIIDLRRTVNTLEIELQAQHSLRDSLENTLTESEARYSSQLAQMQCMITNVEAQLAEIRADLERQNQEYQVLLDVRARLEGEINTYRSLLESEDCKLPCNPCSTPSCTTCVPSPCVTRTVCVPRTVGMPCSPCPQGRY

SEQ ID NO: 59914 - protein, 425 aa, Homo sapiens
MYSSSSCKLPSLSPVARSFSACSVGLGRSSYRATSCLPALCLPAGGFATSYSGGGGWFGEGILTGNEKETMQSLNDRLAGYLEKVRQLEQENASLESRIREWCEQQVPYMCPDYQSYFRTIEELQKKTLCSKAENARLVVEIDNAKLAADDFRTKYETEVSLRQLVESDINGLRRILDDLTLCKSDLEAQVESLKEELLCLKKNHEEEVNSLRCQLGDRLNVEVDAAPPVDLNRVLEEMRCQYETLVENNRRDAEDWLDTQSEELNQQVVSSSEQLQSCQAEIIELRRTVNALEIELQAQHSMRDALESTLAETEARYSSQLAQMQCMITNVEAQLAEIRADLERQNQEYQVLLDVRARLECEINTYRGLLESEDSKLPCNPCAPDYSPSKSCLPCLPAASCGPSAARTNCSPRPICVPCPGGRF

SEQ ID NO: 59915 - protein, 383 aa, Homo sapiens
MFWTFKEWFWLERFWLPPTIKWSDLEDHDGLVFVKPSHLYVTIPYAFLLLIIRRVFEKFVASPLAKSFGIKETVRKVTPNTVLENFFKHSTRQPLQTDIYGLAKKCNLTERQVERWFRSRRNQERPSRLKKFQEACWRFAFYLMITVAGIAFLYDKPWLYDLWEVWNGYPKQPLLPSQYWYYILEMSFYWSLLFRLGFDVKRKDFLAHIIHHLAAISLMSFSWCANYIRSGTLVMIVHDVADIWLESAKMFSYAGWTQTCNTLFFIFSTIFFISRLIVFPFWILYCTLILPMYHLEPFFSYIFLNLQLMILQVLHLYWGYYILKMLNRCIFMKSIQDVRSDDEDYEEEEEEEEEEATKGKEMDCLKNGLGAERHLIPNGQHGH

SEQ ID NO: 59916 - protein, 118 aa, Homo sapiens
MSCQQNQQQCQPPPKCIPKCPPKCLTPRCPPKCPPKCPPVSSCCSVSSGGCCGSSSGGSCGSSSGGCCSSGGGGCCLSHHRRRRSHCHRPQSSGCCSQPSGGSSCCGGGSGQHSGGCC

SEQ ID NO: 59917 - protein, 118 aa, Homo sapiens
MSCQQSQQQCQPPPKCTPKCPPKCPTPKCPPKCPPKCPPVSSCCSVSSGGCCGSSSGGSCGSSSGGCCSSGGGGCCLSHHRRRRSHCHRPQSSGCCSQPSGGSSCCGGGSGQHSGGCC

SEQ ID NO: 59918 - protein, 118 aa, Homo sapiens
MSCQQSQQQCQPPPKCTPKCPPKCPTPKCPPKCPPKCPPVSSCCSVSSGGCCGSSSGGSCGSSSGGCCSSGGGGCCLSHHRHHRSHRHRPQSSDCCSQPSGGSSCCGGGSGQHSGGCC

SEQ ID NO: 59919 - protein, 106 aa, Homo sapiens
MSCQQNQQQCQPPPKCPPKCPPKCPPKCRPQCPAPCPPPVSSCCGPSSGGCCGSSSGGCCSSGGGGCCLSHHRPRLFHRHRHQSPDCCECEPSGGSGCCHSSGDCC

SEQ ID NO: 59920 - protein, 110 aa, Homo sapiens
MSCQQNQQQCQPPPKCPPKCTPKCPPKCPPKCPPQCPAPCFPAVSSCCGPSSGSCCGPSSGGCCSSGAGGCSLSHHRPRLFHRRRHQSPDCCESEPSGGSGCCHSSGGCC

SEQ ID NO: 59921 - protein, 92 aa, Homo sapiens
MSCQQNQQQCQPPPKCPSPKCPPKSPVQCLPPASSGCAPSSGGCGPSSEGGCFLNHHRRHHRCRRQRPNSCDRGSGQQGGGSGCGHGSGGCC

SEQ ID NO: 59922 - protein, 92 aa, Homo sapiens
MSCQQNQKQCQPPPKCPSPKCPPKNPVQCLPPASSGCAPSSGGCGPSSEGGCFLNHHRRHHRCRRQRSNSCDRGSGQQGGGSGCCHGSGGCC

SEQ ID NO: 59923 - protein, 118 aa, Homo sapiens
MSCQQSQQQCQPPPKCTPKCPPKCTPKCPPKCPPKCPPQCSAPCPPPVSSCCGSSSGGCCSSEGGGCCLSHHRPRQSLRRRPQSSSCCGSGSGQQSGGSSCCHSSGGSGCCHSSGGCC

SEQ ID NO: 59924 - protein, 136 aa, Homo sapiens
MSNVPHKSSLPEGIRPGTVLRIRGLVPPNASRFHVNLLCGEEQGSDAALHFNPRLDTSEVVFNSKEQGSWGREERGPGVPFQRGQPFEVLIIASDDGFKAVVGDAQYHHFRHRLPLARVRLVEVGGDVQLDSVRIF

SEQ ID NO: 59925 - protein, 487 aa, Homo sapiens
MSCHFPGSPPWALAGQPGASAPDWSTPDPFAAFLLSQVQALEQRNQLLETRWSFLQGQDSAIFDLGHLYEEYQGRLQEELRKVSQERGQLEANLLQVLEKVEEFRIRYEDEISKRTDMEFTFVQLKKVACPACPRGSFLMGPGPSFPPDILLSFMPNQSPQRLKSQDQQTDRGIPPSPSSSFFEALSQISSGITPTLTQEAAPQPTPALGPSIPSPTTHHCCQPQDLDAECLHRTELETKLKSLESFVELMKTIYEQELKDLAAQVKDVSVTVGMDSRCHIDLSGIVEEVKAQYDAVAARSLEEAEAYSRSQLEEQAARSAEYGSSLQSSRSEIADLNVRIQKLRSQILSVKSHCLKLEENIKTAEEQGELAFQDAKTKLAQLEAALQQAKQDMARQLRKYQELMNVKLALDIEIATYRKLVEGEEGRMDSPSATVVSAVQSRCKTAASRSGLSKAPSRKKKGSKGPVIKITEMSEKYFSQESEVSE

SEQ ID NO: 59926 - protein, 275 aa, Homo sapiens
MEEVREGHALGGGMEADGPASLQELPPSPRSPSPPPSPPPLPSPPSLPSPAAPEAPELPEPAQPSEAHARQLLLEEWGPLSGGLELPQRLTWKLLLLRRPLYRNLLRSPNPEGINIYEPAPPTGPTQRPLETLGNFRGWYIRTEKLQQNQSWTVKQQCVDLLAEGLWEELLDDEQPAITVMDWFEDSRLDACVYELHVWLLAADRRTVIAQHHVAPRTSGRGPPGRWVQVSHVFRHYGPGVRFIHFLHKAKNRMEPGGLRRTRVTDSSVSVQLRE

SEQ ID NO: 59927 - protein, 171 aa, Homo sapiens
MQNLNDRLASYLDKMRALEEANTELEVKIRDWYQRQAPGPARDYSQYYRTIEELQNKILTATLNNANILLQIDNAHLAAADFCTKFETEQALRLSVEAAINGLRRVLDGLTLARADLEMQIENLKEELAYLKKNHEEEINALRGQVGGEINVEMDAAPGMDLSRILNEMHE

SEQ ID NO: 59928 - protein, 151 aa, Homo sapiens
MQNLNDRLASYLDKMRALEEANTELEVKIRDWYQRQAPGPARDYSQYYRTIEELQNKILTATLNNANILLQIDNAHLAAADFCTKVLDGLTLARADLEMQIENLKEELAYLKKNHEEEINALRGQVGGEINVEMDAAPGMDLSRILNEMHE

SEQ ID NO: 59929 - protein, 175 aa, Homo sapiens
MQNLNDRLASYLDKMRALEEANTELEVKIRDWYQRQAPGPARDYSQYYRTIEELQNKILTATLNNANILLQIDNAHLAAADFCTKFETEQALRLSVEAAINGLRRVLDGLTLARADLEMQIENLKEELAYLKKNHEEVRWLGQKVKDAEEWVAEPWGRAMAEAMGESRAEQAHWD

SEQ ID NO: 59930 - protein, 102 aa, Homo sapiens
MFFFIKERNQLFRTGPHLSSGVISVPHRPAELGALYRTLSSLKYPSWRVRTPHEDFSGVKFRRHGADNHEASAATATTAAATTVAAAAAAAAAAAAARVTLT

SEQ ID NO: 59931 - protein, 102 aa, Homo sapiens; identical to SEQ ID NO: 59930

SEQ ID NO: 59932 - protein, 159 aa, Homo sapiens
MTHCCSPCCQPTCCRTTCWKPTTVTTCSSTPCCQPSCCVSSCCQPCCRPTCCQNTCCQPICVTSCCQPSCCSTPCCQPTCCGQTSCGSSCGQSSSCAPVYCRRTCYHPTTVCLPGCLNQSCGSNCCQPCCRPACCETTCCRTTCFQPTCVSSCCQPSCC

SEQ ID NO: 59933 - protein, 201 aa, Homo sapiens; identical to SEQ ID NO: 59905

SEQ ID NO: 59934 - protein, 177 aa, Homo sapiens; identical to SEQ ID NO: 59898

SEQ ID NO: 59935 - protein, 174 aa, Homo sapiens; identical to SEQ ID NO: 59899

SEQ ID NO: 59936 - protein, 98 aa, Homo sapiens; identical to SEQ ID NO: 59902

SEQ ID NO: 59937 - protein, 98 aa, Homo sapiens; identical to SEQ ID NO: 59903

SEQ ID NO: 59938 - protein, 104 aa, Homo sapiens
MQLSQIQGLIGSVEEQLAQLRCEMEQQSREYQILLDMKTRLEQEIATYRCLLEGEDAHLSSPHASGQSCSSRVVFTSSSSSSSRQTWPILKEQGSSSFSQGQCS

SEQ ID NO: 59939 - protein, 85 aa, Homo sapiens
MQHLGDRLASYLDKVRALEEANADLEVKIRDWYQRQRPSEIKDYSPYFKTIEDLRHKIIAATIENAQPILQIDNARLAADDFRTN

SEQ ID NO: 59940 - protein, 126 aa, Homo sapiens
MQHLGDRLASYLDKVRALEEANADLEVKIRDWYQRQRPSEIKDYSPYFKTIEDLRHKIIAATIENAQPILQIDNARLEHELALRLTVEAGVNGLCRVLDELTLARTDLEMQIEGLKEELAYLRKNH

SEQ ID NO: 59941 - protein, 39 aa, Homo sapiens
MSAENGQQREPLMSFDHQEMPKWNQISMNSANGRRGKGR

SEQ ID NO: 59942 - protein, 102 aa, Homo sapiens; identical to SEQ ID NO: 59930

SEQ ID NO: 59943 - protein, 102 aa, Homo sapiens; identical to SEQ ID NO: 59930

SEQ ID NO: 59944 - protein, 86 aa, Homo sapiens
MGSSSEASFRSAQASCSGARRQGLGRGDQNLSVMPPNGRAQTHTPGWVSDPLVLGAQVHGGCRGIEALSVSSGSWSSATVWILTVQ

SEQ ID NO: 59945 - protein, 39 aa, Homo sapiens; identical to SEQ ID NO: 59941

SEQ ID NO: 59946 - protein, 171 aa, Homo sapiens [sequence omitted]

SEQ ID NO: 59947 - protein, 151 aa, Homo sapiens
MQNLNDRLASYLDKMRALEEANTELEVKIRDWYQRQAPGPARDYSQYYRTIEELQNKILTATLNNANILLQIDNAHLAAADFCTKVLDGLTLARADLEMQIENLKEELAYLKKNHEEEINALRGQVGGEINVEMDAAPGMDLSRILNEMRE

SEQ ID NO: 59948 - protein, 175 aa, Homo sapiens; identical to SEQ ID NO: 59929

SEQ ID NO: 59949 - protein, 98 aa, Homo sapiens
MQLSQIQGLIGSVEEQLAQLCCEMEQQSREYQILLDMKTRLEQEIATYRRLLEGEDAHLSSPHASGQSCSSRVGKAPEAPRHCNPSACFHGVGARPFS

SEQ ID NO: 59950 - protein, 104 aa, Homo sapiens [sequence omitted]

SEQ ID NO: 59951 - protein, 604 aa, Homo sapiens
MENWSRHYPRGSCNTTGAGSDICFMQKIKASRSEPDLYCDPRGTLRKGTLGSKGQKTTQNRYSFYSTCSGQKAIKKCPVRPPSCASKQDPVYIPPISCNKDLSFGHSRASSKICSEDIECSGLTIPKAVQYLSSQDEKYQAIGAYYIQHTCFQDESAKQQVYQLGGICKLVDLLRSPNQNVQQAAAGALRNLVFRSTTNKLETRRQNGIREAVSLLRRTGNAEIQKQLTGLLWNLSSTDELKEELIADALPVLADRVIIPFSGWCDGNSNMSREVVDPEVFFNATGCLRNLSSADAGRQTMRNYSGLIDSLMAYVQNCVAASRCDDKSVENCMCVLHNLSYRLDAEVPTRYRQLEYNARNAYTEKSSTGCFSNKSDKMMNNNYDCPLPEEETNPKGSGWLYHSDAIRTYLNLMGKSKKDATLEACAGALQNLTASKGLMSSGMSQLIGLKEKGLPQIARLLQSGNSDVVRSGASLLSNMSRHPLLHRVMGNQVFPEVTRLLTSHTGNTSNSEDILSSACYTVRNLMASQPQLAKQYFSSSMLNNIINLCRSSASPKAAEAARLLLSDMWSSKELQGVLRQQGFDRNMLGTLAGANSLRNFTSRF

SEQ ID NO: 59952 - protein, 363 aa, Homo sapiens [sequence omitted]

SEQ ID NO: 59953 - protein, 198 aa, Homo sapiens
MLLILLSVALLALSSAQNLNEDVSQEESPSLIAGKPQGPPPQGGNQPQGPPPPPGKPQGPPPQGGNKPQGPPPPGKPQGPPPQGDKSRSPRSPPGKPQGPPPQGGKPQGPPPQGGNKPQGPPPPGKPQGPPPQGGSKSRSARSPPGKPQGPPQQEGNNPQGPPPPAGGNPQQPQAPPAGQPQGPPRPPQGGRPSRPPQ

SEQ ID NO: 59954 - protein, 332 aa, Homo sapiens
MLLILLSVALLALSSAQNLNEDVSQEESPSLIAGKPQGPPPQGGNQPQGPPPPPGKPQGPPPQGGNKPQGPPPPGKPQGPPPQGDKSRSPRSPPGKPQGPPPQGGNQPQGPPPPPGKPQGPPPQGGNKPQGPPPPGKPQGPPPQGDNKSRSSRSPPGKPQGPPPQGGNQPQGPPPPPGKPQGPPPQGGNKPQGPPPPGKPQGPPPQGDKSRSSRSPPGKPQGPPPQGGNQPQGPPPPPGKPQGPPPQGGNKPQGPPPPGKPQGPPPQGGSKSRSARSPPGKPQGPPQQEGNNPQGPPPPAGGNPQQPQAPPAGQPQGPPRPPQGGRPSRPPQ

SEQ ID NO: 59955 - protein, 260 aa, Homo sapiens
MLLILLSVALLALSSAQNLNEDVSQEESPSLIAGKPQGPPPQGGNQPQGPPPPPGKPQGPPPQGGNKPQGPPPPGKPQGPPPQGDKSRSPRSPPGKPQGPPPQGGNQPQGPPPPPGKPQGPPPQGGNKPQGPPPPGKPQGPPPQGDNKSRSSRSPPGKPQGPPPQGGKPQGPPPQGGNKPQGPPPPGKPQGPPPQGGSKSRSARSPPGKPQGPPQQEGNNPQGPPPPAGGNPQQPQAPPAGQPQGPPRPPQGGRPSRPPQ

SEQ ID NO: 59956 - protein, 178 aa, Homo sapiens
MLLILLSVALLALSSAQNLNEDVSQEESPSLIAGKPQGPPPQGGNQPQGPPPPPGKPQGPPPQGGNKPQGPPPPGKPQGPPPQGDKSRSPRSPPGKPQGPPPQGGKPQGPPPQGGSKSRSARSPPGKPQGPPQQEGNNPQGPPPPAGGNPQQPQAPPAGQPQGPPRPPQGGRPSRPPQ

SEQ ID NO: 59957 - protein, 333 aa, Homo sapiens
MLLILLSVALLALSSAQNLNEDVSQEESPSLIAGKPQGPPPQGGNQPQGPPPPPGKPQGPPPQGGNKPQGPPPPGKPQGPPPQGDKSRSPRSPPGKPQGPPPQGGNQPQGPPPPPGKPQGPPPQGGNKPQGPPPPGKPQGPPPQGDNKSQSARSPPGKPQGPPPQGGNQPQGPPPPPGKPQGPPPQGGNKPQGPPPPGKPQGPPPQGGSKSRSSRSPPGKPQGPPPQGGNQPQGPPPPPGKPQGPPPQGGNKPQGPPPPGKPQGPPPQGGSKSRSARSPPGKPQGPPQQEGNNPQGPPPPAGGNPQQPQAPPAGQPQGPPRPPQGGRPSRPPQ

SEQ ID NO: 59958 - protein, 136 aa, Homo sapiens; identical to SEQ ID NO: 59924

SEQ ID NO: 59959 - protein, 67 aa, Homo sapiens; identical to SEQ ID NO: 59834

SEQ ID NO: 59960 - protein, 198 aa, Homo sapiens; identical to SEQ ID NO: 59953

SEQ ID NO: 59961 - protein, 332 aa, Homo sapiens; identical to SEQ ID NO: 59954

SEQ ID NO: 59962 - protein, 260 aa, Homo sapiens; identical to SEQ ID NO: 59955

SEQ ID NO: 59963 - protein, 178 aa, Homo sapiens; identical to SEQ ID NO: 59956

SEQ ID NO: 59964 - protein, 333 aa, Homo sapiens; identical to SEQ ID NO: 59957

SEQ ID NO: 59965 - protein, 136 aa, Homo sapiens; identical to SEQ ID NO: 59924

SEQ ID NO: 59966 - protein, 316 aa, Homo sapiens
MSYQKKQPTPQPPVDCVKTSGGGGGGGGTGGGGCGFFGGGGSGGGSSGSGCGYSGGGGYSGGGCGGGSSGGGGGGGIGGCGGGSGGSVKYSGGGGSSGGGSGCFSSGGGGSGCFSSGGGGSSGGGSGCFSSGGGGSSGGGSGCFSSGGGGFSGQAVQCQSYGGVSSGGSSGGGSGCFSSGGGGGSVCGYSGGGSGGGSGCGGGSSGGSGSGYVSSQQVTQTSCAPQPSYGGGSSGGGGSGGSGCFSSGGGGGSSGCGGGSSGIGSGCIISGGGSVCGGGSSGGGGGGSSVGGSGSGKGVPICHQTQQKQAPTWPSK

SEQ ID NO: 59967 - protein, 128 aa, Homo sapiens
MRTALLLLAALAVATGPALTLRCHVCTSSSNCKHSVVCPASSRFCKTTNTVEPLRGNLVKKDCAESCTPSYTLQGQVSSGTSSTQCCQEDLCNEKLHNAAPTRTALAHSALSLGLALSLLAVILAPSL

SEQ ID NO: 59968 - protein, 125 aa, Homo sapiens
MKALMLLTLSVLLCWVSADIRCHSCYKVPVLGCVDRQSCRLEPGQQCLTTHAYLGKMWVFSNLRCGTPEEPCQEAFNQTNRKLGLTYNTTCCNKDNCNSAGPRPTPALGLVFLTSLAGLGLWLLH

SEQ ID NO: 59969 - protein, 346 aa, Homo sapiens
  VARIANT 80: Xaa = Any Amino Acid
MDPARKAGAQAMIWTAGWLLLLLLRGGAQALECYSCVQKADDGCSPNKMKTVKCAPGVDVCTEAVGAVETIHGQFSLAVXGCGSGLPGKNDRGLDLHGLLAFIQLQQCAQDRCNAKLNLTSRALDPAGNESAYPPNGVECYSCVGLSREACQGTSPPVVSCYNASDHVYKGCFDGNVTLTAANVTVSLPVRGCVQDEFCTRDGVTGPGFTLSGSCCQGSRCNSDLRNKTYFSPRIPPLVRLPPPEPTTVASTTSVTTSTSAPVRPTSTTKPMPAPTSQTPRQGVEHEASRDEEPRLTGGAAGHQDRSNSGQYPAKGGPQQPHNKGCVAPTAGLAALLLAVAAGVLL

SEQ ID NO: 59970 - protein, 208 aa, Homo sapiens
MKLPSISCPHECFEAILSLDTGYRAPVTLVRKGCWTGPPAGQTQSNADALPPDYSVVRGCTTDKCNAHLMTHDALPNLSQAPDPPTLSGAECYACIGVHQDDCAIGRSRRVQCHQDQTACFQGNGRMTVGNFSVPVYIRTCHRPSCTTEGSTSPWTAIDLQGSCCEGYLCNRKSMTQPFTSASATTPPRALQVLALLLPVLLLVGLSA

SEQ ID NO: 59971 - protein, 208 aa, Homo sapiens
MKLPSISCPHECFEAILSLDTGYRAPVTLVRKGCWTGPPAGQTQSNPDALPPDYSVVRGCTTDKCNAHLMTHDALPNLSQAPDPPTLSGAECYACIGVHQDDCAIGRSRRVQCHQDQTACFQGSGRMTVGNFSVPVYIRTCHRPSCTTEGTTSPWTAIDLQGSCCEGYLCNRKSMTQPFTSASATTPPRALQVLALLLPVLLLVGLSA

SEQ ID NO: 59972 - protein, 462 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRSSSIPHLGFIL

SEQ ID NO: 59973 - protein, 508 aa, Homo sapiens
MLRRALLCLAVAALVRADAPEEEDHVLVLRKSNFAEALAAHKYLLVEFYAPWCGHCKALAPEYAKAAGKLKAEGSEIRLAKVDATEESDLAQQYGVRGYPTIKFFRNGDTASPKEYTAGREADDIVNWLKKRTGPAATTLPDGAAAESLVESSEVAVIGFFKDVESDSAKQFLQAAEAIDDIPFGITSNSDVFSKYQLDKDGVVLFKKFDEGRNNFEGEVTKENLLDFIKHNQLPLVIEFTEQTAPKIFGGEIKTHILLFLPKSVSDYDGKLSNFKTAAESFKGKILFIFIDSDHTDNQRILEFFGLKKEECPAVRLITLEEEMTKYKPESEELTAERITEFCHRFLEGKIKPHLMSQELPEDWDKQPVKVLVGKNFEDVAFDEKKNVFVEFYAPWCGHCKQLAPIWDKLGETYKDHENIVIAKMDSTANEVEAVKVHSFPTLKFFPASADRTVIDYNGERTLDGFKKFLESGGQDGAGDDDDLEDLEEAEEPDMEEDDDQKAVKDEL

SEQ ID NO: 59974 - protein, 692 aa, Homo sapiens
MGTVSSRRSWWPLPLLLLLLLLLGPAGARAQEDEDGDYEELVLALRSEEDGLAEAPEHGTTATFHRCAKDPWRLPGTYVVVLKEETHLSQSERTARRLQAQAARRGYLTKILHVFHGLLPGFLVKMSGDLLELALKLPHVDYIEEDSSVFAQSIPWNLERITPPRYRADEYQPPDGGSLVEVYLLDTSIQSDHREIEGRVMVTDFENVPEEDGTRFHRQASKCDSHGTHLAGVVSGRDAGVAKGASMRSLRVLNCQGKGTVSGTLIGLEFIRKSQLVQPVGPLVVLLPLAGGYSRVLNAACQRLARAGVVLVTAAGNFRDDACLYSPASAPEVITVGATNAQDQPVTLGTLGTNFGRCVDLFAPGEDIIGASSDCSTCFVSQSGTSQAAAHVAGIAAMMLSAEPELTLAELRQRLIHFSAKDVINEAWFPEDQRVLTPNLVAALPPSTHGAGWQLFCRTVWSAHSGPTRMATAVARCAPDEELLSCSSFSRSGKRRGERMEAQGGKLVCRAHNAFGGEGVYAIARCCLLPQANCSVHTAPPAEASMGTRVHCHQQGHVLTGCSSHWEVEDLGTHKPPVLRPRGQPNQCVGHREASIHASCCHAPGLECKVKEHGIPAPQEQVTVACEEGWTLTGCSALPGTSHVLGAYAVDNTCVVRSRDVSTTGSTSEGAVTAVAICCRSRHLAQASQELQ

SEQ ID NO: 59975 - protein, 193 aa, Homo sapiens
MIRCGLACERCRWILPLLLLSAIAFDIIALAGRGWLQSSDHGQTSSLWWKCSQEGGGSGSYEEGCQSLMEYAWGRAAAAMLFCGFIILVICFILSFFALCGPQMLVFLRVIGGLLALAAVFQIISLVIYPVKYTQTFTLHANPAVTYIYNWAYGFGWAATIILIGCAFFFCCLPNYEDDLLGNAKPRYFYTSA

SEQ ID NO: 59976 - protein, 341 aa, Homo sapiens
MGTLPWLLAFFILGLQAWDTPTIVSRKEWGARPLACRALLTLPVAYIITDQLPGMQCQQQSVCSQMLRGLQSHSVYTIGWCDVAYNFLVGDDGRVYEGVGWNIQGLHTQGYNNISLGIAFFGNKIGSSPSPAALSAAEGLISYAIQKGHLSPRYIQPLLLKEETCLDPQHPVMPRKVCPNIIKRSAWEARETHCPKMNLPAKYVIIIHTAGTSCTVSTDCQTVVRNIQSFHMDTRNFCDIGYHFLVGQDGGVYEGVGWHIQGSHTYGFNDIALGIAFIGYFVEKPPNAAALEAAQDLIQCAVVEGYLTPNYLLMGHSDVVNILSPGQALYNIISTWPHFKH

SEQ ID NO: 59977 - protein, 117 aa, Homo sapiens
MRASSFLIVVVFLIAGTLVLEAAVTGVPVKGQDTVKGRVPFNGQDPVKGQVSVKGQDKVKAQEPVKGPVSTKPGSCPIILIRCAMLNPPNRCLKDTDCPGIKKCCEGSCGMACFVPQ

SEQ ID NO: 59978 - protein, 747 aa, Homo sapiens
MNHSPLKTALAYECFQDQDNSTLALPSDQKMKTGTSGRQRVQEQVMMTVKRQKSKSSQSSTLSHSNRGSMYDGLADNYNYGTTSRSSYYSKFQAGNGSWGYPIYNGTLKREPDNRRFSSYSQMENWSRHYPRGSCNTTGAGSDICFMQKIKASRSEPDLYCDPRGTLRKGTLGSKGQKTTQNRYSFYSTCSGQKAIKKCPVRPPSCASKQDPVYIPPISCNKDLSFGHSRASSKICSEDIECSGLTIPKAVQYLSSQDEKYQAIGAYYIQHTCFQDESAKQQVYQLGGICKLVDLLRSPNQNVQQAAAGALRNLVFRSTTNKLETRRQNGIREAVSLLRRTGNAEIQKQLTGLLWNLSSTDELKEELIADALPVLADRVIIPFSGWCDGNSNMSREVVDPEVFFNATGCLRKRLGMRELLALVPQRATSSRVNLSSADAGRQTMRNYSGLIDSLMAYVQNCVAASRCDDKSVENCMCVLHNLSYRLDAEVPTRYRQLEYNARNAYTEKSSTGCFSNKSDKMMNNNYDCPLPEEETNPKGSGWLYHSDAIRTYLNLMGKSKKDATLEACAGALQNLTASKGLMSSGMSQLIGLKEKGLPQIARLLQSGNSDVVRSGASLLSNMSRHPLLHRVMGNQVFPEVTRLLTSHTGNTSNSEDILSSACYTVRNLMASQPQLAKQYFSSSMLNNIINLCRSSASPKAAEAARLLLSDMWSSKELQGVLRQQGFDRNMLGTLAGANSLRNFTSRF

SEQ ID NO: 59979 - protein, 726 aa, Homo sapiens
MNHSPLKTALAYECFQDQDNSTLALPSDQKMKTGTSGRQRVQEQVMMTVKRQKSKSSQSSTLSHSNRGSMYDGLADNYNYGTTSRSSYYSKFQAGNGSWGYPIYNGTLKREPDNRRFSSYSQMENWSRHYPRGSCNTTGAGSDICFMQKIKASRSEPDLYCDPRGTLRKGTLGSKGQKTTQNRYSFYSTCSGQKAIKKCPVRPPSCASKQDPVYIPPISCNKDLSFGHSRASSKICSEDIECSGLTIPKAVQYLSSQDEKYQAIGAYYIQHTCFQDESAKQQVYQLGGICKLVDLLRSPNQNVQQAAAGALRNLVFRSTTNKLETRRQNGIREAVSLLRRTGNAEIQKQLTGLLWNLSSTDELKEELIADALPVLADRVIIPFSGWCDGNSNMSREVVDPEVFFNATGCLRNLSSADAGRQTMRNYSGLIDSLMAYVQNCVAASRCDDKSVENCMCVLHNLSYRLDAEVPTRYRQLEYNARNAYTEKSSTGCFSNKSDKMMNNNYDCPLPEEETNPKGSGWLYHSDAIRTYLNLMGKSKKDATLEACAGALQNLTASKGLMSSGMSQLIGLKEKGLPQIARLLQSGNSDVVRSGASLLSNMSRHPLLHRVMGNQVFPEVTRLLTSHTGNTSNSEDILSSACYTVRNLMASQPQLAKQYFSSSMLNNIINLCRSSASPKAAEAARLLLSDMWSSKELQGVLRQQGFDRNMLGTLAGANSLRNFTSRF

SEQ ID NO: 59980 - protein, 818 aa, Homo sapiens
MESLSPGGPTGHPYQGEASTCWQLTVRVLEARNLRWADLLSEADPYVILQLSTAPGMKFKTKTLTDTSHPVWNEAFRFLIQSQVKNVLELSIYDEDSVTEDDICFKVLYDISEVLPGKLLRKTFSQSPQGEEELDVEFLMEETSDRPENLITNKVIVARELSCLDVHLDSTGSTAVVADQDKLELELVLKGSYEDTQTSFLGTASAFRFHYMAALETELSGRLRSSRSNGWNGDNSAGYLTVPLRPLTIGKEVTMDVPAPNAPGVRLQLKAEGCPEELAVHLGFNLCAEEQAFLSRRKQVVAKALKQALQLDRDLQEDEVPVVGIMATGGGARAMTSLYGHLLALQKLGLLDCVTYFSGISGSTWTMAHLYGDPEWSQRDLEGPIRYAREHLAKSKLEVFSPERLASYRRELELRAEQGHPTTFVDLWALVLESMLHGQVMDQKLSGQRAALERGQNPLPLYLSLNVKENNLETLDFKEWVEFSPYEVGFLKYGAFVPPELFGSEFFMGRLMRRIPEPRICFLEAIWSNIFSLNLLDAWYDLTSSGESWKQHIKDKTRSLEKEPLTTSGTSSRLEASWLQPGTALAQAFKGFLTGRPLHQRSPNFLQGLQLHQDYCSHKDFSTWADYQLDSMPSQLTPKEPRLCLVDAAYFINTSSPSMFRPGRRLDLILSFDYSLSAPFEALQQTELYCRARGLPFPRVEPSPQDQHQPRECHLFSDPACPEAPILLHFPLVNASFKDHSAPGVQRSPAELQGGQVDLTGATCPYTLSNMTYKEEDFERLLRLSDYNVQTSQGAILQALRTALKHRTLEARPPRAQT

SEQ ID NO: 59981 - protein, 467 aa, Homo sapiens
MLGIWIVAFLFFGTSRGKEVCYERLGCFKDGLPWTRTFSTELVGLPWSPEKINTRFLLYTIHNPNAYQEISAVNSSTIQASYFGTDKITRINIAGWKTDGKWQRDMCNVLLQLEDINCINLDWINGSREYIHAVNNLRVVGAEVAYFIDVLMKKFEYSPSKVHLIGHSLGAHLAGEAGSRIPGLGRITGLDPAGPFFHNTPKEVRLDPSDANFVDVIHTNAARILFELGVGTIDACGHLDFYPNGGKHMPGCEDLITPLLKFNFNAYKKEMASFFDCNHARSYQFYAESILNPDAFIAYPCRSYTSFKAGNCFFCSKEGCPTMGHFADRFHFKNMKTNGSHYFLNTGSLSPFARWRHKLSVKLSGSEVTQGTVFLRVGGAIGKTGEFAIVSGKLEPGMTYTKLIDADVNVGNITSVQFIWKKHLFEDSQNKLGAEMVINTSGKYGYKSTYCSQDIMGPNILQNLKPC

SEQ ID NO: 59982 - protein, 437 aa, Homo sapiens
MVQMMRQFLYRVLPEDSYKVTTGKLHVSLTRLTDGENVVVSEFTSKEELIEALYCSCFVPVYCGLIPPTYRGVRYIDGGFTGMQPCAFWTDAITISTFSGQQDICPRDCPAIFHDFRMFNCSFQFSLENIARMTHALFPPDLVILHDYYYRGYEDAVLYLRRLNAVYLNSSSKRVIFPRVEVYCQIELALGNECPERSQPSLRARQASLEGATQPHKEWVPKGDGRGSHGPPVSQPVQTLEFTCESPVSAPVSPLEQPPAQPLASSTPLSLSGMPPVSFPAVHKPPSSTPGSSLPTPPPGLSPLSPQQQVQPSGSPARSLHSQAPTSHRPSLGPSTVGAPQTLPRSSLSAFPAQPPVEELGQEQPQAVALLVSSKPKSAVPLVHVKETVSKPYVTESPAEDSNWVNKVFKKNKQKTSGTRKGFPRHSGSKKPSSKVQ

SEQ ID NO: 59983 - protein, 436 aa, Homo sapiens
MVNLESMHTDIKMSGDVADSTDARSTLSQVEPGNDRKGLDFNRQIKTEDLSDSLQQTLSHRPCHLSQGPAMMSGNQMSGLNASPCQDMASLHPLQQLVLVPGHLQSVSQFLLSQTQPGQQGLQPNLLPFPQQQSGLLLPQTGPGLASQAFGHPGLPGSSLEPHLEASQHLPVPKHLPSSGGADEPSDLEELEKFAKTFKQRRIKLGFTQGDVGLAMGKLYGNDFSQTTISRFEALNLSFKNMCKLKPLLEKWLNDAESSPSDPSVSTPSSYPSLSEVFGRKRKKRTSIETNIRLTLEKRFQDNPKPSSEEISMIAEQLSMEKEVVRVWFCNRRQKEKRINCPVATPIKPPVYNSRLVSPSGSLGPLSVPPVHSTMPGTVTSSCSPGNNSRPSSPGSGLHASSPTASQNNSKAAVNSASSFNSSGSWYRWNHSTYLH

SEQ ID NO: 59984 - protein, 247 aa, Homo sapiens
MLLILLSVALLALSSAESSSEDVSQEESLFLISGKPEGRRPQGGNQPQRPPPPPGKPQGPPPQGGNQSQGPPPPPGKPEGRPPQGGNQSQGPPPHPGKPERPPPQGGNQSQGTPPPPGKPERPPPQGGNQSHRPPPPPGKPERPPPQGGNQSQGPPPHPGKPEGPPPQEGNKSRSARSPPGKPQGPPQQEGNKPQGPPPPGKPQGPPPAGGNPQQPQAPPAGKPQGPPPPPQGGRPPRPAQGQQPPQ

SEQ ID NO: 59985 - protein, 136 aa, Homo sapiens
MILNWKLLGILVLCLHTRGISGSEGHPSHPPAEDREEAGSPTLPQGPPVPGDPWPGAPPLFEDPPPTRPSRPWRDLPETGVWPPEPPRTDPPQPPRPDDPWPAGPQPPENPWPPAPEVDNRPQEEPDLDPPREEYR

SEQ ID NO: 59986 - protein, 156 aa, Homo sapiens
MAPARAGFCPLLLLLLLGLWVAEIPVSAKPKGMTSSQWFKIQHMQPSPQACNSAMKNINKHTKRCKDLNTFLHEPFSSVAATCQTPKIACKNGDKNCHQSHGPVSLTMCKLTSGKYPNCRYKEKRQNKSYVVACKPPQKKDSQQFHLVPVHLDRVL

SEQ ID NO: 59987 - protein, 2391 aa, Homo sapiens
MTDLLRSVVTVIDVFYKYTKQDGECGTLSKGELKELLEKELHPVLKNPDDPDTVDVIMHMLDRDHDRRLDFTEFLLMIFKLTMACNKVLSKEYCKASGSKKHRRGHRHQEEESETEEDEEDTPGHKSGYRHSSWSEGEEHGYSSGHSRGTVKCRHGSNSRRLGRQGNLSSSGNQEGSQKRYHRSSCGHSWSGGKDRHGSSSVELRERINKSHISPSRESGEEYESGSGSNSWERKGHGGLSCGLETSGHESNSTQSRIREQKLGSSCSGSGDSGRRSHACGYSNSSGCGRPQNASSSCQSHRFGGQGNQFSYIQSGCQSGIKGGQGHGCVSGGQPSGCGQPESNPCSQSYSQRGYGARENGQPQNCGGQWRTGSSQSSCCGQYGSGGSQSCSNGQHEYGSCGRFSNSSSSNEFSKCDQYGSGSSQSTSFEQHGTGLSQSSGFEQHVCGSGQTCGQHESTSSQSLGYDQHGSSSGKTSGFGQHGSGSGQSSGFGQCGSGSGQSSGFGQHGSVSGQSSGFGQHGSVSGQSSGFGQHESRSRQSSYGQHGSGSSQSSGYGQYGSRETSGFGQHGLGSGQSTGFGQYGSGSGQSSGFGQHGSGSGQSSGFGQHESRSGQSSYGQHSSGSSQSSGYGQHGSRQTSGFGQHGSGSSQSTGFGQYGSGSGQSSGFGQHVSGSGQSSGFGQHESRSGHSSYGQHGFGSSQSSGYGQHGSSSGQTSGFGQHELSSGQSSSFGQHGSGSGQSSGFGQHGSGSGQSSGFGQHESRSGQSSYGQHSSGSSQSSGYGQHGSRQTSGFGQHGSGSSQSTGFGQYGSGSGQSAGFGQHGSGSGQSSGFGQHESRSHQSSYGQHGSGSSQSSGYGQHGSSSGQTSGFGQHRSSSGQYSGFGQHGSGSGQSSGFGQHGTGSGQYSGFGQHESRSHQSSYGQHGSGSSQSSGYGQHGSSSGQTFGFGQHRSGSGQSSGFGQHGSGSGQSSGFGQHESGSGKSSGFGQHESRSSQSNYGQHGSGSSQSSGYGQHGSSSGQTTGFGQHRSSSGQYSGFGQHGSGSDQSSGFGQHGTGSGQSSGFGQYESRSRQSSYGQHGSGSSQSSGYGQHGSNSGQTSGFGQHRPGSGQSSGFGQYGSGSGQSSGFGQHGSGTGKSSGFAQHEYRSGQSSYGQHGTGSSQSSGCGQHESGSGPTTSFGQHVSGSDNFSSSGQHISDSGQSTGFGQYGSGSGQSTGLGQGESQQVESGSTVHGRQETTHGQTINTTRHSQSGQGQSTQTGSRVTRRRRSSQSENSDSEVHSKVSHRHSEHIHTQAGSHYPKSGSTVRRRQGTTHGQRGDTTRHGHSGHGQSTQTGSRTSGRQRFSHSDATDSEVHSGVSHRPHSQEQTHSQAGSQHGESESTVHERHETTYGQTGEATGHGHSGHGQSTQRGSRTTGRRGSGHSESSDSEVHSGGSHRPQSQEQTHGQAGSQHGESGSTVHGRHGTTHGQTGDTTRHAHYHHGKSTQRGSSTTGRRGSGHSESSDSEVHSGGSHTHSGHTHGQSGSQHGESESIIHDRHRITHGQTGDTTRHSYSGHEQTTQTGSRTTGRQRTSHSESTDSEVHSGGSHRPHSREHTYGQAGSQHEEPEFTVHERHGTTHGQIGDTTGHSHSGHGQSTQRGSRTTGRQRSSHSESSDSEVHSGVSHTHTGHTHGQAGSQHGQSESIVPERHGTTHGQTGDTTRHAHYHHGLTTQTGSRTTGRRGSGHSEYSDSEGYSGVSHTHSGHTHGQARSQHGESESIVHERHGTIHGQTGDTTRHAHSGHGQSTQTGSRTTGRRSSGHSEYSDSEGHSGFSQRPHSRGHTHGQAGSQHGESESIVDERHGTTHGQTGDTSGHSQSGHGQSTQSGSSTTGRRRSGHSESSDSEVHSGGSHTHSGHTHSQARSQHGESESTVHKRHQTTHGQTGDTTEHGHPSHGQTIQTGSRTTGRRGSGHSEYSDSEGPSGVSHTHSGHTHGQAGSHYPESGSSVHERHGTTHGQTADTTRHGHSGHGQSTQRGSRTTGRRASGHSEYSDSEGHSGVSHTHSGHAHGQAGSQHGESGSSVHERHGTTHGQTGDTTRHAHSGHGQSTQRGSRTAGRRGSGHSESSDSEVHSGVSHTHSGHTYGQARSQHGESGSAIHGRQGTIHGQTGDTTRHGQSGHGQSTQTGSRTTGRQRSSHSESSDSEVHSEASPTHSGHTHSQAGSRHGQSGSSGHGRQGTTHGQTGDTTRHAHYGYGQSTQRGSRTTGRRGSGHSESSDSEVHSWGSHTHSGHIQGQAGSQQRQPGSTVHGRLETTHGQTGDTTRHGHSGYGQSTQTGSRSSRASHFQSHSSERQRHGSSQVWKHGSYGPAEYDYGHTGYGPSGGSRKSISNSHLSWSTDSTANKQLSRH

SEQ ID NO: 59988 - protein, 104 aa, Homo sapiens
MGQCRSANAEDAQEFSDVERAIETLIKNFHQYSVEGGKETLTPSELRDLVTQQLPHLMPSNCGLEEKIANLGSCNDSKLEFRSFWELIGEAAKSVKLERPVRGH

SEQ ID NO: 59989 - protein, 101 aa, Homo sapiens
MSNTQAERSIIGMIDMFHKYTRRDDKIDKPSLLTMMKENFPNFLSACDKKGTNYLADVFEKKDKNEDKKIDFSEFLSLLGDIATDYHKQSHGAAPCSGGSQ

SEQ ID NO: 59990 - protein, 101 aa, Homo sapiens
MSNTQAERSIIGMIDMFHKYTGRDGKIEKPSLLTMMKENFPNFLSACDKKGIHYLATVFEKKDKNEDKKIDFSEFLSLLGDIAADYHKQSHGAAPCSGGSQ

SEQ ID NO: 59991 - protein, 247 aa, Homo sapiens
MHLARLVGSCSLLLLLGALSGWAASDDPIEKVIEGINRGLSNAEREVGKALDGINSGITHAGREVEKVFNGLSNMGSHTGKELDKGVQGLNHGMDKVAHEINHGIGQAGKEAEKLGHGVNNAAGQAGKEADKAVQGFHTGVHQAGKEAEKLGQGVNHAADQAGKEVEKLGQGAHHAAGQAGKELQNAHNGVNQASKEANQLLNGNHQSGSSSHQGGATTTPLASGASVNTPFINLPALWRSVANIMP

SEQ ID NO: 59992 - protein, 90 aa, Homo sapiens
MKLSVCLLLVTLALCCYQANAEFCPALVSELLDFFFISEPLFKLSLAKFDAPPEAVAAKLGVKRCTDQMSLQKRSLIAEVLVKILKKCSV

SEQ ID NO: 59993 - protein, 414 aa, Homo sapiens
MNPTLGLAIFLAVLLTVKGLLKPSFSPRNYKALSEVQGWKQRMAAKELARQNMDLGFKLLKKLAFYNPGRNIFLSPLSISTAFSMLCLGAQDSTLDEIKQGFNFRKMPEKDLHEGFHYIIHELTQKTQDLKLSIGNTLFIDQRLQPQRKFLEDAKNFYSAETILTNFQNLEMAQKQINDFISQKTHGKINNLIENIDPGTVMLLANYIFFRARWKHEFDPNVTKEEDFFLEKNSSVKVPMMFRSGIYQVGYDDKLSCTILEIPYQKNITAIFILPDEGKLKHLEKGLQVDTFSRWKTLLSRRVVDVSVPRLHMTGTFDLKKTLSYIGVSKIFEEHGDLTKIAPHRSLKVGEAVHKAELKMDERGTEGAAGTGAQTLPMETPLVVKIDKPYLLLIYSEKIPSVLFLGKIVNPIGK

SEQ ID NO: 59994 - protein, 391 aa, Homo sapiens
MDSLGAVSTRLGFDLFKELKKTNDGNIFFSPVGILTAIGMVLLGTRGATASQLEEVFHSEKETKSSRIKAEEKEVIENTEAVHQQFQKFLTEISKLTNDYELNITNRLFGEKTYLFLQKYLDYVEKYYHASLEPVDFVNAADESRKKINSWVESKTNEKIKDLFPDGSISSSTKLVLVNMVYFKGQWDREFKKENTKEEKFWMNKSTSKSVQMMTQSHSFSFTFLEDLQAKILGIPYKNNDLSMFVLLPNDIDGLEKIIDKISPEKLVEWTSPGHMEERKVNLHLPRFEVEDGYDLEAVLAAMGMGDAFSEHKADYSGMSSGSGLYAQKFLHSSFVAVTEEGTEAAAATGIGFTVTSAPGHENVHCNHPFLFFIRHNESNSILFFGRFSSP

SEQ ID NO: 59995 - protein, 380 aa, Homo sapiens
MASLAAANAEFCFNLFREMDDNQGNGNVFFSSLSLFAALALVRLGAQDDSLSQIDKLLHVNTASGYGNSSNSQSGLQSQLKRVFSDINASHKDYDLSIVNGLFAEKVYGFHKDYIECAEKLYDAKVERVDFTNHLEDTRRNINKWVENETHGKIKNVIGEGGISSSAVMVLVNAVYFKGKWQSAFTKSETINCHFKSPKCSGKAVAMMHQERKFNLSVIEDPSMKILELRYNGGINMYVLLPENDLSEIENKLTFQNLMEWTNPRRMTSKYVEVFFPQFKIEKNYEMKQYLRALGLKDIFDESKADLSGIASGGRLYISRMMHKSYIEVTEEGTEATAATGSNIVEKQLPQSTLFRADHPFLFVIRKDDIILFSGKVSCP

SEQ ID NO: 59996 - protein, 103 aa, Homo sapiens
MASRWAVQLLLVAAWSMGCGEALKCYTCKEPMTSASCRTITRCKPEDTACMTTLVTVEAEYPFNQSPVVTRSCSSSCVATDPDSIGAAHLIFCCFRDLCNSEL

SEQ ID NO: 59997 - protein, 1064 aa, Homo sapiens
MKIATVSVLLPLALCLIQDAASKNEDQEMCHEFQAFMKNGKLFCPQDKKFFQSLDGIMFINKCATCKMILEKEAKSQKRARHLARAPKATAPTELNCDDFKKGERDGDFICPDYYEAVCGTDGKTYDNRCALCAENAKTGSQIGVKSEGECKSSNPEQDVCSAFRPFVRDGRLGCTRENDPVLGPDGKTHGNKCAMCAELFLKEAENAKREGETRIRRNAEKDFCKEYEKQVRNGRLFCTRESDPVRGPDGRMHGNKCALCAEIFKQRFSEENSKTDQNLGKAEEKTKVKREIVKLCSQYQNQAKNGILFCTRENDPIRGPDGKMHGNLCSMCQAYFQAENEEKKKAEARARNKRESGKATSYAELCSEYRKLVRNGKLACTRENDPIQGPDGKVHGNTCSMCEVFFQAEEEEKKKKEGKSRNKRQSKSTASFEELCSEYRKSRKNGRLFCTRENDPIQGPDGKMHGNTCSMCEAFFQQEERARAKAKREAAKEICSEFRDQVRNGTLICTREHNPVRGPDGKMHGNKCAMCASVFKLEEEEKKNDKEEKGKVEAEKVKREAVQELCSEYRHYVRNGRLPCTRENDPIEGLDGKIHGNTCSMCEAFFQQEAKEKERAEPRAKVKREAEKETCDEFRRLLQNGKLFCTRENDPVRGPDGKTHGNKCAMCKAVFQKENEERKRKEEEDQRNAAGHGSSGGGGGNTQDECAEYREQMKNGRLSCTRESDPVRDADGKSYNNQCTMCKAKLEREAERKNEYSRSRSNGTGSESGKDTCDEFRSQMKNGKLICTRESDPVRGPDGKTHGNKCTMCKEKLEREAAEKKKKEDEDRSNTGERSNTGERSNDKEDLCREFRSMQRNGKLICTRENNPVRGPYGKMHINKCAMCQSIFDREANERKKKDEEKSSSKPSNNAKDECSEFRNYIRNNELICPRENDPVHGADGKFYTNKCYMCRAVFLTEALERAKLQEKPSHVRASQEEDSPDSFSSLDSEMCKDYRVLPRIGYLCPKDLKPVCGDDGQTYNNPCMLCHENLIRQTNTHIRSTGKCEESSTPGTTAASMPPSDE

SEQ ID NO: 59998 - protein, 80 aa, Homo sapiens
MKLSGMFLLLSLALFCFLTGVFSQGGQVDCGEFQDPKVYCTRESNPHCGSDGQTYGNKCAFCKAIVKSGGKISLKHPGKC

SEQ ID NO: 59999 - protein, 85 aa, Homo sapiens
MKITGGLLLLCTVVYFCSSSEAASLSPKKVDCSIYKKYPVVAIPCPITYLPVCGSDYITYGNECHLCTESLKSNGRVQFLHDGSC

SEQ ID NO: 60000 - protein, 72 aa, Homo sapiens
MSYQQQQCKQPCQPPPVCPTPKCPEPCPPPKCPEPCPPPKCPQPCPPQQCQQKYPPVTPSPPCQPKYPPKSK

SEQ ID NO: 60001 - protein, 72 aa, Homo sapiens
MSYQQQQCKQPCQPPPVCPTPKCPEPCPPPKCPEPCPSPKCPQPCPPQQCQQKYPPVTPSPPCQPKCPPKSK

SEQ ID NO: 60002 - protein, 72 aa, Homo sapiens
MSYQQQQCKQPCQPPPVCPTPKCPEPCPPPKCPEPCPPPKCPQPCPPQQCQQKCPPVTPSPPCQPKCPPKSK

SEQ ID NO: 60003 - protein, 73 aa, Homo sapiens
MSYQQQQCKQPCQPPPVCPTPKCPEPCPPPKCPEPYLPPPCPPEHCPPPPCQDKCPPVQPYPPCQQKYPPKSK

SEQ ID NO: 60004 - protein, 79 aa, Homo sapiens
MSSQQQQRQQQQCPPQRAQQQQVKQPCQPPPVKCQETCAPKTKDPCAPQVKKQCPPKGTIIPAQQKCPSAQQASKSKQK

SEQ ID NO: 60005 - protein, 1943 aa, Homo sapiens
MSPLLRSICDITEIFNQYVSHDCDGAALTKKDLKNLLEREFGAVLRRPHDPKTVDLILELLDLDSNGRVDFNEFLLFIFKVAQACYYALGQATGLDEEKRARCDGKESLLQDRRQEEDQRRFEPRDRQLEEEPGQRRRQKRQEQERELAEGEEQSEKQERLEQRDRQRRDEELWRQRQEWQEREERRAEEEQLQSCKGHETEEFPDEEQLRRRELLELRRKGREEKQQQRRERQDRVFQEEEEKEWRKRETVLRKEEEKLQEEEPQRQRELQEEEEQLRKLERQELRRERQEEEQQQQRLRREQQLRRKQEEERREQQEERREQQERREQQEERREQQLRREQEERREQQLRREQEEERREQQLRREQEEERREQQLRREQQLRREQQLRREQQLRREQQLRREQQLRREQQLRREQQLRREQQLRREQEEERHEQKHEQERREQRLKREQEERRDWLKREEETERHEQERRKQQLKRDQEEERRERWLKLEEEERREQQERREQQLRREQEERREQRLKRQEEEERLQQRLRSEQQLRREQEERREQLLKREEEKRLEQERREQRLKREQEERRDQLLKREEERRQQRLKREQEERLEQRLKREEVERLEQEERREQRLKREEPEEERRQQLLKSEEQEERRQQQLRREQQERREQRLKREEEEERLEQRLKREHEEERREQELAEEEQEQARERIKSRIPKWQWQLESEADARQSKVYSRPRKQEGQRRRQEQEEKRRRRESELQWQEEERAHRQQQEEEQRRDFTWQWQAEEKSERGRQRLSARPPLREQRERQLRAEERQQREQRFLPEEEEKEQRRRQRREREKELQFLEEEEQLQRRERAQQLQEEEDGLQEDQERRRSQEQRRDQKWRWQLEEERKRRRHTLYAKPALQEQLRKEQQLLQEEEEELQREEREKRRRQEQERQYREEEQLQQEEEQLLREEREKRRRQERERQYRKDKKLQQKEEQLLGEEPEKRRRQEREKKYREEEELQQEEEQLLREEREKRRRQEWERQYRKKDELQQEEEQLLREEREKRRLQERERQYREEEELQQEEEQLLGEERETRRRQELERQYRKEEELQQEEEQLLREEPEKRRRQERERQCREEEELQQEEEQLLREEREKRRRQELERQYREEEEVQQEEEQLLREEPEKRRRQELERQYREEEELQQEEEQLLREEQEKRRQERERQYREEEELQRQKRKQRYRDEDQRSDLKWQWEPEKENAVRDNKVYCKGRENEQFRQLEDSQLRDRQSQQDLQHLLGEQQERDREQERRRWQQRDRHFPEEEQLEREEQKEAKRRDRKSQEEKQLLREEREEKRRRQETDRKFREEEQLLQEREEQPLRRQERDRKFREEELRHQEQGRKFLEEEQRLRRQERERKFLKEEQQLRCQEREQQLRQDRDRKFREEEQQLSRQERDRKFREEEQQVRRQERERKFLEEEQQLRQERHRKFREEEQLLQEREEQQLHRQERDRKFLEEEQQLRRQERDRKFREQELRSQEPERKFLEEEQQLHRQQRQRKFLQEEQQLRRQERGQQRRQDRDRKFREEEQLRQEREEQQLSRQERDRKFRLEEQKVRRQEQERKFMEDEQQLRRQEGQQQLRQERDRKFREDEQLLQEREEQQLHRQERDRKFLEEEPQLRRQEREQQLRHDRDRKFREEEQLLQEGEEQQLRRQERDRKFREEEQQLRRQERERKFLQEEQQLRRQELERKFREEEQLRQETEQEQLRRQERYRKILEEEQLRPEREEQQLRRQERDRKFREEEQLRQEREEQQLRSQESDRKFREEEQLRQEREEQQLRPQQRDGKYRWEEEQLQLEEQEQRLRQERDRQYRAEEQFATQEKSRREEQELWQEEEQKRRQERERKLREEHIRRQQKEEQRHRQVGEIKSQEGKGHGRLLEPGTHQFASVPVRSSPLYEYIQEQRSQYRP

SEQ ID NO: 60006 - protein, 1949 aa, Homo sapiens
  VARIANT 1756,1907: Xaa = Any Amino Acid
MSPLLRSICDITEIFNQYVSHDCDGAALTKKDLKNLLEREFGAVLRRPHDPKTVDLILELLDRDSNGRVDFNEFLLFIFKVAQACYYALGQATGLDEEKRARCDGKESLLQDRRQEEDQRRFEPRDRQLEEEPGQRRRQKRQEQERELAEGEEQSEKQERLEQRDRQRRDEELWRQRQEWQEREERRAEEEQLQSCKGHETEEFPDEEQLRRRELLELRRKGREEKQQQRRERQDRVFQEEEEKEWRKRETVLRKEEEKLQEEEPQRQRELQEEEEQLRKLERQELRRERQEEEQQQQRLRREQQLRRKQEEERREQQEERREQQERREQQEERREQQLRREQEERREQQLRREQEEERREQQLRREQEEERREQQLRREQQLRREQQLRREQQLRREQQLRREQQLRREQQLRREQQLRREQQLRREQQLRREQEEERHEQKHEQERREQRLKREQEERRDWLKREEETERHEQERRKQQLKRDQEEERRERWLKLEEEERREQQERREQQLRREQEERREQRLKRQEEEERLQQRLRSEQQLRREQEERREQLLKREEEKRLEQERREQRLKREQEERRDQLLKREEERRQQRLKREQEERLEQRLKREEVERLEQEERREQRLKREEPEEERRQQLLKSEEQEERRQQQLRREQQERREQRLKREEEEERLEQRLKREHEEERREQELAEEEQEQARERIKSRIPKWQWQLESEADARQSKVYSRPRKQEGQRRRQEQEEKRRRRESELQWQEEERAHRQQQEEEQRRDFTWQWQAEEKSERGRQRLSARPPLREQRERQLRAEERQQREQRFLPEEEEKEQRRRQRREREKELQFLEEEEQLQRRERAQQLQEEEDGLQEDQERRRSQEQRRDQKWRWQLEEERKRRRHTLYAKPALQEQLRKEQQLLQEEEEELQREEREKRRRQEQERQYREEEQLQQEEEQLLREEREKRRRQERERQYRKDKKLQQKEEQLLGEEPEKRRRQEREKKYREEEELQQEEEQLLREEREKRRRQEWERQYRKKDELQQEEEQLLREEREKRRLQERERQYREEEELQQEEEQLLGEERETRRRQELERQYRKEEELQQEEEQLLREEPEKRRRQERERQCREEEELQQEEEQLLREEREKRRRQELERQYREEEEVQQEEEQLLREEPEKRRRQELERQYREEEELQQEEEQLLREEQEKRRQERERQYREEEELQRQKRKQRYRDEDQRSDLKWQWEPEKENAVRDNKVYCKGRENEQFRQLEDSQLRDRQSQQDLQHLLGEQQERDREQERRRWQQRDRHFPEEEQLEREEQKEAKRRDRKSQEEKQLLREEREEKRRRQETDRKFREEEQLLQEREEQPLRRQERDRKFREEELRHQEQGRKFLEEEQRLRRQERERKFLKEEQQLRCQEREQQLRQDRDRKFREEEQQLSRQERDRKFREEEQQVRRQERERKFLEEEQQLRQERHRKFREEEQLLQEREEQQLHRQERDRKFLEEEQQLRRQERDRKFREQELRSQEPERKFLEEEQQLHRQQRQRKFLQEEQQLRRQERGQQRRQDRDRKFREEEQLRQEREEQQLSRQERDRKFRLEEQKVRRQEQERKFMEDEQQLRRQEGQQQLRQERTENSAKTNSCSRKGKNSSCTAKSVTENSSRRNRSCAARSANNSCVTTATENSVKRNSCSRKGRNSSCAAKSVTENSAKRNSSSAVRNERENSSRRNSSCAARNWRENSVRRNSCAKKRSKSSCAAKNATEKSXRKSSSVRKGKNSSCAARSATENSARRNSSARRGRNSSCAAKSLTENSARRNSYARRGKNSSCAPNSVTESIAGKKSSSNLRNKSRGCGRSETGSTGRRSSLPRRRRVVVRNKNYGKKRSRNVARNGKGNYGKNTSAASRRRNRGTAKSGRXNPKKGRAMGGFWSPALISLPVSQCAPALSMSTSKSRDLNTAL

SEQ ID NO: 60007 - protein, 817 aa, Homo sapiens
MMDGPRSDVGRWGGNPLQPPTTPSPEPEPEPDGRSRRGGGRSFWARCCGCCSCRNAADDDWGPEPSDSRGRGSSSGTRRPGSRGSDSRRPVSRGSGVNAAGDGTIREGMLVVNGVDLLSSRSDQNRREHHTDEYEYDELIVRRGQPFHMLLLLSRTYESSDRITLELLIGNNPEVGKGTHVIIPVGKGGSGGWKAQVVKASGQNLNLRVHTSPNAIIGKFQFTVRTQSDAGEFQLPFDPRNEIYILFNPWCPEDIVYVDHEDWRQEYVLNESGRIYYGTEAQIGERTWNYGQFDHGVLDACLYILDRRGMPYGGRGDPVNVSRVISAMVNSLDDNGVLIGNWSGDYSRGTNPSAWVGSVEILLSYLRTGYSVPYGQCWVFAGVTTTVLRCLGLATRTVTNFNSAHDTDTSLTMDIYFDENMKPLEHLNHDSVWNFHVWNDCWMKRPDLPSGFDGWQVVDATPQETSSGIFCCGPCSVESIKNGLVYMKYDTPFIFAEVNSDKVYWQRQDDGSFKIVYVEEKAIGTLIVTKAISSNMREDITYLYKHPEGSDAERKAVETAAAHGSKPNVYANRGSAEDVAMQVEAQDAVMGQDLMVSVMLINHSSSRRTVKLHLYLSVTFYTGVSGTIFKETKKEVELAPGASDRVTMPVAYKEYRPHLVDQGAMLLNVSGHVKESGQVLAKQHTFRLRTPDLSLTLLGAAVVGQECEVQIVFKNPLPVTLTNVVFRLEGSGLQRPKILNVGDIGGNETVTLRQSFVPVRPGPRQLIASLDSPQLSQVHGVIQVDVAPAPGDGGFFSDAGGDSHLGETIPMASRGGA

SEQ ID NO: 60008 - protein, 638 aa, Homo sapiens
MAQGLEVALTDLQSSRNNVRHHTEEITVDHLLVRRGQAFNLTLYFRNRSFQPGLDNIIFVVETEDAVYLDSEPQRQEYVMNDYGFIYQGSKNWIRPCPWNYGQFEDKIIDICLKLLDKSLHFQTDPATDCALRGSPVYVSRVVCAMINSNDDNGVLNGNWSENYTDGANPAEWTGSVAILKQWNATGCQPVRYGQCWVFAAVMCTVMRCLGIPTRVITNFDSGHDTDGNLIIDEYYDNTGRILGNKKKDTIWNFHVWNECWMARKDLPPAYGGWQVLDATPQEMSNGVYCCGPASVRAIKEGEVDLNYDTPFVFSMVNADCMSWLVQGGKEQKLHQDTSSVGNFISTKSIQSDERDDITENYKYEEGSLQERQVFLKALQKLKARSFHGSQRGAELQPSRPTSLSQDSPRSLHTPSLRPSDVVQVSLKFKLLDPPNMGQDICFVLLALNMSSQFKDLKVNLSAQSLLHDGSPLSPFWQDTAFITLSPKEAKTYPCKISYSQYSQYLSTDKLIRISALGEEKSSPEKILVNKIITLSYPSITINVLGAAVVNQPLSIQVIFSNPLSEQVEDCVLTVEGSGLFKKQQKVFLGVLKPQHQASIILETVPFKSGQRQIQANMRSNKFKDIKGYRNVYVDFAL

SEQ ID NO: 60009 - protein, 720 aa, Homo sapiens
MAQGLEVALTDLQSSRNNVRHHTEEITVDHLLVRRGQAFNLTLYFRNRSFQPGLDNIIFVVETGPLSDLALGTRAVFSLARHHSPSPWIAWLETNGATSTEVSLCAPPTAAVGRYLLKIHIDSFQGSVTAYQLGEFILLFNPWCPEDAVYLDSEPQRQEYVMNDYGFIYQGSKNWIRPCPWNYGQFEDKIIDICLKLLDKSLHFQTDPATDCALRGSPVYVSRVVCAMINSNDDNGVLNGNWSENYTDGANPAEWTGSVAILKQWNATGCQPVRYGQCWVFAAVMCTVMRCLGIPTRVITNFDSGHDTDGNLIIDEYYDNTGRILGNKKKDTIWNFHVWNECWMARKDLPPAYGGWQVLDATPQEMSNGVYCCGPASVRAIKEGEVDLNYDTPFVFSMVNADCMSWLVQGGKEQKLHQDTSSVGNFISTKSIQSDERDDITENYKYEEGSLQERQVFLKALQKLKARSFHGSQRGAELQPSRPTSLSQDSPRSLHTPSLRPSDVVQVSLKFKLLDPPNMGQDICFVLLALNMSSQFKDLKVNLSAQSLLHDGSPLSPFWQDTAFITLSPKEAKTYPCKISYSQYSQYLSTDKLIRISALGEEKSSPEKILVNKIITLSYPSITINVLGAAVVNQPLSIQVIFSNPLSEQVEDCVLTVEGSGLFKKQQKVFLGVLKPQHQASIILETVPFKSGQRQIQANMRSNKFKDIKGYRNVYVDFAL

SEQ ID NO: 60010 - protein, 247 aa, Homo sapiens
MIRRCFQVAARLGHHRGLLEAPRILPRLNPASAFGSSTDSMFSRFLPEKTDLKDYALPNASWCSDMLSLYQEFLEKTKSSGWIKLPSFKSNRDHIRGLKLPSGLAVSSDKGDCRIFTRCIQVEGQGFEYVIFFQPTQKKSVCLFQPGSYLEGPPGFAHGGSLAAMMDETFSKTAFLAGEGLFTLSLNIRFKNLIPVDSLVVMDVEVDKIEDQKLYMSCIAHSRDQQTVYAKSSGVFLQLQLEEESPQ

SEQ ID NO: 60011 - protein, 537 aa, Homo sapiens
MERDSHGNASPARTPSAGASPAQASPAGTPPGRASPAQASPAQASPAGTPPGRASPAQASPAGTPPGRASPGRASPAQASPAQASPAQASPARASPALASLSRSSSGRSSSARSASVTTSPTRVYLVRATPVGAVPIRSSPARSAPATRATRESPVQFWQGHTGIRYKEQRESCPKHAVRCDGVVDCKLKSDELGCVRFDWDKSLLKIYSGSSHQWLPICSSNWNDSYSEKTCRQLGFESAHRTTEVAHRDFANSFSILRYNSTIQESLHRSHCPSQRYISLQCSHCGLRAMTGRIVGGALASDSKWPWQVSLHFGTTHICGGTLIDAQWVLTAAHCFFVTREKVLEGWKVYAGTSNLHQLPEAASIAEIIINSNYTDEEDDYDIALMRLSKPLTLSAHIHPACLPMHGQTFSLNETCWITGFGKTRETDDKTSPFLREVQVNLIDFKKCNDYLVYDSYLTPRMMCAGDLHGGRDSCQGDSGGPLVCEQNNRWYLAGVTSWGTGCGQRNKPGVYTKVTEVLPWIYSKMESEVRFRKS

SEQ ID NO: 60012 - protein, 715 aa, Homo sapiens
MSQVMSSPLLAGGHAVSLAPCDEPRRTLHPAPSPSLPPQCSYYTTEGWGAQALMAPVPCMGPPGRLQQAPQVEAKATCFLPSPGEKALGTPEDLDSYIDFSLESLNQMILELDPTFQLLPPGTGGSQAELAQSTMSMRKKEESEALDIKYIEVTSARSRCHDWPQHCSSPSVTPPFGSPRSGGLLLSRDVPRETRSSSESLIFSGNQGRGHQRPLPPSEGLSPRPPNSPSISIPCMGSKASSPHGLGSPLVASPRLEKRLGGLAPQRGSRISVLSASPVSDVSYMFGSSQSLLHSSNSSHQSSSRSLESPANSSSSLHSLGSVSLCTRPSDFQAPRNPTLTMGQPRTPHSPPLAKEHASICPPSITNSMVDIPIVLINGCPEPGSSPPQRTPGHQNSVQPGAASPSNPCPATRSNSQTLSDAPFTTCPEGPARDMQPTMKFVMDTSKYWFKPNITREQAIELLRKEEPGAFVIRDSSSYRGSFGLALKVQEVPASAQNRPGEDSNDLIRHFLIESSAKGVHLKGADEEPYFGSLSAFVCQHSIMALALPCKLTIPQRELGGADGASDSTDSPASCQKKSAGCHTLYLSSVSVETLTGALAVQKAISTTFERDILPTPTVVHFEVTEQGITLTDVQRKVFFRRHYPLTTLRFCGMDPEQRKWQKYCKPSWIFGFVAKSQTEPQENVCHLFAEYDMVQPASQVIGLVTALLQDAERM

SEQ ID NO: 60013 - protein, 588 aa, Homo sapiens
MEAADASRSNGSSPEARDARSPSGPSGSLENGTKADGKDAKTTNGHGGEAAEGKSLGSALKPGEGRSALFAGNEWRRPIIQFVESGDDKNSNYFSMDSMEGKRSPYAGLQLGAAKKPPVTFAEKGELRKSIFSESRKPTVSIMEPGETRRNSYPRADTGLFSRSKSGSEEVLCDSCIGNKQKAVKSCLVCQASFCELHLKPHLEGAAFRDHQLLEPIRDFEARKCPVHGKTMELFCQTDQTCICYLCMFQEHKNHSTVTVEEAKAEKETELSLQKEQLQLKIIEIEDEAEKWQKEKDRIKSFTTNEKAILEQNFRDLVRDLEKQKEEVRAALEQREQDAVDQVKVIMDALDERAKVLHEDKQTREQLHSISDSVLFLQEFGALMSNYSLPPPLPTYHVLLEGEGLGQSLGNFKDDLLNVCMRHVEKMCKADLSRNFIERNHMENGGDHRYVNNYTNSFGGEWSAPDTMKRYSMYLTPKGGVRTSYQPSSPGRFTKETTQKNFNNLYGTKGNYTSRVWEYSSSIQNSDNDLPVVQGSSSFSLKGYPSLMRSQSPKAQPQTWKSGKQTMLSHYRPFYVNKGNGIGSNEAP

SEQ ID NO: 60014 - protein, 570 aa, Homo sapiens
MEAADASRSNGSSPEARDARSPSGPSGSLENGTKADGKDAKTTNGHGGEAAEGKSLGSALKPGEGRSALFAGNEWRRPIIQFVESGDDKNSNYFSMDSMEGKRSPYAGLQLGAAKKPPVTFAEKGELRKSIFSESRKPTVSIMEPGETRRNSYPRADTGLFSRSKSGSEEVLCDSCIGNKQKAVKSCLVCQASFCELHLKPHLEGAAFRDHQLLEPIRDFEARKCPVHGKTMELFCQTDQTCICYLCMFQEHKNHSTVTVEEAKAEKETELSLQKEQLQLKIIEIEDEAEKWQKEKDRIKSFTTNEKAILEQNFRDLVRDLEKQKEEVRAALEQREQDAVDQVKVIMDALDERAKVLHEDKQTREQLHSISDSVLFLQEFGALMSNYSLPPPLPTYHVLLEGEGLGQSLGNFKDDLLNVCMRHVEKMCKADLSRNFIERNHMENGGDHRYVNNYTNSFGGEWSAPDTMKRYSMYLTPKGGVRTSYQPSSPGRFTKETTQKNFNNLYGTKGNYTSRVWEYSSSIQNSDNDLPVVQGSSSFSLKGYPSLMRSQSPKAQPQTWKSGKQTMLVV

SEQ ID NO: 60015 - protein, 523 aa, Homo sapiens
MAGQRVLLLVGFLLPGVLLSEAAKILTISTVGGSHYLLMDRVSQILQDHGHNVTMLNHKRGPFMPDFKKEEKSYQVISWLAPEDHQREFKKSFDFFLEETLGGRGKFENLLNVLEYLALQCSHFLNRKDIMDSLKNENFDMVIVETFDYCPFLIAEKLGKPFVAILSTSFGSLEFGLPIPLSYVPVFRSLLTDHMDFWGRVKNFLMFFSFCRRQQHMQSTFDNTIKEHFTEGSRPVLSHLLLKAELWFINSDFAFDFARPLLPNTVYVGGLMEKPIKPVPQDLENFIAKFEDSGFVLVTLGSMVNTCQNPEIFKEMNNAFAHLPQGVIWKCQCSHWPKDVHLAANVKIVDWLPQSDLLAHPSIRLFVTHGGQNSIMEAIQHGVPMVGIPLFGDQPENMVRVEAKKFGVSIQLKKLKAETLALKMKQIMEDKRYKSAAVAASVILRSHPLSPTQRLVGWIDHVLQTGGATHLKPYVFQQPWHEQYLLDVFVFLLGLTLGTLWLCGKLLGMAVWWLRGARKVKET

SEQ ID NO: 60016 - protein, 99 aa, Homo sapiens
MKIPVLPAVVLLSLLVLHSAQGATLGGPEEESTIENYASRPEAFNTPFLNIDKLRSAFKADEFLNWHALFESIKRKLPFLNWDAFPKLKGLRSATPDAQ

SEQ ID NO: 60017 - protein, 310 aa, Homo sapiens
MAATGANAEKAESHNDCPVRLLNPNIAKMKEDILYHFNLTTSRHNFPALFGDVKFVCVGGSPSRMKAFIRCVGAELGLDCPGRDYPNICAGTDRYAMYKVGPVLSVSHGMGIPSISIMLHELIKLLYYARCSNVTIIRIGTSGGIGLEPGTVVITEQAVDTCFKAEFEQIVLGKRVIRKTDLNKKLVQELLLCSAELSEFTTVVGNTMCTLDFYEGQGRLDGALCSYTEKDKQAYLEAAYAAGVRNIEMESSVFAAMCSACGLQAAVVCVTLLNRLEGDQISSPRNVLSEYQQRPQRLVSYFIKKKLSKA

SEQ ID NO: 60018 - protein, 310 aa, Homo sapiens; identical to SEQ ID NO: 60017

SEQ ID NO: 60019 - protein, 466 aa, Homo sapiens
MALSAAYRFVLTEGQKRYFEKLVIYCDQYASLIPVSFVLGFYVTLVVNRWWSQYLCMPLPDALMCVVAGTVHGRDDRGRLYRRTLMRYAGLSAVLILRSVSTAVFKRFPTIDHVVEAGFMTREERKKFENLNSSYNKYWVPCVWFSNLAAQARREGRIRDNSALKLLLEELNVFRGKCGMLFHYDWISVPLVYTQVVTIALYSYFLACLIGRQFLDPAQGYKDHDLDLCVPIFTLLQFFFYAGWLKVAEQLINPFGEDDDDFETNFLIDRNFQVSMLAVDEMYDDLAVLEKDLYWDAAEARAPYTAATVFQLRQPSFQGSTFDITLAKEDMQFQRLDGLDGPMGGAPGDFLQRLLPAGAGMVAGGPLGRRLSFLLRKNSCVSEASTGASCSCAVVPEGAAPECSCGDPLLDPGLPEPEAPPPAGPEPLTLIPGPVEPFSIVTMPGPRGPAPPWLPSPIGEEEENLA

SEQ ID NO: 60020 - protein, 414 aa, Homo sapiens
MRVGGAFHLLLVCLSPALLSAVRINGDGQEVLYLAEGDNVRLGCPYVLDPEDYGPNGLDIEWMQVNSDPAHHRENVFLSYQDKRINHGSLPHLQQRVRFAASDPSQYDASINLMNLQVSDTATYECRVKKTTMATRKVIVTVQARPAVPMCWTEGHMTYGNDVVLKCYASGGSQPLSYKWAKISGHHYPYRAGSYTSQHSYHSELSYQESFHSSINQGLNNGDLVLKDISRADDGLYQCTVANNVGYSVCVVEVKVSDSRRIGVIIGIVLGSLLALGCLAVGIWGLVCCCCGGSGAGGARGAFGYGNGGGVGGGACGDLASEIREDAVAPGCKASGRGSRVTHLLGYPTQNVSRSLRRKYAPPPCGGPEDVALAPCTAAAACEAGPSPVYVKVKSAEPADCAEGPVQCKNGLLV

SEQ ID NO: 60021 - protein, 123 aa, Homo sapiens
MRTQSLLLLGALLAVGSQLPAVFGRKKGEKSGGCPPDDGPCLLSVPDQCVEDSQCPLTRKCCYRACFRQCVPRVSVKLGSCPEDQLRCLSPMNHLCHKDSDCSGKKRCCHSACGRDCRDPARG

SEQ ID NO: 60022 - protein, 355 aa, Homo sapiens
MQLTTCLRETLFTGASQKTSLWWLGIASFGVPEKLGCANLPLNSRQKELCKRKPYLLPSIREGARLGIQECGSQFRHERWNCMITAAATTAPMGASPLFGYELSSGTKETAFIYAVMAAGLVHSVTRSCSAGNMTECSCDTTLQNGGSASEGWHWGGCSDDVQYGMWFSRKFLDFPIGNTTGKENKVLLAMNLHNNEAGRQAVAKLMSVDCRCHGVSGSCAVKTCWKTMSSFEKIGHLLKDKYENSIQISDKTKRKMRRREKDQRKIPIHKDDLLYVNKSPNYCVEDKKLGIPGTQGRECNRTSEGADGCNLLCCGRGYNTHVVRHVERCECKFIWCCYVRCRRCESMTDVHTCK

SEQ ID NO: 60023 - protein, 365 aa, Homo sapiens
MDRAALLGLARLCALWAALLVLFPYGAQGNWMWLGIASFGVPEKLGCANLPLNSRQKELCKRKPYLLPSIREGARLGIQECGSQFRHERWNCMITAAATTAPMGASPLFGYELSSGTKETAFIYAVMAAGLVHSVTRSCSAGNMTECSCDTTLQNGGSASEGWHWGGCSDDVQYGMWFSRKFLDFPIGNTTGKENKVLLAMNLHNNEAGRQAVAKLMSVDCRCHGVSGSCAVKTCWKTMSSFEKIGHLLKDKYENSIQISDKTKRKMRRREKDQRKIPIHKDDLLYVNKSPNYCVEDKKLGIPGTQGRECNRTSEGADGCNLLCCGRGYNTHVVRHVERCECKFIWCCYVRCRRCESMTDVHTCK

SEQ ID NO: 60024 - protein, 90 aa, Homo sapiens
MNMKPATASALLLLLLGLAWTQGSHGWGADASSLQKRAGRADQNYNYNQHAYPTAYGGKYSVKTPAKGGVSPSSSASRVQPGLLQWVKFW

SEQ ID NO: 60025 - protein, 476 aa, Homo sapiens
MKFQGPLACLLLALCLGSGEAGPLQSGEESTGTNIGEALGHGLGDALSEGVGKAIGKEAGGAAGSKVSEALGQGTREAVGTGVRQVPGFGAADALGNRVGEAAHALGNTGHEIGRQAEDVIRHGADAVRGSWQGVPGHNGAWETSGGHGIFGSQGGLGGQGQGNPGGLGTPWVHGYPGNSAGSFGMNPQGAPWGQGGNGGPPNFGTNTQGAVAQPGYGSVRASNQNEGCTNPPPSGSGGGSSNSGGGSGSQSGSSGSGSNGDNNNGSSSGGSSSGSSSGGSSGGSSGGSSGNSGGSRGDSGSESSWGSSTGSSSGNHGGSGGGNGHKPGCEKPGNEARGSGESGIQNSETSPGMFNFDTFWKNFKSKLGFINWDAINKNQVPPPSTRALLYFSRLWEDFKQNTPFLNWKAIIEGADASSLQKRAGRADQNYNYNQHAYPTAYGGKYSVKTPAKGGVSPSSSASRVQPGLLQWVKFW

SEQ ID NO: 60026 - protein, 452 aa, Homo sapiens
MQRQAPYNIRRSSTSGDTEEEEEEEVVPFSSDEQKRRSEAASGVLRRTAPREHSYVLSAAKKSTGSPTQETQAPFIAKRVEVVEEDGPSEKSQDPPALARSTPGSNSSRGEEIVRLQILTPRAGLRLVAPDVEGMSSSATSVSAVPADRKSNSTAAQEDAKADPKGALADCEGKDVPTRVGEAWQERPGAPRGGQGDPAVPAQQPADPSTPERQSSPSGSEQLVRRESCGSSVLTDFEGKDVATKVGEAWQDRPRAPRGGQGDPAVPTQQPADPSTPEQQNSPSGSEQFVRRESCTSRVRSPSSCMVTVTVTATSEQPHIYIPAPASELDSSSTTKGILFVKEYVNASEVSSGKPVSARYSNVSSIEDSFAMEKKPPCGSTPYSERTTGGICTYCNREIRDCPKITLEHLGICCHEYCFKCGICSKPMGDLLDQIFIHRDTIHCGKCYEKLF

SEQ ID NO: 60027 - DNA, 20 bp, Homo sapiens
gatctgctggaaaccaacaa

SEQ ID NO: 60028 - DNA, 20 bp, Homo sapiens
gatcctctcacatcccacac

SEQ ID NO: 60029 - DNA, 20 bp, Homo sapiens
gatccttccaagcactcata

SEQ ID NO: 60030 - DNA, 20 bp, Homo sapiens
gatccttttttacgctttgc

SEQ ID NO: 60031 - DNA, 20 bp, Homo sapiens
gatctcacacgacatccgcc

SEQ ID NO: 60032 - DNA, 20 bp, Homo sapiens
gatctgtctttctccaaaga

SEQ ID NO: 60033 - DNA, 20 bp, Homo sapiens
gatcacagcagacataaagg

SEQ ID NO: 60034 - DNA, 20 bp, Homo sapiens
gatcataagacaatggaccc

SEQ ID NO: 60035 - DNA, 20 bp, Homo sapiens
gatccactggaaagaggacc

SEQ ID NO: 60036 - DNA, 20 bp, Homo sapiens
gatcatggccacagagcctc

SEQ ID NO: 60037 - DNA, 20 bp, Homo sapiens
gatctggcacacagtcccca

SEQ ID NO: 60038 - DNA, 20 bp, Homo sapiens
gatcccctccagccatcctg

SEQ ID NO: 60039 - DNA, 20 bp, Homo sapiens
gatccacacctgggtctcag

SEQ ID NO: 60040 - DNA, 20 bp, Homo sapiens
gatctttattgtcacatggc

SEQ ID NO: 60041 - DNA, 20 bp, Homo sapiens
gatcgggccctggaggacag

SEQ ID NO: 60042 - DNA, 20 bp, Homo sapiens
gatctgagttagacatcacc

SEQ ID NO: 60043 - DNA, 20 bp, Homo sapiens
gatcaatgcggggctgaggg

SEQ ID NO: 60044 - DNA, 20 bp, Homo sapiens
gatcatggcgtccagctcct

SEQ ID NO: 60045 - DNA, 20 bp, Homo sapiens
gatccgcgaggccgacgtgg

SEQ ID NO: 60046 - DNA, 20 bp, Homo sapiens
gatctaaataaaggactgcc

SEQ ID NO: 60047 - DNA, 20 bp, Homo sapiens
gatcatgtgctgccttttac

SEQ ID NO: 60048 - DNA, 20 bp, Homo sapiens
gatcttgcctgcatgaaaca

SEQ ID NO: 60049 - DNA, 20 bp, Homo sapiens
gatcaagacccgtaatccgg

SEQ ID NO: 60050 - DNA, 20 bp, Homo sapiens
gatcaaatgtataaccacct

SEQ ID NO: 60051 - DNA, 20 bp, Homo sapiens
gatccattccagacgctttg

SEQ ID NO: 60052 - DNA, 20 bp, Homo sapiens
gatctcttaaataacacagg

SEQ ID NO: 60053 - DNA, 20 bp, Homo sapiens
gatcttacaactagagagac

SEQ ID NO: 60054 - DNA, 20 bp, Homo sapiens
gatcaccaccccttacaatt

SEQ ID NO: 60055 - DNA, 20 bp, Homo sapiens
gatcccctgccgctccatcc

SEQ ID NO: 60056 - DNA, 20 bp, Homo sapiens
gatcctggacagatggctca

SEQ ID NO: 60057 - DNA, 20 bp, Homo sapiens
gatctggctctagtctacaa

SEQ ID NO: 60058 - DNA, 20 bp, Homo sapiens
gatctggctgaggggcactg

SEQ ID NO: 60059 - DNA, 20 bp, Homo sapiens
gatcaacaaattctttttgg

SEQ ID NO: 60060 - DNA, 20 bp, Homo sapiens
gatccgagagtaaggaagtt

SEQ ID NO: 60061 - DNA, 20 bp, Homo sapiens
gatcagctacctcacaagtc

SEQ ID NO: 60062 - DNA, 20 bp, Homo sapiens
gatcaggaggagcatactgc

SEQ ID NO: 60063 - DNA, 20 bp, Homo sapiens
gatcagtcttcggagttcca

SEQ ID NO: 60064 - DNA, 20 bp, Homo sapiens
gatcatcaagtaccatgtac

SEQ ID NO: 60065 - DNA, 20 bp, Homo sapiens
gatcccaggcaatgtgtggt

SEQ ID NO: 60066 - DNA, 20 bp, Homo sapiens
gatcgttcctgtccaactca

SEQ ID NO: 60067 - DNA, 20 bp, Homo sapiens
gatcttacctatccggagtt

SEQ ID NO: 60068 - DNA, 20 bp, Homo sapiens
gatctggattacaatgagct

SEQ ID NO: 60069 - DNA, 20 bp, Homo sapiens
gatcatgactcagtagccag

SEQ ID NO: 60070 - DNA, 20 bp, Homo sapiens
gatcgtggactatcaattca

SEQ ID NO: 60071 - DNA, 20 bp, Homo sapiens
gatctagaaagcgtgggtaa

SEQ ID NO: 60072 - DNA, 20 bp, Homo sapiens
gatcttcgactgcatctttt

SEQ ID NO: 60073 - DNA, 20 bp, Homo sapiens
gatcggcaagtgctcgacgc

SEQ ID NO: 60074 - DNA, 20 bp, Homo sapiens
gatcaaacaatattggatgt

SEQ ID NO: 60075 - DNA, 20 bp, Homo sapiens
gatcacaaagaatactgtgc

SEQ ID NO: 60076 - DNA, 20 bp, Homo sapiens
gatctccctgtgtgtttcaa

SEQ ID NO: 60077 - DNA, 20 bp, Homo sapiens
gatcttaaaacttgccaggc

SEQ ID NO: 60078 - DNA, 20 bp, Homo sapiens
gatcgacaagtggggcaccg

SEQ ID NO: 60079 - DNA, 20 bp, Homo sapiens
gatcacctggaacccaaatt

SEQ ID NO: 60080 - DNA, 20 bp, Homo sapiens
gatccttcagagctcagtcc

SEQ ID NO: 60081 - DNA, 20 bp, Homo sapiens
gatcaaaacctgctacctcc

SEQ ID NO: 60082 - DNA, 20 bp, Homo sapiens
gatcggagccactgcactcc

SEQ ID NO: 60083 - DNA, 20 bp, Homo sapiens
gatcggtgagtgagggagtg

SEQ ID NO: 60084 - DNA, 20 bp, Homo sapiens
gatctaaattaaaaagatgt

SEQ ID NO: 60085 - DNA, 20 bp, Homo sapiens
gatctccagctggttctgtg

SEQ ID NO: 60086 - DNA, 20 bp, Homo sapiens
gatccaattcccaccactaa

SEQ ID NO: 60087 - DNA, 20 bp, Homo sapiens
gatctaaaaaaatgttttta

SEQ ID NO: 60088 - DNA, 20 bp, Homo sapiens
gatcacgattataaattaaa

SEQ ID NO: 60089 - DNA, 20 bp, Homo sapiens
gatcactgatattttagtca

SEQ ID NO: 60090 - DNA, 20 bp, Homo sapiens
gatctccttgaaaaatggtg

SEQ ID NO: 60091 - DNA, 20 bp, Homo sapiens
gatctcgctccgggtcccgc

SEQ ID NO: 60092 - DNA, 20 bp, Homo sapiens
gatcaaaagtcatatgtcag

SEQ ID NO: 60093 - DNA, 20 bp, Homo sapiens
gatcactattcaatgaaggg

SEQ ID NO: 60094 - DNA, 20 bp, Homo sapiens
gatcatttattaaatgataa

SEQ ID NO: 60095 - DNA, 20 bp, Homo sapiens
gatcccatttcaggtcagac

SEQ ID NO: 60096 - DNA, 20 bp, Homo sapiens
gatcccctctgttgagatgg

SEQ ID NO: 60097 - DNA, 20 bp, Homo sapiens
gatctcattattcaagagtt

SEQ ID NO: 60098 - DNA, 20 bp, Homo sapiens
gatcagggatgccacaccac

SEQ ID NO: 60099 - DNA, 20 bp, Homo sapiens
gatcttgtgaggattcaatg

SEQ ID NO: 60100 - DNA, 20 bp, Homo sapiens
gatcatccaaggtattatgc

SEQ ID NO: 60101 - DNA, 20 bp, Homo sapiens
gatccaagagcccaagagaa

SEQ ID NO: 60102 - DNA, 20 bp, Homo sapiens
gatctttaaacgctatattt

SEQ ID NO: 60103 - DNA, 20 bp, Homo sapiens
gatcttctgtaagacagctt

SEQ ID NO: 60104 - DNA, 20 bp, Homo sapiens
gatcttttataaatgtttcc

SEQ ID NO: 60105 - DNA, 20 bp, Homo sapiens
gatcctgggtgtctgggata

SEQ ID NO: 60106 - DNA, 20 bp, Homo sapiens
gatcgccatcagtgacctcc

SEQ ID NO: 60107 - DNA, 20 bp, Homo sapiens
gatccatgaactactgtaaa

SEQ ID NO: 60108 - DNA, 20 bp, Homo sapiens
gatccggagtgctttacttc

SEQ ID NO: 60109 - DNA, 20 bp, Homo sapiens
gatcaggagaggcttccctg

SEQ ID NO: 60110 - DNA, 20 bp, Homo sapiens
gatcccttcctggttgaagc

SEQ ID NO: 60111 - DNA, 20 bp, Homo sapiens
gatcgactggaacaaagtga

SEQ ID NO: 60112 - DNA, 20 bp, Homo sapiens
gatcctctcaaacatcatcc

SEQ ID NO: 60113 - DNA, 20 bp, Homo sapiens
gatccccatcccaaggcact

SEQ ID NO: 60114 - DNA, 20 bp, Homo sapiens
gatcttttgaagggagaaga

SEQ ID NO: 60115 - DNA, 20 bp, Homo sapiens
gatctggccctcaattagct

SEQ ID NO: 60116 - DNA, 20 bp, Homo sapiens
gatccagaagtatggcccag

SEQ ID NO: 60117 - DNA, 20 bp, Homo sapiens
gatcgtggtggtgcggaacc

SEQ ID NO: 60118 - DNA, 20 bp, Homo sapiens
gatcataataaatttatgta

SEQ ID NO: 60119 - DNA, 20 bp, Homo sapiens
gatctacaaccccttggagc

SEQ ID NO: 60120 - DNA, 20 bp, Homo sapiens
gatctacaacccttcagagc

SEQ ID NO: 60121 - DNA, 20 bp, Homo sapiens
gatcacaatttttagaacct

SEQ ID NO: 60122 - DNA, 20 bp, Homo sapiens
gatccctgtctcctcgtgtt

SEQ ID NO: 60123 - DNA, 20 bp, Homo sapiens
gatcggagttttgcagccac

SEQ ID NO: 60124 - DNA, 20 bp, Homo sapiens
gatcttctttgcattagcct

SEQ ID NO: 60125 - DNA, 20 bp, Homo sapiens
gatcagcgtcagcctctctg

SEQ ID NO: 60126 - DNA, 20 bp, Homo sapiens
gatccatttcaactggctgc

SEQ ID NO: 60127 - DNA, 20 bp, Homo sapiens
gatccgctccaacctggaca

SEQ ID NO: 60128 - DNA, 20 bp, Homo sapiens
gatctcaggcaacctggatg

SEQ ID NO: 60129 - DNA, 20 bp, Homo sapiens
gatctccggtgtacacaagc

SEQ ID NO: 60130 - DNA, 20 bp, Homo sapiens
gatctggacaacctcaagaa

SEQ ID NO: 60131 - DNA, 20 bp, Homo sapiens
gatcgtctcatacaagggaa

SEQ ID NO: 60132 - DNA, 20 bp, Homo sapiens
gatctctcagctacaccaag

SEQ ID NO: 60133 - DNA, 20 bp, Homo sapiens
gatctatgctttttctgtgg

SEQ ID NO: 60134 - DNA, 20 bp, Homo sapiens
gatctgagccaaccttggcc

SEQ ID NO: 60135 - DNA, 20 bp, Homo sapiens
gatccgtgagtctatcaggc

SEQ ID NO: 60136 - DNA, 20 bp, Homo sapiens
gatccacttggtgaacttgc

SEQ ID NO: 60137 - DNA, 20 bp, Homo sapiens
gatccaggaaaccatccagg

SEQ ID NO: 60138 - DNA, 20 bp, Homo sapiens
gatcaaggcctcgaagtcat

SEQ ID NO: 60139 - DNA, 20 bp, Homo sapiens
gatctgaaaacacatgtccc

SEQ ID NO: 60140 - DNA, 20 bp, Homo sapiens
gatctcccttaataaactca

SEQ ID NO: 60141 - DNA, 20 bp, Homo sapiens
gatctcgcccctcgtgatgt

SEQ ID NO: 60142 - DNA, 20 bp, Homo sapiens
gatcaatctcggttggattc

SEQ ID NO: 60143 - DNA, 20 bp, Homo sapiens
gatcactcttcagttggtcc

SEQ ID NO: 60144 - DNA, 20 bp, Homo sapiens
gatcactgctggcagacatg

SEQ ID NO: 60145 - DNA, 20 bp, Homo sapiens
gatcagtggcaatctcagtc

SEQ ID NO: 60146 - DNA, 20 bp, Homo sapiens
gatcatcaactaccagcgca

SEQ ID NO: 60147 - DNA, 20 bp, Homo sapiens
gatccaaaaggtgaagtctc

SEQ ID NO: 60148 - DNA, 20 bp, Homo sapiens
gatccagctctgggggtgtc

SEQ ID NO: 60149 - DNA, 20 bp, Homo sapiens
gatccccggcctcctatgga

SEQ ID NO: 60150 - DNA, 20 bp, Homo sapiens
gatctcagggtcaatctcca

SEQ ID NO: 60151 - DNA, 20 bp, Homo sapiens
gatctccaacttgcagcagt

SEQ ID NO: 60152 - DNA, 20 bp, Homo sapiens
gatctgaaaacttcattggg

SEQ ID NO: 60153 - DNA, 20 bp, Homo sapiens
gatctgaaatcgacaatgtc

SEQ ID NO: 60154 - DNA, 20 bp, Homo sapiens
gatctgcagctcttcatact

SEQ ID NO: 60155 - DNA, 20 bp, Homo sapiens
gatctggagattgccaccta

SEQ ID NO: 60156 - DNA, 20 bp, Homo sapiens
gatccgactggagaatgaaa

SEQ ID NO: 60157 - DNA, 20 bp, Homo sapiens
gatcgacaatgccaggctgg

SEQ ID NO: 60158 - DNA, 20 bp, Homo sapiens
gatctgaagcaggatgttgg

SEQ ID NO: 60159 - DNA, 20 bp, Homo sapiens
gatctgactcaacttctgaa

SEQ ID NO: 60160 - DNA, 20 bp, Homo sapiens
gatcttaatatccaggagtt

SEQ ID NO: 60161 - DNA, 20 bp, Homo sapiens
gatcaaagactacagtccct

SEQ ID NO: 60162 - DNA, 20 bp, Homo sapiens
gatcccctctcctgcccaag

SEQ ID NO: 60163 - DNA, 20 bp, Homo sapiens
gatccgtgactggtaccaga

SEQ ID NO: 60164 - DNA, 20 bp, Homo sapiens
gatcgcagtcatccagagat

SEQ ID NO: 60165 - DNA, 20 bp, Homo sapiens
gatctcggagctccggcgca

SEQ ID NO: 60166 - DNA, 20 bp, Homo sapiens
gatctgggccagctgcatgc

SEQ ID NO: 60167 - DNA, 20 bp, Homo sapiens
gatctgtgtccacacggggg

SEQ ID NO: 60168 - DNA, 20 bp, Homo sapiens
gatcttcacttccaggtcgg

SEQ ID NO: 60169 - DNA, 20 bp, Homo sapiens
gatcttgtactcctggttct

SEQ ID NO: 60170 - DNA, 20 bp, Homo sapiens
gatcacagacctgagacgca

SEQ ID NO: 60171 - DNA, 20 bp, Homo sapiens
gatccagggactgattggca

SEQ ID NO: 60172 - DNA, 20 bp, Homo sapiens
gatcgaaggcctgaaggagg

SEQ ID NO: 60173 - DNA, 20 bp, Homo sapiens
gatctgggacagctgcatgc

SEQ ID NO: 60174 - DNA, 20 bp, Homo sapiens
gatctggtactcctggctct

SEQ ID NO: 60175 - DNA, 20 bp, Homo sapiens
gatcttgctggatgtgaaga

SEQ ID NO: 60176 - DNA, 20 bp, Homo sapiens
gatcccagcctgcaggagcc

SEQ ID NO: 60177 - DNA, 20 bp, Homo sapiens
gatcctcacagccaccgtgg

SEQ ID NO: 60178 - DNA, 20 bp, Homo sapiens
gatctcaccacccacctggc

SEQ ID NO: 60179 - DNA, 20 bp, Homo sapiens
gatctcactcttgccactct

SEQ ID NO: 60180 - DNA, 20 bp, Homo sapiens
gatctgctggcggcctgggc

SEQ ID NO: 60181 - DNA, 20 bp, Homo sapiens
gatctgggacagctgcacgc

SEQ ID NO: 60182 - DNA, 20 bp, Homo sapiens
gatcttcacctccagctcag

SEQ ID NO: 60183 - DNA, 20 bp, Homo sapiens
gatcttgttctgcagctcct

SEQ ID NO: 60184 - DNA, 20 bp, Homo sapiens
gatctggaaatgtgggaagt

SEQ ID NO: 60185 - DNA, 20 bp, Homo sapiens
gatcctcgtggcaaagttct

SEQ ID NO: 60186 - DNA, 20 bp, Homo sapiens
gatcaaaactctcaacaaca

SEQ ID NO: 60187 - DNA, 20 bp, Homo sapiens
gatcaacttccagcttctcc

SEQ ID NO: 60188 - DNA, 20 bp, Homo sapiens
gatcgcacatgtgaagaagc

SEQ ID NO: 60189 - DNA, 20 bp, Homo sapiens
gatcgccacctaccgcaaac

SEQ ID NO: 60190 - DNA, 20 bp, Homo sapiens
gatcgcccagaggagcaagg

SEQ ID NO: 60191 - DNA, 20 bp, Homo sapiens
gatctggtggtggctctaag

SEQ ID NO: 60192 - DNA, 20 bp, Homo sapiens
gatcttctctccaaaccagt

SEQ ID NO: 60193 - DNA, 20 bp, Homo sapiens
gatcttgtggaggattataa

SEQ ID NO: 60194 - DNA, 20 bp, Homo sapiens
gatctttcaaaaactgtatg

SEQ ID NO: 60195 - DNA, 20 bp, Homo sapiens
gatccagaggctgagagccg

SEQ ID NO: 60196 - DNA, 20 bp, Homo sapiens
gatcgccacttaccgcaagc

SEQ ID NO: 60197 - DNA, 20 bp, Homo sapiens
gatcgaccacgtcaagaagc

SEQ ID NO: 60198 - DNA, 20 bp, Homo sapiens
gatcaggacaactgacttgt

SEQ ID NO: 60199 - DNA, 20 bp, Homo sapiens
gatctcatctgtaagagtgt

SEQ ID NO: 60200 - DNA, 20 bp, Homo sapiens
gatcttctcttgcagtgtcc

SEQ ID NO: 60201 - DNA, 20 bp, Homo sapiens
gatcctgggaaggcctggat

SEQ ID NO: 60202 - DNA, 20 bp, Homo sapiens
gatctggatgtggccctgca

SEQ ID NO: 60203 - DNA, 20 bp, Homo sapiens
gatcctgataagatggcacc

SEQ ID NO: 60204 - DNA, 20 bp, Homo sapiens
gatcttgcctgctggatatt

SEQ ID NO: 60205 - DNA, 20 bp, Homo sapiens
gatcttccagcatgctgctt

SEQ ID NO: 60206 - DNA, 20 bp, Homo sapiens
gatcctccgccctggctttc

SEQ ID NO: 60207 - DNA, 20 bp, Homo sapiens
gatctaatgcaagctgcttc

SEQ ID NO: 60208 - DNA, 20 bp, Homo sapiens
gatcaacctgaccacctatg

SEQ ID NO: 60209 - DNA, 20 bp, Homo sapiens
gatcatattgcttcctggct

SEQ ID NO: 60210 - DNA, 20 bp, Homo sapiens
gatctcttcccagcattcag

SEQ ID NO: 60211 - DNA, 20 bp, Homo sapiens
gatcttaaagcctccaacct

SEQ ID NO: 60212 - DNA, 20 bp, Homo sapiens
gatctcatataatattgttt

SEQ ID NO: 60213 - DNA, 20 bp, Homo sapiens
gatccagccacccaattgta

SEQ ID NO: 60214 - DNA, 20 bp, Homo sapiens
gatcctcctgggccgctgcc

SEQ ID NO: 60215 - DNA, 20 bp, Homo sapiens
gatctttgcaatcttttttt

SEQ ID NO: 60216 - DNA, 20 bp, Homo sapiens
gatcaatcatctttgcaatt

SEQ ID NO: 60217 - DNA, 20 bp, Homo sapiens
gatcaataatctttgcaatc

SEQ ID NO: 60218 - DNA, 20 bp, Homo sapiens
gatctcaactttgactcaaa

SEQ ID NO: 60219 - DNA, 20 bp, Homo sapiens
gatcaacacataccggagcc

SEQ ID NO: 60220 - DNA, 20 bp, Homo sapiens
gatcacctgcaacaagctct

SEQ ID NO: 60221 - DNA, 20 bp, Homo sapiens
gatcctcctcaccccaggtc

SEQ ID NO: 60222 - DNA, 20 bp, Homo sapiens
gatcaacacgtaccggggcc

SEQ ID NO: 60223 - DNA, 20 bp, Homo sapiens
gatctgtgtttcaataaatg

SEQ ID NO: 60224 - DNA, 20 bp, Homo sapiens
gatcatcagacatggacaag

SEQ ID NO: 60225 - DNA, 20 bp, Homo sapiens
gatctcgagctggggaggga

SEQ ID NO: 60226 - DNA, 20 bp, Homo sapiens
gatctgctccacacgcttct

SEQ ID NO: 60227 - DNA, 20 bp, Homo sapiens
gatcagtagccagcttgtcc

SEQ ID NO: 60228 - DNA, 20 bp, Homo sapiens
gatcttgcaggtccttcacc

SEQ ID NO: 60229 - DNA, 20 bp, Homo sapiens
gatccactttagcagcagcc

SEQ ID NO: 60230 - DNA, 20 bp, Homo sapiens
gatcctgagcctagaagaac

SEQ ID NO: 60231 - DNA, 20 bp, Homo sapiens
gatctccattcactggcctt

SEQ ID NO: 60232 - DNA, 20 bp, Homo sapiens
gatctgagtttctggactcc

SEQ ID NO: 60233 - DNA, 20 bp, Homo sapiens
gatccatggctgccctggga

SEQ ID NO: 60234 - DNA, 20 bp, Homo sapiens
gatcttaccttcccacttta

SEQ ID NO: 60235 - DNA, 20 bp, Homo sapiens
gatcagagctttattataac

SEQ ID NO: 60236 - DNA, 20 bp, Homo sapiens
gatcctgatgctgagacaag

SEQ ID NO: 60237 - DNA, 20 bp, Homo sapiens
gatctgagctctccccagaa

SEQ ID NO: 60238 - DNA, 20 bp, Homo sapiens
gatcccaggtgctgaagatg

SEQ ID NO: 60239 - DNA, 20 bp, Homo sapiens
gatctgccagtccttctcct

SEQ ID NO: 60240 - DNA, 20 bp, Homo sapiens
gatcctcacggagtccagct

SEQ ID NO: 60241 - DNA, 20 bp, Homo sapiens
gatcttctgagcagaagccc

SEQ ID NO: 60242 - DNA, 20 bp, Homo sapiens
gatcagtctgtatgtactat

SEQ ID NO: 60243 - DNA, 20 bp, Homo sapiens
gatcatgcagaaacaggaag

SEQ ID NO: 60244 - DNA, 20 bp, Homo sapiens
gatctgagctctgtgccccc

SEQ ID NO: 60245 - DNA, 20 bp, Homo sapiens
gatctctgttgagagaatgc

SEQ ID NO: 60246 - DNA, 20 bp, Homo sapiens
gatctcttcacacatctccc

SEQ ID NO: 60247 - DNA, 20 bp, Homo sapiens
gatctgcccaccttggcttc

SEQ ID NO: 60248 - DNA, 20 bp, Homo sapiens
gatcaatgtggagatggacg

SEQ ID NO: 60249 - DNA, 20 bp, Homo sapiens
gatcaatgaaggagacatct

SEQ ID NO: 60250 - DNA, 20 bp, Homo sapiens
gatcacatttctctctggct

SEQ ID NO: 60251 - DNA, 20 bp, Homo sapiens
gatcattgcggccaccattg

SEQ ID NO: 60252 - DNA, 20 bp, Homo sapiens
gatcatgcctcattaccttc

SEQ ID NO: 60253 - DNA, 20 bp, Homo sapiens
gatccccagtgggcatgacc

SEQ ID NO: 60254 - DNA, 20 bp, Homo sapiens
gatccagaagcagctgactg

SEQ ID NO: 60255 - DNA, 20 bp, Homo sapiens
gatctcctccaggaaagcca

SEQ ID NO: 60256 - DNA, 20 bp, Homo sapiens
gatctacattattcagcagc

SEQ ID NO: 60257 - DNA, 20 bp, Homo sapiens
gatcccccagggtaccacgg

SEQ ID NO: 60258 - DNA, 20 bp, Homo sapiens
gatcgggacgcccttgccac

SEQ ID NO: 60259 - DNA, 20 bp, Homo sapiens
gatctatttggacggccagg

SEQ ID NO: 60260 - DNA, 20 bp, Homo sapiens
gatctgccaccagacccagc

SEQ ID NO: 60261 - DNA, 20 bp, Homo sapiens
gatccacagggcttctgtcc

SEQ ID NO: 60262 - DNA, 20 bp, Homo sapiens
gatccccggatttcacactc

SEQ ID NO: 60263 - DNA, 20 bp, Homo sapiens
gatcccaatccctcctcaag

SEQ ID NO: 60264 - DNA, 20 bp, Homo sapiens
gatctgggcctgaaatgggg

SEQ ID NO: 60265 - DNA, 20 bp, Homo sapiens
gatcacacacagacataagg

SEQ ID NO: 60266 - DNA, 20 bp, Homo sapiens
gatcagtttctggcacataa

SEQ ID NO: 60267 - DNA, 20 bp, Homo sapiens
gatcatgtctacaagggctg

SEQ ID NO: 60268 - DNA, 20 bp, Homo sapiens
gatcacagctgttactcact

SEQ ID NO: 60269 - DNA, 20 bp, Homo sapiens
gatcattgagaatgcagtcg

SEQ ID NO: 60270 - DNA, 20 bp, Homo sapiens
gatcatcgggacagcaaagt

SEQ ID NO: 60271 - DNA, 20 bp, Homo sapiens
gatcttcttccattccccat

SEQ ID NO: 60272 - DNA, 20 bp, Homo sapiens
gatcatggctcttgcatttt

SEQ ID NO: 60273 - DNA, 20 bp, Homo sapiens
gatcctgcatgtcttccatg

SEQ ID NO: 60274 - DNA, 20 bp, Homo sapiens
gatctgtttcatcctctcct

SEQ ID NO: 60275 - DNA, 20 bp, Homo sapiens
gatccagtgtgccgtggttg

SEQ ID NO: 60276 - DNA, 20 bp, Homo sapiens
gatcttgtccattgaatgga

SEQ ID NO: 60277 - DNA, 20 bp, Homo sapiens
gatcttccgagtgttgtcct

SEQ ID NO: 60278 - DNA, 20 bp, Homo sapiens
gatccctcacagcagccccc

SEQ ID NO: 60279 - DNA, 20 bp, Homo sapiens
gatccctggactgtcctggg

SEQ ID NO: 60280 - DNA, 20 bp, Homo sapiens
gatctcctgtgctagcggcc

SEQ ID NO: 60281 - DNA, 20 bp, Homo sapiens
gatcttggagcttccctgta

SEQ ID NO: 60282 - DNA, 20 bp, Homo sapiens
gatcaacatttaaaaatcca

SEQ ID NO: 60283 - DNA, 20 bp, Homo sapiens
gatcatgtggttttgtcgtg

SEQ ID NO: 60284 - DNA, 20 bp, Homo sapiens
gatcatagtaattatctttt

SEQ ID NO: 60285 - DNA, 20 bp, Homo sapiens
gatctgtaggaatctggata

SEQ ID NO: 60286 - DNA, 20 bp, Homo sapiens
gatcgatgatgtaaattgct

SEQ ID NO: 60287 - DNA, 20 bp, Homo sapiens
gatcccaaaatctgtgaaaa

SEQ ID NO: 60288 - DNA, 20 bp, Homo sapiens
gatcttcgctcctctctccc

SEQ ID NO: 60289 - DNA, 20 bp, Homo sapiens
gatcctcattctacccaatg

SEQ ID NO: 60290 - DNA, 20 bp, Homo sapiens
gatcgctggggcagggctac

SEQ ID NO: 60291 - DNA, 20 bp, Homo sapiens
gatcttcctcctctttgact

SEQ ID NO: 60292 - DNA, 20 bp, Homo sapiens
gatcctggctaaccctggcc

SEQ ID NO: 60293 - DNA, 20 bp, Homo sapiens
gatcccagtcagtgccaagc

SEQ ID NO: 60294 - DNA, 20 bp, Homo sapiens
gatcatgttaaataccttaa

SEQ ID NO: 60295 - DNA, 20 bp, Homo sapiens
gatccagaaaattgtacttc

SEQ ID NO: 60296 - DNA, 20 bp, Homo sapiens
gatccagcacaggttttgcc

SEQ ID NO: 60297 - DNA, 20 bp, Homo sapiens
gatcctatatccagaaggcc

SEQ ID NO: 60298 - DNA, 20 bp, Homo sapiens
gatctcagaaaagataccac

SEQ ID NO: 60299 - DNA, 20 bp, Homo sapiens
gatcatgagccatcagctcc

SEQ ID NO: 60300 - DNA, 20 bp, Homo sapiens
gatctgtggcagaccaggtg

SEQ ID NO: 60301 - DNA, 20 bp, Homo sapiens
gatcatgcctattatggacc

SEQ ID NO: 60302 - DNA, 20 bp, Homo sapiens
gatcgacatgtttcacaaat

SEQ ID NO: 60303 - DNA, 20 bp, Homo sapiens
gatcaaccatggtattggac

SEQ ID NO: 60304 - DNA, 20 bp, Homo sapiens
gatcaaccgagggctgagca

SEQ ID NO: 60305 - DNA, 20 bp, Homo sapiens
gatcccttcaatgaccttct

SEQ ID NO: 60306 - DNA, 20 bp, Homo sapiens
gatccgctttgatggttgcc

SEQ ID NO: 60307 - DNA, 20 bp, Homo sapiens
gatcttccagccatcaagga

SEQ ID NO: 60308 - DNA, 20 bp, Homo sapiens
gatcttcactgcagaatgta

SEQ ID NO: 60309 - DNA, 20 bp, Homo sapiens
gatcagggtgtcattgaaag

SEQ ID NO: 60310 - DNA, 20 bp, Homo sapiens
gatccgtgcatctcttcact

SEQ ID NO: 60311 - DNA, 20 bp, Homo sapiens
gatccttgccacccgcgact

SEQ ID NO: 60312 - DNA, 20 bp, Homo sapiens
gatcgcccctcatcgcagcc

SEQ ID NO: 60313 - DNA, 20 bp, Homo sapiens
gatctttatttacatgttca

SEQ ID NO: 60314 - DNA, 20 bp, Homo sapiens
gatcatccttttctttttct

SEQ ID NO: 60315 - DNA, 20 bp, Homo sapiens
gatcccattttagaagacca

SEQ ID NO: 60316 - DNA, 20 bp, Homo sapiens
gatctgagttcataatgctc

SEQ ID NO: 60317 - DNA, 20 bp, Homo sapiens
gatctgccacaaactgtggg

SEQ ID NO: 60318 - DNA, 20 bp, Homo sapiens
gatctgttaatttcctatct

SEQ ID NO: 60319 - DNA, 20 bp, Homo sapiens
gatcctgcagcacaaggatg

SEQ ID NO: 60320 - DNA, 20 bp, Homo sapiens
gatcaggacaatcaaccagg

SEQ ID NO: 60321 - DNA, 20 bp, Homo sapiens
gatcctttttgaaactctac

SEQ ID NO: 60322 - DNA, 20 bp, Homo sapiens
gatctttaatatttgaaaaa

SEQ ID NO: 60323 - DNA, 20 bp, Homo sapiens
gatcttttaactgttggcag

SEQ ID NO: 60324 - DNA, 20 bp, Homo sapiens
gatcagaggcagcaggggca

SEQ ID NO: 60325 - DNA, 20 bp, Homo sapiens
gatcccactcttcttgcagc

SEQ ID NO: 60326 - DNA, 20 bp, Homo sapiens
gatctcgtgttacagagagg

SEQ ID NO: 60327 - DNA, 20 bp, Homo sapiens
gatcgtgggcatcttgctgg

SEQ ID NO: 60328 - DNA, 20 bp, Homo sapiens
gatcacctccccctgcttcc

SEQ ID NO: 60329 - DNA, 20 bp, Homo sapiens
gatcacagagtctaggagga

SEQ ID NO: 60330 - DNA, 20 bp, Homo sapiens
gatcgagaagctaatgaaag

SEQ ID NO: 60331 - DNA, 20 bp, Homo sapiens
gatctgagggtataaagaca

SEQ ID NO: 60332 - DNA, 20 bp, Homo sapiens
gatctgagtgagctaactga

SEQ ID NO: 60333 - DNA, 20 bp, Homo sapiens
gatcactgggggtctccttc

SEQ ID NO: 60334 - DNA, 20 bp, Homo sapiens
gatcaagtgaaccatcccta

SEQ ID NO: 60335 - DNA, 20 bp, Homo sapiens
gatcggtgctagagtaccag

SEQ ID NO: 60336 - DNA, 20 bp, Homo sapiens
gatctgcccatgatgttccc

SEQ ID NO: 60337 - DNA, 20 bp, Homo sapiens
gatcatcacaggcaggccac

SEQ ID NO: 60338 - DNA, 20 bp, Homo sapiens
gatctgtgacagcaaaagat

SEQ ID NO: 60339 - DNA, 20 bp, Homo sapiens
gatcactggctaagaggaaa

SEQ ID NO: 60340 - DNA, 20 bp, Homo sapiens
gatccctgatagcaaaaggt

SEQ ID NO: 60341 - DNA, 20 bp, Homo sapiens
gatcactgcctaatctcgct

SEQ ID NO: 60342 - DNA, 20 bp, Homo sapiens
gatccatgtgctccccaggt

SEQ ID NO: 60343 - DNA, 20 bp, Homo sapiens
gatcctgagcccagccctga

SEQ ID NO: 60344 - DNA, 20 bp, Homo sapiens
gatcacatagagcatgttgg

SEQ ID NO: 60345 - DNA, 20 bp, Homo sapiens
gatcagcaacccttcctgct

SEQ ID NO: 60346 - DNA, 20 bp, Homo sapiens
gatcctcaacgttggggaca

SEQ ID NO: 60347 - DNA, 20 bp, Homo sapiens
gatccaagctaatatgagaa

SEQ ID NO: 60348 - DNA, 20 bp, Homo sapiens
gatcaagctgccctccttca

SEQ ID NO: 60349 - DNA, 20 bp, Homo sapiens
gatccccgtggactctctgg

SEQ ID NO: 60350 - DNA, 20 bp, Homo sapiens
gatcttttgtttggagaaca

SEQ ID NO: 60351 - DNA, 20 bp, Homo sapiens
gatcagcccagcctagccca

SEQ ID NO: 60352 - DNA, 20 bp, Homo sapiens
gatcagctgttcttagatgc

SEQ ID NO: 60353 - DNA, 20 bp, Homo sapiens
gatccttggaaagtccagcc

SEQ ID NO: 60354 - DNA, 20 bp, Homo sapiens
gatcattgagattgaggatg

SEQ ID NO: 60355 - DNA, 20 bp, Homo sapiens
gatctgggggctagcagtga

SEQ ID NO: 60356 - DNA, 20 bp, Homo sapiens
gatcatggatgctctggatg

SEQ ID NO: 60357 - DNA, 20 bp, Homo sapiens
gatctggtcatggctccttg

SEQ ID NO: 60358 - DNA, 20 bp, Homo sapiens
gatcagtatcaatgctatgc

SEQ ID NO: 60359 - DNA, 20 bp, Homo sapiens
gatcttgtgctatgaaacaa

SEQ ID NO: 60360 - DNA, 20 bp, Homo sapiens
gatctttggcatgatttaaa

SEQ ID NO: 60361 - DNA, 20 bp, Homo sapiens
gatccctctctttggagacc

SEQ ID NO: 60362 - DNA, 20 bp, Homo sapiens
gatcccggtccttcctgccg

SEQ ID NO: 60363 - DNA, 20 bp, Homo sapiens
gatcgcaatttgtcgatgtt

SEQ ID NO: 60364 - DNA, 20 bp, Homo sapiens
gatctgcgtttaaggctgat

SEQ ID NO: 60365 - DNA, 20 bp, Homo sapiens
gatcttcatggcgtcaagtt

SEQ ID NO: 60366 - DNA, 20 bp, Homo sapiens
gatcgcgattaagagacaga

SEQ ID NO: 60367 - DNA, 20 bp, Homo sapiens
gatctggtccccttccaggc

SEQ ID NO: 60368 - DNA, 20 bp, Homo sapiens
gatcttagagcccagccccc

SEQ ID NO: 60369 - DNA, 20 bp, Homo sapiens
gatcctgagccttctccgca

SEQ ID NO: 60370 - DNA, 20 bp, Homo sapiens
gatctgtggctctgcaccta

SEQ ID NO: 60371 - DNA, 20 bp, Homo sapiens
gatcactattctgatttaga

SEQ ID NO: 60372 - DNA, 20 bp, Homo sapiens
gatcagaactacaattacaa

SEQ ID NO: 60373 - DNA, 20 bp, Homo sapiens
gatcggctctgcctgcacgt

SEQ ID NO: 60374 - DNA, 20 bp, Homo sapiens
gatccagcaccggctcctcc

SEQ ID NO: 60375 - DNA, 20 bp, Homo sapiens
gatccccaggaggactcact

SEQ ID NO: 60376 - DNA, 20 bp, Homo sapiens
gatcagaagctgatgactcg

SEQ ID NO: 60377 - DNA, 4166 bp, Homo sapiens
ttcccgtctccctccacaccttgcctcctccaggcccaaccccattccaccagcaccccgccccaggcgcactggctaggactggaaggcaaggactaaggtgaaagctgactgcccgcaccgccccaggcgcactgggtaggactgaaaggcagggactaaggtgacagctgactctgccggggcggagtgcgtgtcctcccaccgtgctggcgctgaactgactgtccgctgccaagggaagtgacagccgcagccgggctctcagccagcggccaggcgccccgcggaccatgctctccagtacgcagaacgcgggcggctcctatcagcgggtccgcggggcgcttgatacacagaaatgcagtccagagaaaagtgcctcatttttcagtaaagtgacatattcctggtttagcagagtaattactttaggctataagagacctttggaaagagaggatctttttgaactaaaggaaagtgattccttctgcactgcgtgtcccatctttgaaaaacaatggagaaaggaagttttaaggaatcaagagaggcaaaaagtaaaggtatcttgttataaagaggcacatatcaagaaaccatctctactctatgcattgtggaacacctttaaatccatcctgattcaagttgccttattcaaagtgtttgctgatattttgtccttcactagcccactcataatgaagtaagttaaagtctggtgggttttttttccctcctcacagataaatgaaaagtaagtattctaatataaaagttctaatacaaaagagtagagaaggttcttattgcaaatattattaggatgtggacatgctattagggttatctacaatataaatgggaattaggataatatagtcaatatctaataaagtcaaccctgtactaagcactgctctaaaatcttatattaattttattaagcaagggttcgccagagaaacagaaccaataggatatataagcccaaataagaggggatttattatgggaattggctctcgcaattatggaggccaagaagtcccacagtcttgcatttgcaagctagagactcaggaaagacagtggcataatgcagtctgagtccaaaggccaggtaaccttgagttctgacgtccacgggcaggagaaggtggatatttcagctccaggaaagagagctaattcactctctctttaccttcttgttctatccaggccctcaacaaattggatgaggcactatgccctgggatcatccttactcagtctactgattcaaatgctaatctcttccagaaacagcctcacagacacacccagacatctggtagatggtaaaacattatttaaatgttattaaacagaaataatgttttaccatctcttcaccagtcaagttgacacgtaaaattaaccatcacattggtaatctcatttaatctttactacactcctgcaacatagacagtattattacattcagtattacaatggcagaaacagacagaaagggtggagtaatttgtccaagtccccacagctagaaagtgccagagtcgtaattgaaatctaggaagtctcgcttgaatgtatgcgatacatattttcactacgatacttagttgtggccttttgagagttgagctttaacagccatggcaattacacacacacacaaacatacactcacacacacaattactatgtataacatatatgaacatatattattattacctaatatatgtatatttctgtgcatctctatatctagatatggacatagtaaaatgacttgaaacatttctataatatctacctgcaatggtttacaggcagacaatgaaattgatcttttgactgtgccacctttttcaaggaaaccttgacttatacctagctgtcatatgaaggaaatgcaaagaaacatatattttattaactggtgattatatttttactattgaaaaatttccaagttgttagagtttttaataaccatttaattcatgaaaatatcattaatcctgcattacttagatcccatatgatattcaggaatatattcattcaatatttattgagcacctatgcatgccaaaactgttctaggtcgactgcggggacagaacaaaaatcaaaacaaagaacctgctctgatgacacttagaggggagagatgaaagccaaacaaatgaataaacataaatgataccatcagtgcttaggaacaaagtaaagtagggtaagggaatgccagtctgaggagttagaagttaccgttttatgtaaggtaattatgaaagacattggtgataaggtgacatttggtcacagttctgaaggaagttagggaggaagccaagaaaatatctattgtgattaaaggtagcaggaagggcaaaagtcatgaagaagctcatgcttgatatctctgagggcctgcaaggaggcaaagtgaggttggagcagagagctggaaaggtaagactgaggtcagaaaggtgcagagatgaaaagattttgaaggaccttatgaaatatgatgggaatattggcttttagtccacattagcagggaagaatttggaagattttgagcaaaaaaacaatgatctgcttagacttaagtcttataggaatgactctggctgctatgtggggaataaaatcaagacgtgcaagagtggaagaagaaacaccagttagaagtttgtttgcgataatccaagcaaaagttaatggtggcttcaactaggtagtagcaataagggtgataagaagtggtcagactctggttgtgttttaaaggtagagttaacagaatatactggtggactgaatgtaggttgagagaggaagcgagaagttaaggatgccttcaaaatttttgtttagatcatcaggtaaatgagtcagcatatccttgtagtatgtcacagtatacgcccaaattgttttcaccatattgcatgtgctatatagccttttaaatttaacactattttcagtcgcattgatgcagttttaaaaaggtgaaatcatgcttaaaatattattaccagtgaacatcaggcactctgagttttagacaatgtttatagttgagggactatcagccgagatacttgtaattagaaccatccccactgtttttctgctccccagcattggccctaatcatcctgatcatgctgtcacaaacttaagaggaaataaggaaaaggagagaaaaaagaaattggttatgaataaaagtgacaataaaacatgagatataaatcaagcttaaaaaaaaaaagcagcacctgtgggccatactaaaagatcccctacttacgttctggttgtcatgtttccctgtatttgataaaacacataattttgagaaaaataaagttttaaatgtatctatgtctcgacttttctgatgaagttataccagaaaagttaattatttgatgggcctgccatgtgaaaaccagaaaataacctcgtactcacaagccagtggaagggattcctgattttactaaaaaaaaaaaaaaaaaagagagggcggggacaaatatcaaattaagcaagtaaagaaaaagaacaggtaagagtgtgtgtgtgtgtgtgtgtgtgtaacactttgacaatactaaactctcataagcatttaacacttcagatgtttaacatttctgcccctttctcaatttttatgacgtgcaggcaaattatcattttctgtgaacacagctcagattttggctggaatggctatggctatgcagtggcacttcttgttgtagtctttttgcaaactctgattcttcagcaatatcaacgttttaacatgctcacctcagcaaaagttaagacagctgtaaatggactgatctacaaaaaggccttacttttatcaaatgtttctcgacaaaagttttccactggggaaattattaacttgatgtcagcaactcatggacttgacagcaaacctcaatctcctctggtctgccccttttcaaatcctaatggccgtatatctcctttggcaagagctgggtccagcagtgttagcaggggtggcagtccttgtgtttgttataccaataaatgctttagctgcaactaaaataaaaaagttaaaggtaagaaaa

SEQ ID NO: 60378 - DNA, 1073 bp, Homo sapiens
ttcccgtctccctccacaccttgcctcctccaggcccaaccccattccaccagcaccccgccccaggcgcactggctaggactggaaggcaaggactaaggtgaaagctgactgcccgcaccgccccaggcgcactgggtaggactgaaaggcagggactaaggtgacagctgactctgccggggcggagtgcgtgtcctcccaccgtgctggcgctgaactgactgtccgctgccaagggaagtgacagccgcagccgggctctcagccagcggccaggcgccccgcggaccatgctctccagtacgcagaacgcggggcgcttgatacacagagtaattactttaggctataagagacctttggaaagagaggatctttttgaactaaaggaaagtgattccttctgcactgcgtgtcccatctttgaaaaacaatggagaaaggaagttttaaggaatcaagagaggcaaaaagtaaaggtatcttgttataaagaggcacatatcaagaaaccatctctactctatgcattgtggaacacctttaaatccatcctgattcaagttgccttattcaaagtgtttgctgatattttgtccttcactagcccactcataatgaagcaaattatcattttctgtgaacacagctcagattttggctggaatggctatggctatgcagtggcacttcttgttgtagtctttttgcaaactctgattcttcagcaatatcaacgttttaacatgctcacctcagcaaaagttaagacagctgtaaatggactgatctacaaaaaggccttacttttatcaaatgtttctcgacaaaagttttccactggggaaattattaacttgatgtcagcaactcatggacttgacagcaaacctcaatctcctctggtctgccccttttcaaatcctaatggccgtatatctcctttggcaagagctgggtccagcagtgttagcaggggtggcagtccttgtgtttgttataccaataaatgctttagctgcaactaaaataaaaaagttaaaggtaagaaaaaaaaaaaaaaaaaaaaa

SEQ ID NO: 60379 - DNA, 4445 bp, Homo sapiens
gtcagcgctgcctgagctcgtcccctggatgtccgggtctccccaggcggccacccgccggctcccatcgtgacctccagccgcagcgcctcccacgccggccgccgcgcgaggggagcgctcgggcgcgccgggtgtggttgggggaaggggttgtgccgcgcgcgggctgcgtgctgtgcccactcaaaaggttccgggcgcgcaggagggaagaggcagtgcccgccactcccactgagattgagagacgcggcaaggaggcagcctgtggaggaactgggtaggatttaggaacgcaccgtgcacatgcttggtggtcttgttaagtggaaactgctgctttagagtttgtttggaaggtccgggtgactcatcccaacatttacatccttaattgttaaagcgctgcctccgagcgcacgcatcctgagatcctgagcctttggttaagaccgagctctattaagctgaaaagataaaaactctccagatgtcttccagtaatgtcgaagtttttatcccagtgtcacaaggaaacaccaatggcttccccgcgacagcttccaatgacctgaaggcatttactgaaggagctgtgttaagttttcataacatctgctatcgagtaaaactgaagagtggctttctaccttgtcgaaaaccagttgagaaagaaatattatcgaatatcaatgggatcatgaaacctggtctcaacgccatcctgggacccacaggtggaggcaaatcttcgttattagatgtcttagctgcaaggaaagatccaagtggattatctggagatgttctgataaatggagcaccgcgacctgccaatttcaaatgtaattcaggttacgtggtacaagatgatgttgtgatgggcactctgacggtgagagaaaacttacagttctcagcagctcttcggcttgcaacaactatgacgaatcatgaaaaaaacgaacggattaacagggtcattcaagagttaggtctggataaagtggcagactccaaggttggaactcagtttatccgtggtgtgtctggaggagaaagaaaaaggactagtataggaatggagcttatcactgatccttccatcttgttcttggatgagcctacaactggcttagactcaagcacagcaaatgctgtccttttgctcctgaaaaggatgtctaagcagggacgaacaatcatcttctccattcatcagcctcgatattccatcttcaagttgtttgatagcctcaccttattggcctcaggaagacttatgttccacgggcctgctcaggaggccttgggatactttgaatcagctggttatcactgtgaggcctataataaccctgcagacttcttcttggacatcattaatggagattccactgctgtggcattaaacagagaagaagactttaaagccacagagatcatagagccttccaagcaggataagccactcatagaaaaattagcggagatttatgtcaactcctccttctacaaagagacaaaagctgaattacatcaactttccgggggtgagaagaagaagaagatcacagtcttcaaggagatcagctacaccacctccttctgtcatcaactcagatgggtttccaagcgttcattcaaaaacttgctgggtaatccccaggcctctatagctcagatcattgtcacagtcgtactgggactggttataggtgccatttactttgggctaaaaaatgattctactggaatccagaacagagctggggttctcttcttcctgacgaccaaccagtgtttcagcagtgtttcagccgtggaactctttgtggtagagaagaagctcttcatacatgaatacatcagcggatactacagagtgtcatcttatttccttggaaaactgttatctgatttattacccatgaggatgttaccaagtattatatttacctgtatagtgtacttcatgttaggattgaagccaaaggcagatgccttcttcgttatgatgtttacccttatgatggtggcttattcagccagttccatggcactggccatagcagcaggtcagagtgtggtttctgtagcaacacttctcatgaccatctgttttgtgtttatgatgattttttcaggtctgttggtcaatctcacaaccattgcatcttggctgtcatggcttcagtacttcagcattccacgatatggatttacggctttgcagcataatgaatttttgggacaaaacttctgcccaggactcaatgcaacaggaaacaatccttgtaactatgcaacatgtactggcgaagaatatttggtaaagcagggcatcgatctctcaccctggggcttgtggaagaatcacgtggccttggcttgtatgattgttattttcctcacaattgcctacctgaaattgttatttcttaaaaaatattcttaaatttccccttaattcagtatgatttatcctcacataaaaaagaagcactttgattgaagtattcaatcaagtttttttgttgttttctgttcccttgccatcacactgttgcacagcagcaattgttttaaagagatacatttttagaaatcacaacaaactgaattaaacatgaaagaacccaagacatcatgtatcgcatattagttaatctcctcagacagtaaccatggggaagaaatctggtctaatttattaatctaaaaaaggagaattgaattctggaaactcctgacaagttattactgtctctggcatttgtttcctcatctttaaaatgaataggtaggttagtagcccttcagtcttaatactttatgatgctatggtttgccattatttaataaatgacaaatgtattaatgctatactggaaatgtaaaattgaaaatatgttggaaaaaagattctgtcttatagggtaaaaaaagccaccgtgatagaaaaaaaatctttttgataagcacattaaagttaatagaacttactgatattcctgtctagtggtataatatctcaggaatcttggctgagggtttggaactgtgggtagagtagagggccaggagtccagtaatagaattcttgcaccatttctggaacattctagctctgggaggtcacgtaaccttcttggggtagttcagtggtttagtggtttataatccaggtgtgcgtcagaatcatctgaggaactttgctaaaatacaaaaatctggcctaagtagctccagatctaccttcataaaggaatctgaccactcctggatttggtaatttccaagttctgaaaattttacttaggatttaataactattaacatctgtccctacataggttttctttcctacttatataccttatgttctcttcattctaaccttcatcagtaatagggaaatgttttaattttatttttttagttgaagggtaatgtaccaaaaaatatagttcagtgaattaaaatgaacacacatgtgcaaccatcaattcaggtcaagaaatagaagattgtagcacacaaaagcctactcagccattctcccagtcactacttccttccttacccctgggttatttttgaaatgacacttgatgtatttccctctgttgctgttatgagaacattgctacagccaagtgttgtgtttctgtgtgcataggttgatacttaattatctccccactttttaataaacttttaatttggaaataattttagattgacagaaaagttgcaaagatagtgaggaaagttcctgtctactctttgctcagcttcccttaatgttaacattttatatagcaagatgcatttgtcaaagctaacaagttaacattggtacaatcactgttaattaaactgcacacaatattcagatttcaccacttttccactaatattctttcattgttctaggattcaattcaggagaccacatttcatctagccctcttttttaaaagtaaatacttttcagcacttacaggagttaactgagctggggcatcatggtgtatagacgccctgacactggtcatcttggaattcatttagtttgtcagtgggtgccctgacattctgtcacaacatcaatttgggaacatggcattatatttttatctttgaacttttttctttttggatgacatttgattaatgcgtcatcttggaacacattatcttttttcttggttatgtgatcaggaagattaatcagtttttcctgttcttggtataattcctgcttttcacatacctgtcccttacagttctctatatatacccttcccttattacacagagagaaatatctatctatactttttacacaaaatatacttcaaaagaaacaaaacagccacaattattaactttttaaataaatgagaatttaattatatcctaaaaaaaaaaaaaaa

SEQ ID NO: 60380 - DNA, 2679 bp, Homo sapiens
ctccaggaaacagagtgaagacactggccctggcaggcagcagctgggtctaagagagctgcagcccagggtcacagacctgtgggccccatggccgggaaggcggcagaggagagagggctgccgaaaggggccactccccaggatacctcgggcctccaggatagattgttctcctctgaaagtgacaacagcctgtacttcacctacagtggccagcccaacaccctggaggtcagagacctcaactaccaggtggacctggcctctcaggtcccttggtttgagcagctggctcagttcaagatgccctggacatctcccagctgccagaattcttgtgagctgggcatccagaacctaagcttcaaagtgagaagtgggcagatgctggccatcatagggagctcaggttgtgggagagcctccttgctagatgtgatcactggccgaggtcacggcggcaagatcaagtcaggccagatctggatcaatgggcagcccagctcgcctcagctggtgaggaagtgtgtggcccacgtgcgccagcacaaccagctgctccccaacttgactgtgcgagagaccttggccttcattgcccagatgcggctgcccagaaccttctcccaggcccagcgtgacaaaagggtggaggacgtgatcgcggagctgcggcttaggcagtgcgctgacacccgcgtgggcaacatgtacgtgcgggggttgtcggggggtgagcgcaggagagtcagcattggggtgcagctcctgtggaacccaggaatccttattctcgacgaacccacctctgggctcgacagcttcacagcccacaacctggtgaagaccttgtccaggctggccaaaggcaaccggctggtgctcatctccctccaccagcctcgctctgacatcttcaggctgtttgatctggtcctcctgatgacgtctggcacccccatctacttaggggcggcccagcacatggtccagtatttcacagccatcggctacccctgtcctcgctacagcaatcctgctgacttctatgtggacctgaccagcattgacaggcgcagcagagagcaggaattggccaccagggagaaggctcagtcactcgcagccctgtttctagaaaaagtgcgtgacttagatgactttctatggaaagcagagacgaaggatcttgacgaggacacctgtgtggaaagcagcgtgaccccactagacaccaactgcctcccgagtcctacgaagatgcctggggcggtgcagcagtttacgacgctgatccgtcgtcagatttccaacgacttccgagacctgcccaccctcctcatccatggggcggaggcctgtctgatgtcaatgaccatcggcttcctctattttggccatgggagcatccagctctccttcatggatacagccgccctcttgttcatgatcggtgctctcatccctttcaacgtcattctggatgtcatctccaaatgttactcagagagggcaatgctttactatgaactggaagacgggctgtacaccactggtccatatttctttgccaagatcctcggggagcttccggagcactgtgcctacatcatcatctacgggatgcccacctactggctggccaacctgaggccaggcctccagcccttcctgctgcacttcctgctggtgtggctggtggtcttctgttgcaggattatggccctggccgccgcggccctgctccccaccttccacatggcctccttcttcagcaatgccctctacaactccttctacctcgccgggggcttcatgataaacttgagcagcctgtggacagtgcccgcgtggatttccaaagtgtccttcctgcggtggtgttttgaagggctgatgaagattcagttcagcagaagaacttataaaatgcctctcgggaacctcaccatcgcggtctcaggagataaaatcctcagtgtcatggagctggactcgtaccctctctacgccatctacctcatcgtcattggcctcagcggtggcttcatggtcctgtactacgtgtccttaaggttcatcaaacagaaaccaagtcaagactggtgattcacgccagacgtctgcccgctggtgggggacctgagcagacccttcaactgcactccctcctcaggagccccttcctggggacagtgaggacaatgaccctacagatgctcagctacatccggcccagggtgctgcagtggcacagaccagccacaggatggcagtagaataaagacagtcgaaagggatttctgctcactggcaggagactgcgatgactgggagaaaacctgcactcggtggcacctacaacgttgctaatttatttccttttgatatgcatttatataggcaactcgatataggatgggagcaaactaggaatgaattgggtagctagactgtgcaggaattgttggaacctggagggaacaataacagtagctagcagatttggcttcatcttccaggggccccacactccgtggtgagccaccatcaatacagaaagtgacctaagatgtaccagcaagatgccatcccttctttttgtgtggggtcatgggctccaaaagccaacgtgaacaattaaaaatgtattgagcatctaaaaaaaaaaaaaaa

SEQ ID NO: 60381 - DNA, 4195 bp, Homo sapiens
gccgagcaccgcgcaccgcgtcatgggggccgcctcgggccgccgggggccggggctgctgctgccgctgccgctgctgttgctgctgccgccgcagcccgccctggcgttggaccccgggctgcagcccggcaacttttctgctgacgaggccggggcgcagctcttcgcgcagagctacaactccagcgccgaacaggtgctgttccagagcgtggccgccagctgggcgcacgacaccaacatcaccgcggagaatgcaaggcgccaggaggaagcagccctgctcagccaggagtttgcggaggcctggggccagaaggccaaggagctgtatgaaccgatctggcagaacttcacggacccgcagctgcgcaggatcatcggagctgtgcgcaccctgggctctgccaacctgcccctggctaagcggcagcagtacaacgccctgctaagcaacatgagcaggatctactccaccgccaaggtctgcctccccaacaagactgccacctgctggtccctggacccagatctcaccaacatcctggcttcctcgcgaagctacgccatgctcctgtttgcctgggagggctggcacaacgctgcgggcatcccgctgaaaccgctgtacgaggatttcactgccctcagcaatgaagcctacaagcaggacggcttcacagacacgggggcctactggcgctcctggtacaactcccccaccttcgaggacgatctggaacacctctaccaacagctagagcccctctacctgaacctccatgccttcgtccgccgcgcactgcatcgccgatacggagacagatacatcaacctcaggggacccatccctgctcatctgctgggagacatgtgggcccagagctgggaaaacatctacgacatggtggtgcctttcccagacaagcccaacctcgatgtcaccagtactatgctgcagcagggctggaacgccacgcacatgttccgggtggcagaggagttcttcacctccctggagctctcccccatgcctcccgagttctgggaagggtcgatgctggagaagccggccgacgggcgggaagtggtgtgccacgcctcggcttgggacttctacaacaggaaagacttcaggatcaagcagtgcacacgggtcacgatggaccagctctccacagtgcaccatgagatgggccatatacagtactacctgcagtacaaggatctgcccgtctccctgcgtcggggggccaaccccggcttccatgaggccattggggacgtgctggcgctctcggtctccactcctgaacatctgcacaaaatcggcctgctggaccgtgtcaccaatgacacggaaagtgacatcaattacttgctaaaaatggcactggaaaaaattgccttcctgccctttggctacttggtggaccagtggcgctggggggtctttagtgggcgtacccccccttcccgctacaacttcgactggtggtatcttcgaaccaagtatcaggggatctgtcctcctgttacccgaaacgaaacccactttgatgctggagctaagtttcatgttccaaatgtgacaccatacatcaggtactttgtgagttttgtcctgcagttccagttccatgaagccctgtgcaaggaggcaggctatgagggcccactgcaccagtgtgacatctaccggtccaccaaggcaggggccaagctccggaaggtgctgcaggctggctcctccaggccctggcaggaggtgctgaaggacatggtcggcttagatgccctggatgcccagccgctgctcaagtacttccagccagtcacccagtggctgcaggagcagaaccagcagaacggcgaggtcctgggctggcccgagtaccagtggcacccgccgttgcctgacaactacccggagggcatagacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcactgcctgcccaggagctggaggagtacaacaagatcctgttggatatggaaaccacctacagcgtggccactgtgtgccacccgaatggcagctgcctgcagctcgagccagatctgacgaatgtgatggccacgtcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggtactttgtcagcttcatcatccagttccagttccacgaggcactgtgccaggcagctggccacacgggccccctgcacaagtgtgacatctaccagtccaaggaggccgggcagcgcctggcgaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccgctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctgaggtgacccggctgggtcggccctgcccaagggcctcccaccagagactgggatgggaacactggtgggcagctgaggacacaccccacaccccagcccaccctgctcctcctgccctgtccctgtccccctcccctcccagtcctccagaccaccagccgccccagccccttctcccagcacacggctgcctgacactgagccccacctctccaagtctctctgtgaatacaattaaaggtcctgccctccc

SEQ ID NO: 60382 - DNA, 2503 bp, Homo sapiens
cgctcttattggccaggggacggtagctgcaggactctgctctcctgcggccatgggccagggttgggctactgcaggacttcccagcctcctcttcctgctgctctgctacgggcaccctctgctggtccccagccaggaggcatcccaacaggtgacagtcacccatgggacaagcagccaggcaacaaccagcagccagacaaccacccaccaggcgacggcccaccagacatcagcccagagcccaaacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcactgcctgcccaggagctggaggagtacaacaagatcctgttggatatggaaaccacctacagcgtggccactgtgtgccacccgaatggcagctgcctgcagctcgagccagatctgacgaatgtgatggccacgtcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggtactttgtcagcttcatcatccagttccagttccacgaggcactgtgccaggcagctggccacacgggccccctgcacaagtgtgacatctaccagtccaaggaggccgggcagcgcctggcgaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccgctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctgaggtgacccggctgggtcggccctgcccaagggcctcccaccagagactgggatgggaacactggtgggcagctgaggacacaccccacaccccagcccaccctgctcctcctgccctgtccctgtccccctcccctcccagtcctccagaccaccagccgccccagccccttctcccagcacacggctgcctgacactgagccccacctctccaagtctctctgtgaatacaattaaaggtcctgccctccc

SEQ ID NO: 60383 - DNA, 4863 bp, Homo sapiens
cgctcttattggccaggggacggtagctgcaggactctgctctcctgcggccatgggccagggttgggctactgcaggacttcccagcctcctcttcctgctgctctgctacgggcaccctctgctggtccccagccaggaggcatcccaacaggtgacagtcacccatgggacaagcagccaggcaacaaccagcagccagacaaccacccaccaggcgacggcccaccagacatcagcccagagcccaaacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcactgcctgcccaggagctggaggagtacaacaagatcctgttggatatggaaaccacctacagcgtggccactgtgtgccacccgaatggcagctgcctgcagctcgagccagatctgacgaatgtgatggccacgtcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggtactttgtcagcttcatcatccagttccagttccacgaggcactgtgccaggcagctggccacacgggccccctgcacaagtgtgacatctaccagtccaaggaggccgggcagcgcctggcgaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccgatgacttctacaatgagaccgagaccaagatcttcctgcagttttatgaccaaacagggatttgggaccatggggcaccacatctcctgcccccatcccaagcaagaggaacaagggaagccccagtgtacatgtcaaagagggctgcaagctctgggcctcctggaagccctaaacttcctccagctgcacaaggacatggagaggtcccagttcatgatttactttggcacccaggcccacctgtttaaagtcacccagttcaaggacccggatgtgaatggcatgctgaaactcgaagtcatggccacctccagggacaaagaggagctgctgtgggcctggcagggctggcaggatgccgtgggccgccagatctgcaccaccttcgagcactatgtggagctcagcaacaaggctgcacagctcaacggaagaggctgctgagaaagagaatgagaagaggctgctgcagacaagtggacagggaaggcctctgacatttatccaagacctgaaagatgggcaaaagacgggaagcaagatgtgaaagaagagcagcctaggcagaggctccgcggcaggaggagccggtgctctggaagacctgaaagaagcccaggttacaaagacatgggggccttgtggcactccaagtatgagtcggataccctggagcaagacctggagcggctattccaggagctgcggccactctacctgaacctgcacacctacgtgcgcagggccctccaccgccactatgggcccgagctcatcgacctgagggggcccatccctgcccacctcctggagaacacgttggctcagtcctgggtcaacatcttagacccggtcctgcccttcctgaagaagatcccagaggatgtcacaaagatcatgaaagtccagcactggaagccagagaaaatgttggaagaggctgagacattcttcacctccttggcgctgccacctgccccacccagtttctggaaaaagttgatgctaatgaggccaaccgatgggcgagaggtggagtgtcacatctctgcctggaacttctaccaggacgacgatttcagctaggaggctgaggcaggagaatcactggaacctgggagccggaggctgcagtgagccaagatcgcaccattgcactccagctgggagacacagcaagactccgtctcaaaagaaaaaaaaaaaaaagaacaactgccaagaataaagaagtgcgcggaagtgaccacagaagacccgctctccatcttccacgaaatgggccattccagtacttcctgcagtacaagaacctctccatcatcttccgcgcaggtgccaacccagcctttgaagaggctgtggggtctgtgatcaccctctcggcctcctcccacaagcacctgctcaacataggcctgctcagcctctagcaccaggactcagaggatgaggtcaatttcctgatgcatattgccctggagaagatcgccttcatcccctttggctacctgatggacctccttcgctggaaggtctttgacggcaccatctggaaggacatctacaatcaggagtggtggaacctcaggttgaaataccagggcttgtgccccgctattcctcactcagaggaagactttgatccaggtgccaagttccacttttctgcaggtacttcctcagtctggtgctccagttccagttccacgaaacactgtgcaaagcctcgggccacatgggtccactgcaccagtgtgacatctacaactccaagattgccgggaagctcctgggggatgctctaaagctgggctcaagcaagccctggccagaggtcctaaagatgctgactggggagtctgaggtgtctacaaatgtcttcatgacctacttcaaacccctactgacctggctggtgacagaacatgcagcaaggggacatcttaggctggccagacttcagctgttcctttgaagaaaaagacacagacaaagtgacattcctgagtctgaagctggaccccaaccaggctaaatttgggtactgggtgctgttggccctgggctttgtcatgtctctggtggtgctggggctggcctgcaggctgcagtccctggaaaaacagtcactgactcaagacactgagatattcagcccactgcccaatgcctgcttcctgggcatagccatggaaccctgccaggctgctaaaggacagtggatgctgctgggcctctgccttgtcctgatgctgtgctcaatcagcctggccatctggattttcacacagtaaagcaggaagcctccaaggtaacccggctatgggactgcagtgcccaaggaatttctgctctggttagaaaaaggactctgcttcagtccacttctgctctggttagaaaaaggactctgcttcagtccacagtacataaaatgtactcagctatcagctctataagagctggatgcacatcaggagtgtgcccctctgtaacaactctagtcagcacaggccatggtgcacaaaagggacttggaaaatgatggaatgaccagcctgtccaacagaggggcagccaggacatctctgccctcttctcatcccccagccacagtggccaaagaggcccccactaggcactgtggctctgcatgacaaacacacatccagcccaggactctaagcctctcacctggactccagtaaaaaccttgctgagcctccttgtctatccttcctcccccacccaccattgtaaagtttatgtcaccagaatatttctttcatgtctaattgcttaagaacttggttgttcatcaattaaatctagatgt

SEQ ID NO: 60384 - DNA, 3405 bp, Homo sapiens
cgcccaacccaagttcaaaggctgataagagagaaaatctcatgaggaggttttagtctagggaaagtcattcagtggatgtgatcttggctcacaggggacgatgtcaagctcttcctggctccttctcagccttgttgctgtaactgctgctcagtccaccattgaggaacaggccaagacatttttggacaagtttaaccacgaagccgaagacctgttctatcaaagttcacttgcttcttggaattataacaccaatattactgaagagaatgtccaaaacatgaataatgctggggacaaatggtctgcctttttaaaggaacagtccacacttgcccaaatgtatccactacaagaaattcagaatctcacagtcaagcttcagctgcaggctcttcagcaaaatgggtcttcagtgctctcagaagacaagagcaaacggttgaacacaattctaaatacaatgagcaccatctacagtactggaaaagtttgtaacccagataatccacaagaatgcttattacttgaaccaggtttgaatgaaataatggcaaacagtttagactacaatgagaggctctgggcttgggaaagctggagatctgaggtcggcaagcagctgaggccattatatgaagagtatgtggtcttgaaaaatgagatggcaagagcaaatcattatgaggactatggggattattggagaggagactatgaagtaaatggggtagatggctatgactacagccgcggccagttgattgaagatgtggaacatacctttgaagagattaaaccattatatgaacatcttcatgcctatgtgagggcaaagttgatgaatgcctatccttcctatatcagtccaattggatgcctccctgctcatttgcttggtgatatgtggggtagattttggacaaatctgtactctttgacagttccctttggacagaaaccaaacatagatgttactgatgcaatggtggaccaggcctgggatgcacagagaatattcaaggaggccgagaagttctttgtatctgttggtcttcctaatatgactcaaggattctgggaaaattccatgctaacggacccaggaaatgttcagaaagcagtctgccatcccacagcttgggacctggggaagggcgacttcaggatccttatgtgcacaaaggtgacaatggacgacttcctgacagctcatcatgagatggggcatatccagtatgatatggcatatgctgcacaaccttttctgctaagaaatggagctaatgaaggattccatgaagctgttggggaaatcatgtcactttctgcagccacacctaagcatttaaaatccattggtcttctgtcacccgattttcaagaagacaatgaaacagaaataaacttcctgctcaaacaagcactcacgattgttgggactctgccatttacttacatgttagagaagtggaggtggatggtctttaaaggggaaattcccaaagaccagtggatgaaaaagtggtgggagatgaagcgagagatagttggggtggtggaacctgtgccccatgatgaaacatactgtgaccccgcatctctgttccatgtttctaatgattactcattcattcgatattacacaaggaccctttaccaattccagtttcaagaagcactttgtcaagcagctaaacatgaaggccctctgcacaaatgtgacatctcaaactctacagaagctggacagaaactgttcaatatgctgaggcttggaaaatcagaaccctggaccctagcattggaaaatgttgtaggagcaaagaacatgaatgtaaggccactgctcaactactttgagcccttatttacctggctgaaagaccagaacaagaattcttttgtgggatggagtaccgactggagtccatatgcagaccaaagcatcaaagtgaggataagcctaaaatcagctcttggagataaagcatatgaatggaacgacaatgaaatgtacctgttccgatcatctgttgcatatgctatgaggcagtactttttaaaagtaaaaaatcagatgattctttttggggaggaggatgtgcgagtggctaatttgaaaccaagaatctcctttaatttctttgtcactgcacctaaaaatgtgtctgatatcattcctagaactgaagttgaaaaggccatcaggatgtcccggagccgtatcaatgatgctttccgtctgaatgacaacagcctagagtttctggggatacagccaacacttggacctcctaaccagccccctgtttccatatggctgattgtttttggagttgtgatgggagtgatagtggttggcattgtcatcctgatcttcactgggatcagagatcggaagaagaaaaataaagcaagaagtggagaaaatccttatgcctccatcgatattagcaaaggagaaaataatccaggattccaaaacactgatgatgttcagacctccttttagaaaaatctatgtttttcctcttgaggtgattttgttgtatgtaaatgttaatttcatggtatagaaaatataagatgataaagatatcattaaatgtcaaaactatgactctgttcagaaaaaaaattgtccaaagacaacatggccaaggagagagcatcttcattgacattgctttcagtatttatttctgtctctggatttgacttctgttctgtttcttaataaggattttgtattagagtatattagggaaagtgtgtatttggtctcacaggctgttcagggataatctaaatgtaaatgtctgttgaatttctgaagttgaaaacaaggatatatcattggagcaagtgttggatcttgtatggaatatggatggatcacttgtaaggacagtgcctgggaactggtgtagctgcaaggattgagaatggcatgcattagctcactttcatttaatccattgtcaaggatgacatgctttcttcacagtaactcagttcaagtactatggtgatttgcctacagtgatgtttggaatcgatcatgctttcttcaaggtgacaggtctaaagagagaagaatccagggaacaggtagaggacattgctttttcacttccaaggtgcttgatcaacatctccctgacaacacaaaactagagccaggggcctccgtgaactcccagagcatgcctgatagaaactcatttctactgttctctaactgtggagtgaatggaaattccaactgtatgttcaccctctgaagtgggtacccagtctcttaaatcttttgtatttgctcacagtgtttgagcagtgctgagcacaaagcagacactcaataaatgctagatttacacactcaaaaaaaaaaaa

SEQ ID NO: 60385 - DNA, 1317 bp, Homo sapiens
cggagtgacagccccacgggccacgcagcaagcagaagatccccgggagtcaccctcaaccctctggggccacgtgggcccatgaataccagcctgtctgcgagttagacgccagtcctggtggcccgggaagcccagatccgcatcagcggttctgcaccccacaccagcatgtgctcactgcctgtgccccgggagcccctgcgtcgcgtggctgtgactgggggcacgcatggcaacgagatgtcgggcgtctacctggcccggcactggctgcatgcccccgcagagctgcagagagccagcttctccgctgtgcctgtgctggccaacccggcagccacatccggctgccgccgctacgtggaccatgacctcaaccgcaccttcaccagcagcttcctcaattccaggcccaccccggacgacccatatgaggtgacaagagcccgagagctgaaccagctgctggggcccaaggcctcgggccaggcctttgactttgtccttgacctgcacaacaccacggccaacatgggcacctgcttaatcgcgaagtcctcccacgaagtctttgccatgcacctgtgccgccatctgcagctgcagtaccccgagctgtcctgccaggtcttcctgtaccagcggtctggggaggagagctacaacctggactctgtggccaaaaatggactgggtctggagctgggcccccagccacagggtgtgctgcgggctgacattttctcaaggatgaggaccctggtggccacagttctggacttcatcgaactcttcaaccagggtacggcctttcctgcctttgagatggaagcctatagacccgtgggcgtcgtggacttcccccgcaccgaggccgggcacctggcaggcactgtgcatcctcagctgcaggaccgagacttccagccactgcagcctggtgctcccatcttccagatgttcagtggggaggacctgctctatgagggagagtccacggtgtaccccgtgttcattaacgaggctgcctactatgagaagggcgttgcctttgtccagactgagaagttcacattcaccgtgcctgccatgcccgcgctgacccctgccccgagcccagcttcctaacccaagacacacctccccaacctcagtcttcccatctgaacgatgggtcctgaggcacagctctgagcacagaggtcccttctgccacctaccatgcaccatgttccttgccaggcctccccaacccctggcctcaatttccctttctataaaatggaagatgtccagaaaaaaaaaaaaaaaaaa

SEQ ID NO: 60386 - DNA, 2001 bp, Homo sapiens
cggccttcctgtacagcgacggccagtccgagaccatccttggcggcctggggctccgaatgggcagcagcgactgcagagtgaaaattgctaccaaggccaatccatggattgggaactccctgaagcctgacagtgtccgatcccagctggagacgtcactgaagcggctgcagtgtccctgagtggacctcttctatctacatgcacctgaccacagcgccccggtggaagagacactgcgtgcctgccaccagctgcaccaggagggcaagttcgtggagcttggcctctccaactatgccgcctgggaagtggccgagatctgtaccctctgcaagagcaacggctggatcctgcccactgtgtaccagcttctggaaggagcaccacttcgagggcattgccctggtggagaaggccctgcaggccgcgtatggcgccagcgctcccagcatgacctcggccgccctccggtggatgtaccaccactcacagctgcagggtgcccacggggacgcggtcatcctgggcatgtccagcctggagcagctggagcagaacttggcagcggcagaggaagggcccctggagccggctgtcgtggacgcctttaatcaagcctggcatttgtttgcccacgaatgtcccaactacttcatctaagctcattgtggctcaggctgcccaaggcttttctgtcaactcttttgctctctcccgctttgtctaatttagaactgcctcactaaattcttagggatggaagtatttggaaaaaaacctaacagtagagtcaccacctaaggaagaataaaatctcccagggtgctgtgtgttagtctgtttgcgttgctataaaagaatacctgagactgggtcatgtataaagaaaagaggtttctttggctcacagttctgcagtctgtacaagagggtgtggtgccggcatctgctcttggtgagggcctcaggaagcttagaatcatggcagaaggggaaacggagccagcgtgtcacatggtgagagagggagcaagagacagacaggggaggaaattcacacactgatggtggggatgtaaaatggtacaaccagtttggaaaacagtttggcagtttctcaaaggattaaacataaaattaccataggattcagcagttccacttgtgggtatgtagccaagagaaatgaaaacatatctccccacaaaaaaacttgggtatgagatttcacattatcattgctcataatagccaataagtaaaaacaacccaaatgtccaagaatgaataaatggataaacaaaatatggtatatttatacaacagactattattcggccattaaaaaaaaaaagagtggctgacacctgtaatctcagcactttgagaggccaaggcagtaggactgattgaagacaggagttccagaccagtctgggaaacaaagcgagaccctgtctccactaaacataaaaacaaaattactggggccccatggcacacacctgtagtcccagctgctcgggaagctgagatgggcggattgcttgagcccaggtattcaagtctggagtgagctatgactgtgccactgcactccagcctgggcgacagagcaaaccctgtttccaaacaaacaaacaaacaaacaaatacacagacagaagtagttaaacatctacaaggtaagtgcatcttgaagacgtgttaagttaaagaagccaattacaaaaggtttcacgttgtatgatttcgtttatatgaaatgtccagaataggcaaatctgtttgagagagagaaagtagatgagtacttgcctaggactgggaggaggattgcgaggaaatggagattcactgctaatgagtacagggtttcttttgggggcgcttatgaagatgctctgaaattgattgtgatggttgtacaactctgaatacatgaaacagcattaaacatcactttaagtaagtcaaaaaaaaaaaaaaaaaaaa

SEQ ID NO: 60387 - DNA, 1301 bp, Homo sapiens
gccgcccgctccgagcctggtgcttccgaccgctgcgcgcggctcctgggctgtcacagtctcccgttgccgccgtcatgtcccggcagctgtcgcgggcccggccagccacggtgctgggcgccatggagatggggcgccgcatggacgcgcccaccagcgccgcagtcacgcgcgccttcctggagcgcggccacaccgagatagacacggccttcgtgtacagcgagggccagtccgagaccatccttggcggcctggggctccggctgggcggcagcgactgcagagtgaaaattgataccaaggccattccactgtttgggaactccctgaagcctgacagtctccggttccagctggagacgtcactgaagcggctgcagtgtccccgagtggacctcttctacctgcatatgccagaccacagcaccccggtggaagagacactgcgtgcctgccaccagctgcaccaggagggcaagttcgtggagcttggcctctccaactatgcagcctgggaagtggccgagatctgtaccctctgcaagagcaacggctggatcctgcccactgtgtaccagggcatgtacaatgccatcacccggcaggtggaaacggagctcttcccctgcctcaggcactttggactgaggttctatgccttcaaccctctggctgggggcctgctgaccggcaagtacaagtatgaggacaagaatgggaaacagcccgtgggccgcttctttgggaatacctgggcagagatgtacaggaatcgctactggaaggagcaccactttgagggcattgccctggtggagaaggccctgcaggccgcgtatggcgccagcgcccccagcatgacctcggccaccctccggtggatgtaccaccactcacagctgcagggtgcccacggggacgcggtcatcctgggcatgtccagcctggagcagctggagcagaacttggcagcggcagaggaagggcccctggagccggctgtcgtggacgcctttaatcaagcctggcatttggttactcacgaatgtcccaactacttccgctaggcccatcgtttctcaggctgcccaaggctcttctgtaacatcttttgttactcacattttctttaatttagaactgcctcagtaaattcttagggatggaagtatttggacaaaaacctaatagaagagtcaccaccaaatgaagaataaaactcccagggtgctgtgaaaaaaaaaaaaaaaaaaaaaaaaaaaaaaaaaaaaaaaaaaaaaaaaaaaaaaaaaaaa

SEQ ID NO: 60388 - DNA, 2904 bp, Homo sapiens
ctgcctggagagacatctggccaagttctggtgagcaggaaaaatgtctactcgttaccaccaagctgctagtgatagttacctggaacttctaaaagaggctaccaagcgagatctaaatctttcggatgaagacggcatgactcctactctcttggcagcctaccatgggaacttggaagccctagagataatctgcagtagaggaggggaccctgataggtgtgacatctggggaaacactcctctacattttgcagcctccaatggccatgcccactgcgtctcattcctggtcaactttggtgccaacatctttgccctggataatgacttacagactccactggatgctgctgccagcagggagcagaatgaatgtgttgctctcctggacaaggctgccactgcacagaacatcatgaaccccaagaaggtcaccaggctgaaggagcaggctcagaagaatgccaggaggcagatcaaagagtgtgagaggctccaggagaagcaccaaaataagatggcccacacctacagcaaggaggaatccgggactctctcttcttccaagggtaccttctccagatcatccccttcaaatgcttctgctcctggcacattcgggtcactatctaagggcattaaagacactttcaagatcaagttcaagaagaacaaagatacagcagaacaggtggggaaggaaggcagaagtgggcagaggaacgtgatggaagtgttcagagaggaagaggaagactcgttctcaggggacttcaaagagaagctccagttgtcagcagaggaggacggcagtgtgcaccatgaatccattctcaatcgtccaggtctaggaagtattgtttttagaaggaacaggatatcgagtcctgaagacatctcagatagcaagagagagtttggttttaaactgcccagtgaattgcttcaaagacaaggagcatcagaggctgatgagggtgcagctgatgaagagggagaggaaaacggcctcaaagatgatctgccgtgggatgacgatgaagtggagtgggaggaagatgtggtcgatgccacgcccctggaagtgttcttgctgtctcagcacctggaagaattcctgcctatcttcaagagagagcagattgatctagaagctctgctgctctgctctgatgaggaccttcagagcatacaaatgcagctgggtcccaggaagaaagttctgaatgctatcaacaggaggaagcaggtgcttcaacagcctgggcagctggtcgacaccagcctgagatggagagttttggcctggagcattggggtgatgctgtggcccgctggcagcactccaggcggcaccccctctttacccaatgccagaccactgggaatggattctagggcatcggaaatgcctacctgagagagagacccaaactttactctgggaggtaggctatgcccatccaaataaatctccatgagaaacttgaggagacttcataacaagaatctggcatttctcttcagttatcttatatgtacatataattgtttttgtggttgttttgttttgttttgttttgttttttggagatgaaggtctcagtctcttacccaggctagggtgcagtggtgtgatcatagttcactgtattctcaacctcctaggctcaaatgatctcctcccacctcagcctcccaagtagctgagactacaggttcacaccccccacacctggcttattttgtatgttttagtagaggtggggtcttgccacattgcccaggctggtctcaaactcctggcctcaagcaatcctcccacctcagcctcctaaagcactgggattacaggtgtgaaccaccgtacccagcctatctttttgatacttttgaataaagaaagggtcatatgcatgacaggaaaatgaaagaaacttcctttacttttctatctctggatttaaaattataatctcatcacattatcctgctgcttgctttccgatctgtgtaacctgggaattccaattctttttctctccttagatctatgactttgcctagtggtagagactagagttctttcctggcctgcggcttgatgcccaacttaaatgcatctaaccctttaacaaatgtgtacatgtttacaagtaatggaaatgcgtctataatactcctgcctgagaatagagacagagtggtggtggggagagtgaagaaagagatagaatacaggtggtacctgttgtggactgaattgcgtcaaattcatatgttggagctctaacccctaatgtgactgtaattggaaataagacctttaaagaagtgattaaggttaaatgaagtcataagaatgcaaccctaatcctgtaggactggtgtcctttttttccctttttttttttttttgagatggagccttgctctgtcactcatgctggagtgcagtggcgtgatctcagctcactgcagcccccgcctcccaggttcgagcacttttcatgcctcagcctcctgagtagctgggattacaggcgtgcaccacaacgcctggctaagtttttgtatttttagtagaggcggggtttcaccatgttggccaggctggtctcaaactcctgacctcaggtgatccacctgcctcggcctcccagagtgctgggattacaggcatgagccactgcacctggcctaggactggtgtcctaagaagaggaagagacacttaggtggaaggcacacagagaggccacgtgaggacacagtgagaaggtggccgtctgcaagccgaggagggggcctcaggagaaaccaaccctgcaatcaccttgatcttgggctttcagcccccaaaggtgtgagaaaataaacttcggttgataaactgct

SEQ ID NO: 60389 - DNA, 3494 bp, Homo sapiens
taatttttgcccagtctgcctgttgtggggctcctcccctttggggatataagcccggcctggggctgctccgttctctgcctggcctgaggctccctgagccgcctccccaccatcaccatggccaagggcttctatatttccaagtccctgggcatcctggggatcctcctgggcgtggcagccgtgtgcacaatcatcgcactgtcagtggtgtactcccaggagaagaacaagaacgccaacagctcccccgtggcctccaccaccccgtccgcctcagccaccaccaaccccgcctcggccaccaccttggaccaaagtaaagcgtggaatcgttaccgcctccccaacacgctgaaacccgattcctaccaggtgacgctgagaccgtacctcacccccaatgacaggggcctgtacgtttttaagggctccagcaccgtccgtttcacctgcaaggaggccactgacgtcatcatcatccacagcaagaagctcaactacaccctcagccaggggcacagggtggtcctgcgtggtgtgggaggctcccagccccccgacattgacaagactgagctggtggagcccaccgagtacctggtggtgcacctcaagggctccctggtgaaggacagccagtatgagatggacagcgagttcgagggggagttggcagatgacctggcgggcttctaccgcagcgagtacatggagggcaatgtcagaaaggtggtggccactacacagatgcaggctgcagatgcccggaagtccttcccatgcttcgatgagccggccatgaaggccgagttcaacatcacgcttatccaccccaaggacctgacagccctgtccaacatgcttcccaaaggtcccagcaccccacttccagaagaccccaactggaatgtcactgagttccacaccacgcccaagatgtccacgtacttgctggccttcattgtcagtgagttcgactacgtggagaagcaggcatccaatggtgtcttgatccggatctgggcccggcccagtgccattgcggcgggccacggcgattatgccctgaacgtgacgggccccatccttaacttctttgctggtcattatgacacaccctacccactcccaaaatcagaccagattggcctgccagacttcaacgccggcgccatggagaactggggactggtgacctaccgggagaactccctgctgttcgaccccctgtcctcctccagcagcaacaaggagcgggtggtcactgtgattgctcatgagctggcccaccagtggttcgggaacctggtgaccatagagtggtggaatgacctgtggctgaacgagggcttcgcctcctacgtggagtacctgggtgctgactatgcggagcccacctggaacttgaaagacctcatggtgctgaatgatgtgtaccgcgtgatggcagtggatgcactggcctcctcccacccgctgtccacacccgcctcggagatcaacacgccggcccagatcagtgagctgtttgacgccatctcctacagcaagggcgcctcagtcctcaggatgctctccagcttcctgtccgaggacgtattcaagcagggcctggcgtcctacctccacacctttgcctaccagaacaccatctacctgaacctgtgggaccacctgcaggaggctgtgaacaaccggtccatccaactccccaccaccgtgcgggacatcatgaaccgctggaccctgcagatgggcttcccggtcatcacggtggataccagcacggggaccctttcccaggagcacttcctccttgaccccgattccaatgttacccgcccctcagaattcaactacgtgtggattgtgcccatcacatccatcagagatggcagacagcagcaggactactggctgatagatgtaagagcccagaacgatctcttcagcacatcaggcaatgagtgggtcctgctgaacctcaatgtgacgggctattaccgggtgaactacgacgaagagaactggaggaagattcagactcagctgcagagagaccactcggccatccctgtcatcaatcgggcacagatcattaatgacgccttcaacctggccagtgcccataaggtccctgtcactctggcgctgaacaacaccctcttcctgattgaagagagacagtacatgccctgggaggccgccctgagcagcctgagctacttcaagctcatgtttgaccgctccgaggtctatggccccatgaagaactacctgaagaagcaggtcacacccctcttcattcacttcagaaataataccaacaactggagggagatcccagaaaacctgatggaccagtacagcgaggttaatgccatcagcaccgcctgctccaacggagttccagagtgtgaggagatggtctctggccttttcaagcagtggatggagaaccccaataataacccgatccaccccaacctgcggtccaccgtctactgcaacgctatcgcccagggcggggaggaggagtgggacttcgcctgggagcagttccgaaatgccacactggtcaatgaggctgacaagctccgggcagccctggcctgcagcaaagagttgtggatcctgaacaggtacctgagctacaccctgaacccggacttaatccggaagcaggacgccacctctaccatcatcagcattaccaacaacgtcattgggcaaggtctggtctgggactttgtccagagcaactggaagaagctttttaacgattatggtggtggctcgttctccttctccaacctcatccaggcagtgacacgacgattctccaccgagtatgagctgcagcagctggagcagttcaagaaggacaacgaggaaacaggcttcggctcaggcacccgggccctggagcaagccctggagaagacgaaagccaacatcaagtgggtgaaggagaacaaggaggtggtgctccagtggttcacagaaaacagcaaatagtccccagcccttgaagtcacccggccccgatgcaaggtgcccacatgtgtccatcccagcggctggtgcagggcctccattcctggagcccgaggcaccagtgtcctcccctcaaggacaaagtctccagcccacgttctctctgcctgtgagccagtctagttcctgatgacccaggctgcctgagcacctcccagcccctgcccctcatgccaaccccgccctaggcctggcatggcacctgtcgcccagtgccctggggctgatctcagggaagcccagctccagggccagatgagcagaagctctcgatggacaatgaacggccttgctgggggccgccctgtaccctctttcacctttccctaaagaccctaaatctgaggaatcaacagggcagcagatctgtatatttttttctaagagaaaatgtaaataaaggatttctagatgaaaaaaaaaaaaaaaaa

SEQ ID NO: 60390 - DNA, 1460 bp, Homo sapiens
tgcagcgcaggtgagctctcctgaggacctctctgtcagctcccctgattgtagggaggatccagtgtggcaagaaactcctccagcccagcaagcagctcaggatgttcctgaaggccgtggtcctgaccctggccctggtggctgtcgccggagccagggctgaggtcagtgctgaccaggtggccacggtgatgtgggactacttcagccagctgagcaacaatgccaaggaggccgtggaacatctccagaaatctgaactcacccagcaactcaatgccctcttccaggacaaacttggagaagtgaacacttacgcaggtgacctgcagaagaagctggtgccctttgccaccgagctgcatgaacgcctggccaaggactcggagaaactgaaggaggagattgggaaggagctggaggagctgagggcccggctgctgccccatgccaatgaggtgagccagaagatcggggacaacctgcgagagcttcagcagcgcctggagccctacgcggaccagctgcgcacccaggtcagcacgcaggccgagcagctgcggcgccagctgaccccctacgcacagcgcatggagagagtgctgcgggagaacgccgacagcctgcaggcctcgctgaggccccacgccgacgagctcaaggccaagatcgaccagaacgtggaggagctcaagggacgccttacgccctacgctgacgaattcaaagtcaagattgaccagaccgtggaggagctgcgccgcagcctggctccctatgctcaggacacgcaggagaagctcaaccaccagcttgagggcctgaccttccagatgaagaagaacgccgaggagctcaaggccaggatctcggccagtgccgaggagctgcggcagaggctggcgcccttggccgaggacgtgcgtggcaacctgaggggcaacaccgaggggctgcagaagtcactggcagagctgggtgggcacctggaccagcaggtggaggagttccgacgccgggtggagccctacggggaaaacttcaacaaagccctggtgcagcagatggaacagctcaggcagaaactgggcccccatgcgggggacgtggaaggccacttgagcttcctggagaaggacctgagggacaaggtcaactccttcttcagcaccttcaaggagaaagagagccaggacaagactctctccctccctgagctggagcaacagcaggaacagcagcaggagcagcagcaggagcaggtgcagatgctggcccctttggagagctgagctgcccctggtgcactggccccaccctcgtggacacctgccctgccctgccacctgtctgtctgtctgtcccaaagaagttctggtatgaacttgaggacacatgtccagtgggaggtgagaccacctctcaatattcaataaagctgctgagaatctagcctc

SEQ ID NO: 60391 - DNA, 911 bp, Homo sapiens
gactccagaggaggaagtccagagacagagcaccatgacttctgagaaaggtccttcaaccggtgaccccactctgaggagaagaatcgaaccctgggagtttgacgtcttctatgaccccagagaacttcgtaaagaggcctgtctgctctacgaaatcaagtggggcatgagccggaagatctggcgaagctcaggcaaaaacaccaccaatcacgtggaagttaattttataaaaaaatttacgtcagaaagagattttcacccatccatgagctgctccatcacctggttcttgtcctggagtccctgctgggaatgctcccaggctattagagagtttctgagtcggcaccctggtgtgactctagtgatctacgtagctcggcttttttggcacatggatcaacaaaatcggcaaggtctcagggaccttgttaacagtggagtaactattcagattatgagagcatcagagtattatcactgctggaggaattttgtcaactacccacctggggatgaagctcactggccacaatacccacctctgtggatgatgttgtacgcactggagctgcactgcataattctaagtcttccaccctgtttaaagatttcaagaagatggcaaaatcatcttacatttttcagacttcatcttcaaaactgccattaccaaacgattccgccacacatccttttagctacagggctgatacatccttctgtggcttggagatgaataggatgattccgtgtgtgtactgattcaagaacaagcaatgatgacccactaaagagtgaatgccatttagaatctagaaatgttcacaaggtaccccaaaactctgtagcttaaaccaacaataaatatgtattacctctggcaaaaaaaaaaaaaaaaaaaa

SEQ ID NO: 60392 - DNA, 883 bp, Homo sapiens
gactccagaggaggaagtccagagacagagcaccatgacttctgagaaaggagaagaatcgaaccctgggagtttgacgtcttctatgaccccagagaacttcgtaaagaggcctgtctgctctacgaaatcaagtggggcatgagccggaagatctggcgaagctcaggcaaaaacaccaccaatcacgtggaagttaattttataaaaaaatttacgtcagaaagagattttcacccatccatgagctgctccatcacctggttcttgtcctggagtccctgctgggaatgctcccaggctattagagagtttctgagtcggcaccctggtgtgactctagtgatctacgtagctcggcttttttggcacatggatcaacaaaatcggcaaggtctcagggaccttgttaacagtggagtaactattcagattatgagagcatcagagtattatcactgctggaggaattttgtcaactacccacctggggatgaagctcactggccacaatacccacctctgtggatgatgttgtacgcactggagctgcactgcataattctaagtcttccaccctgtttaaagatttcaagaagatggcaaaatcatcttacatttttcagacttcatcttcaaaactgccattaccaaacgattccgccacacatccttttagctacagggctgatacatccttctgtggcttggagatgaataggatgattccgtgtgtgtactgattcaagaacaagcaatgatgacccactaaagagtgaatgccatttagaatctagaaatgttcacaaggtaccccaaaactctgtagcttaaaccaacaataaatatgtattacctctggcaaaaaaaaaaaaaaaaaaaa

SEQ ID NO: 60393 - DNA, 1794 bp, Homo sapiens
agacagagggagcagtgaatagcaatagggtgtttccaccatggtcttcactcaggccccggctgaaatcatgggccacctccggatacgcagcctcctggcccggcagtgcctggcagagtttctgggtgtgtttgtactcatgctcctcacccaaggagctgtggcccaggctgtcaccagtggagaaaccaaaggcaacttcttcaccatgtttctggctggctctctggccgttacgatagccatctacgtgggtggtaacgtctcaggggcccacctgaatccagccttctccctggccatgtgcatcgttggacgcctcccctgggtcaagctccccatttacatcttggtgcagttgctgtctgctttctgtgcttcgggagccacctatgttctctaccatgatgccctacagaactatacaggtgggaacctgacagtgactggccccaaggagacagcctccatttttgccacctatcctgccccctatctgtccctgaacaatggcttcctggatcaggttctgggcactgggatgctgattgtggggctcttggccatcctggacagacggaacaagggagtccctgcgggtctggagcctgtggtggtggggatgctgatcctggccctcgggttatccatgggtgccaactgcgggattccactcaaccctgcccgggacctgggcccacgtctcttcacctacgtggctggctggggtcctgaagtcttcagtgctggtaatggctggtggtgggtgcctgtggtggcccctctggtgggggccaccgttggcacagccacttaccagctgttggtggctctgcaccaccctgagggcccagagccagctcaggatctggtgtctgctcaacacaaagcctcagagttggaaactcctgcctcagctcagatgctggagtgtaagctatgattaggacaaccctcacttcactcatggaccctggagccagccactgaccccgcctgggaacaacagtcattcttcctctttgttaatgtgccagaacctgggaggcttctctgtttatctgtttggcatcccttcctcctaaactaagaaggatcctggacagggagaagtggaggaggataaggtaccaggactcaggcttctcatcccctcctcccgcaaagcggttttctgaccctcagggcctctcggaatgtagttgctcgaggtaaccgctagagggtgcgcacctggatgctggatggggacggctgcgggcatctgcagggtggagggggccaccatccagtgtagggcacaaccctggggactgccctccatagcctgtcccgactgccgactcctagctctcatcgcctcggcgcctcccaccttcaccctctcggggatgcctccccaagagggtagttaggggtggggaagccgcctccacccagggggcgtggtgggggcggagggaaggagggcggcggggcacagagacagagagcaaggctgtgaaactgaggcaccgttcctagacatctcggtgctgtgtcgttcattcaaggagagttgagatacagtgaaatgagccagggcgaggagggagggtgaaggaacggagggcgggcggctccgaggagcgagagtcgggctgagggcaacctggcgccagggaaaattctggttattcaccacttctacagctctcctgccgctccctgcagaggatgctcgttttgcagagaaggcagtgttcctctattcccttcttccgaattaaaaataccccctcagagcgaaaa

SEQ ID NO: 60394 - DNA, 1306 bp, Homo sapiens
tgataagctacaacataaacacatctaggttcttgttcttagaatacagcatgaagaatttgctttcttctttcttcctaacattttcatgtgagatccagaaaggacacattgtctctggccattcgaagagagaaagaaagaaagaaaaaaaaggtatttagagacagagagagaaaaaggctgaaatgggttcgctgggttctaaaaatccgcaaaccaaacaagcccaagttcttcttttgggacttgactcagctgggaagtctactctcctttataaattaaagcttgctaaggatattaccaccatccctacaataggtttcaatgtggaaatgatcgagttggaaaggaatctttcactcacagtctgggatgttggaggacaggaaaaaatgagaactgtttggggctgttactgtgagaacaccgatgggctggtgtatgttgtggacagtacagacaaacagcgactggaagagtctcagagacagtttgagcacattttgaagaatgaacacattaaaaatgtgcctgttgttctattagccaacaaacaagacatgcctggagctctgactgctgaggacatcaccagaatgttcaaagtgaagaagctttgcagtgaccggaactggtatgtgcaaccctgctgtgccctcacaggggaggggctggcccaggggttcaggaaattaactggatttgtgaagagccacatgaaatcaagaggagacactttggcgttcttcaagcagaactgaggctgcgaaaaatccaagtctctacagagacactgatgaagttgaaagggtaattgtttttccatgccaaatgaggaaatcaaattaatgagttgacaaacttttcctgagatgttatttcatctacatttagttaaacaacttagaatgatatctagaaaatatttattttcagccaggaactttagcaaactgtggcaatgatcactgggaatgaaaacgtataatgttctacaatttttgttatcacattggatgactttgaatatagtagtgacacttgggaccaaataaattattttatatgactactagaacaaagttttagtaagctgtctgctaatagagtcagaattcttccagattgtttccagctgtaacaggtattgaatttccaccgtgctcctatgtaacagctgggtggtgtaaaaaatgaacttcaaattatggagtggaagaagcgtaatgttaatatcttgtaaattcgtattccctattaaataaagctttcttattccctaaaaaaaaaaaaaaaaaaa

SEQ ID NO: 60395 - DNA, 2289 bp, Homo sapiens
atgagtgccatcacagtggcccttctcagcctcttgtttatcaccagtgggaccattgaaaaccacaaagatttaggaggccattttttttcaaccacccaaagccctccagccacccagggctccacagctgcccaacgctccacagccacccagcattccacagccacccagagctccacagccactcaaacttctccagtgcctttaaccccagagtctcctctatttcagaacttcagtggctaccatattggtgttggacgagctgactgcacaggacaagtagcagatatcaatttgatgggctatggcaaatccggccagaatgcacagggcatcctcaccaggctatacagtcgtgccttcatcatggcagaacctgatgggtccaatcgaacagtgtttgtcagcatcgacataggcatggtatcacaaaggctcaggctggaggtcctgaacagactgcagagtaaatatggctccctgtacagaagagataatgtcatcctgagtggcactcacactcattcaggtcctgcaggatatttccagtataccgtgtttgtaattgccagtgaaggatttagcaatcaaacttttcagcacatggtcactggtatcttgaagagcattgacatagcacacacaaatatgaaaccaggcaaaatcttcatcaataaaggaaatgtggatggtgtgcagatcaacagaagtccgtattcttaccttcaaaatccgcagtcagagagagcaaggtatccttcaaatacagacaaggaaatgatagttttgaaaatggtagatttgaatggagatgacttgggccttatcagctggtttgccatccacccggtcagcatgaacaacagtaaccatcttgtaaacagtgacaatgtgggctatgcatcttacctgcttgagcaagagaagaacaaaggatatctacctggacaggggccatttgtagcagcctttgcttcatcaaacctaggagatgtgtcccccaacattcttggaccacgttgcatcaacacaggagagtcctgtgataacgccaatagcacttgtcccattggtgggcctagcatgtgcattgctaagggacctggacaggatatgtttgacagcacacaaattataggacgggccatgtatcagagagcaaaggaactctatgcctctgcctcccaggaggtaacaggaccactggcttcagcacaccagtgggtggatatgacagatgtgactgtctggctcaattccacacatgcatcaaaaacatgtaaaccagcattgggctacagttttgcggctggcactattgatggagttggaggcctcaattttacacaggggaaaacagaaggggatccattttgggacaccattcgggaccagatcctgggaaagccatctgaagaaattaaagaatgtcataaaccaaagcccatccttcttcacaccggagaactatcaaaacctcacccctggcatccagacattgttgatgttcagattattacccttgggtccttggccataactgccatccccggggagtttacgaccatgtctggacgaagacttcgagaggcagttcaagcagaatttgcatctcatgggatgcagaacatgactgttgttatttcaggtctatgcaacgtctatacacattacattaccacttatgaagaataccaggctcagcgatatgaggcagcatcgacaatttatggaccgcacgcattatctgcttacattcagctcttcagaaaccttgctaaggctattgctacggacacggtagccaacctgagcagaggtccagaacctccctttttcaaacaattaatagttccattaattcctagtattgtggatagagcaccaaaaggcagaactttcggggatgtcctgcagccagcaaaacctgaatacagagtgggggaagttgctgaagttatatttgtaggtgctaacccgaagaattcagtacaaaaccagacccatcagaccttcctcactgtggagaaatatgaggctacttcaacatcgtggcagatagtgtgtaatgatgcctcctgggagactcgtttttattggcacaagggactcctgggtctgagtaatgcaacagtggaatggcatattccagacactgcccagcctggaatctacagaataagatattttggacacaatcggaagcaggacattctgaagcctgctgtcatactttcatttgaaggcacttccccggcttttgaagttgtaactatttagtga

SEQ ID NO: 60396 - DNA, 1401 bp, Homo sapiens
ccgagtctcaccctcccaggcagctcctacactcaactgcttctctaggaaaggtctcacctccagcctggagcagtcgggattacagaaagccccatccttggcttagggagcgccatgacgactgaaattggttggtggaagctgactttcctccggaaaaagaaatccactcccaaagtgctgtatgagatccctgacacctatgcccaaacagagggagatgcagaacccccgaggcctgacgctggaggccccaacagcgactttaacacccgcctggagaagattgtggacaagagcacaaagggcaagcacgtcaaggtctccaactcaggacgcttcaaggagaagaagaaagtgagagccacgctggcagagaaccctaacctctttgatgatcacgaggaaggacggtcatcaaagtgaagggctgaggagggtgctagcacctcttggctccctgccatcagccagatctgagacaggaccttgccacgctggcctctttggccatagctgaagctgtggggccagttgatacctgctggcaggaaatggctgttttttaggtttgtatttatgtgccgccacttttgtaaggcctgggagatcccagggtcctccaccctccccctgaccacatacaaaggcactctagttcaagagtgaaaaatctcacccaggaggaacagccctccttgaagcaatggcagggccagcagggaggtgggcatggcagggaatggagagagtgagccagacagacttcacctccttactggacacagggtcaagggcgagtttcaattgctgctccctttactttctctacctgtgactactccctggaccaatcctgaggagggcacattttccagaagccacgtgataggggctggtttctgtggagccagaggcagagacactgaacttgagctcacctcctaacaccggcagtaaacttcctggaactttgccctcaggtgcggaggggacagaggaccctggcactctgttagggtgctgtagaagactagattgatggtagtttggcctgttagttcctgttttggccatgacttttgcagatggcaagtcacacaccctcaaagggaagctacacgggccaaatcgggggagtgggtggggaattttctcctctccctttcctactataatagtatttaagacatatcagctccagagatgagtcctggagccttgaattttgtttaacaaaataattgtaggtttctctctgtaataacaacgctggaaaggccgagaacctcttttatgctcatgtcttgcatttattgagatgactgtttctcatgcctttatgttccttcatgtaagtaaagtggacctttgtgctcaaaaaaaaaaaaaaaaaaa

SEQ ID NO: 60397 - DNA, 2446 bp, Homo sapiens
gaatgtaaagagatccagggctcttggagagggacaagtgagagccagccaaaaaggaaaaagcaaaggcagaaacggcatcaggagagacagagatgtgaaggagggaaggagcaggagagcaggaaggaaacgcaggaggagggagcagcatctcctgtgaacacagaggagcacctgtttgctgttaaaatcgatctccctcggcaccctgagcaatggatataatatttggcaggaataggaaagaacagctggagcctgtgagggccaaagtgacaggcaagattccagcatggctgcagggaaccctgctccgcaatgggcctgggatgcacacagttggggagtccagatacaaccattggttcgacggccttgccctgctccacagcttcaccatcagagacggtgaagtctattacaggagcaaatacctgagaagcgatacctacaacaccaatattgaggcaaacaggattgtggtgtctgagtttggaacaatggcctatccggacccctgcaaaaacatattttccaaagctttctcctacttgtctcacaccatccccgatttcaccgacaactgcctgatcaacatcatgaagtgcggagaagacttctacgcgacctcagagaccaattacatcaggaaaatcaacccacagactctggaaaccctggagaaggttgattatcgtaaatacgtggcggtaaatctggcaacgtcacatccccattatgatgaggctggaaatgttctaaacatgggcacatccattgtggaaaaggggaagacaaagtatgtgatttttaagatccctgccacagtaccagagggcaagaagcaggggaagagcccctggaagcacacagaggtgttctgctccatcccatcccgctccctgctctccccaagctactaccacagctttggagtcaccgagaactatgtcatcttccttgagcagcctttcaggttggatattctcaagatggcaaccgcatacatccggagaatgagctgggcctcctgcctggctttccacagggaggagaagacttatatccacatcatcgaccaaaggaccaggcagcctgtgcagaccaagttttacacagacgccatggtggtcttccatcacgtcaacgcctacgaagaggacggctgcatcgtgtttgacgtcattgcctacgaggacaacagcctctaccagctcttctacctggccaacctgaaccaggacttcaaggagaactccaggctcacctcggtccccaccctcaggaggtttgccgtgcccctccacgtggacaagaatgcagaagtgggcacaaatttaatcaaagtggcatctacaacagccacggccctgaaggaagaagatggccaagtctactgccagccggaatttctttatgaaggcttagagcttccacgggtcaattatgctcacaatggaaagcaataccgatatgtctttgctacaggagttcagtggagtccaatcccaaccaagataataaaatatgacattctcacaaagtcatccttaaaatggagagaggacgactgctggccagcggaacccctgtttgtgcccgcgccaggtgccaaggatgaggatgacggagtaatcttatcagccattgtctctactgatccccaaaagctgccttttctgctcattctggatgccaaaagctttacggaattggcccgtgcctctgttgatgtcgatatgcacatggatctccatggattattcattacagacatggactgggacacaaaaaagcaggccgcttctgaggaacagcgggacagggcttccgactgccacggggctcctctgacctgatggtgttggggtttgggtaggggaggggagctcggctgtcagaactccatggatatgtttctttggatggaggggagggcctttgttaccttttgcacttattctttctgtgggtgctttgacaagggcatggcaagagagcttgtcagtatcatttctttcattttattttggctgtaaaaattttgtttgaaagtcaaacatttgaacatcaaatatgtattgattagatccagtccttctaagaaacctcctttcctttaacaaaaagaccttgaccatgaatcagagattgtattcaatgacattatcatcatttttagaacgagccactaacctattagagaagaggcagataattatttatcattgtgccttcctctgtctctttctctttcctttgctccctcccatgtttctggtggactaaattgtgtatctgggagttctcactttctagccaggcctgatgagttaagttacatgaccaggaaggttatgccactttgtggtcattccatgcaagtcatggcgtaatataaaataataaaaactttaaagtctgaaaaaaaaaaaaaaaaaaa

SEQ ID NO: 60398 - DNA, 6196 bp, Homo sapiens
atgccaagaactggagctcaggatggagcatggatccaaaagcaggttgtttttgaaggtcaaatggcttcaacgtatgaacaggatgaagtcattgctattgatgatatatctttcagttcaggctgcttgcctgccaatgatggaattttactgtgtcaagaagcattgaatgctgagcgggagctatgccatccagatacagatctctgcagatttgatgctacagatgaagagttgagattgtgtcaggcctgtgggtttgaatttgacatgtgtgagtggacgtcagaagcatctgctggccaaatttcctggatgcgcacaaaagcgagagagatccctgcattcgaatccacacctcagcaggatcaaggaggtgatgatgaaggttattatgtatgggtaggcgctaagcatggtttcactcttaaccatttagacagcagggcttacctaaatagctctgtgtgtcattgcctgggcaagagctgtcatcttcaattctattatgcaatggaaagcagtgtcctgagagtaagactgtataataataagatgcgatcaaaagtagtgaaactcaacaacattgactttggtacccttgatttcttcactggaagagaaaagcatagactggcatctctaagagatagagtgttaataaatatgttaaatatttttcttgaaagctttttcaattttactaccaagactttagatttcctagtactttatatcatacaggaagaagaaatattttggacatacaacatatcaactcacagccaatgggtgaaagcagatgtgttaataccagaagatctgaagacatttaagattatttttgaagggactcttttgagccagagaagttttattgcccttgatcacctctgggtctatgcctgtggacagacccaatccagaaagctttgctctgcagacgaattcccttgcactagtggccagtgcatcgccaaagaatctgtctgtgactctcggcaggactgctccgatgagagtgatgaagacccagcaacttgctcaaagcatctcacctgtgactttgagtcgggtttctgcggttgggagccatttctcacagaagattcacactggaagctgatgaaaggattgaataatggagagcaccactttcctgcagctgatcacacagcaaacataaatcatggatcgtttatttatttggaggcacagcgctcccccggggtggccaagcttggaagtcctgttcttacaaaattgctcactgcctctaccccatgtcaggtgcagttttggtatcatttgtctcaacattcaaatctctcagtttttacaagaacgtctctagatggaaacttgcaaaagcagggcaaaataatcagattctccgaatctcagtggagccacgcaaaaattgatctcattgcagaagcgggagaatctactctaccttttcagttaattttggaagctactgttttgtcgtcaaatgctaccgttgctctagatgacatcagtgtgtcccaggaatgtgaaatttcctataaatcactaccaaggaccagtacacaaagcaagttttccaagtgtgactttgaagcaaacagctgtgattggtttgaagcaattagtggtgaccattttgactggatacggagctctcagagtgaactttctgctgattttgagcaccaggctccacctcgggatcatagtctcaacgcatctcaagggcattttatgttcattctgaagaaaagcagcagcttgtggcaagttgctaagcttcagagcccaactttcagccagacaggacctggatgcatactttccttctggttctataactatggcctgtcagtgggagcagctgagctgcagctacatatggaaaattctcatgactcaacagtgatttggagagtattatacaatcagggcaaacaatggttggaggcaaccattcagctagggcgcctttcgcagcccttccatttgtcactagataaagtcagtctgggcatttatgatggggtctcagctattgatgacatccgatttgaaaattgtactctccctcttcctgctgagagctgtgaagggctggatcatttctggtgtcgccacaccagggcttgcatagaaaagcttcggttatgtgatctggtggatgactgtggtgatcgtactgatgaagtcaactgtgcacctgagctgcagtgtaactttgaaactggaatctgtaactgggaacaagatgcaaaagatgactttgattggaccaggagccagggtccaactccaacacttaacacagggccaatgaaagataacactctgggcacagctaaaggacactatctctacatagaatcttcagagccacaggcttttcaagacagtgctgccttactcagcccaatccttaatgccactgatacaaaaggctgcaccttccgcttctattaccacatgtttggaaagcgcatttataggttggcaatctaccaacgaatctggagtgactcaaggggacagctgctgtggcagatatttgggaatcaaggcaacagatggattaggaaacacctcaacatttccagcaggcagccctttcagatattggtggaggcttcagtgggagatggcttcactggagatattgcgattgatgatctgtcatttatggactgcaccctctaccctggtaatttgccagcagacctcccaactccaccagaaacgtcagttcctgtaacattacctccacacaactgcacagacaatgaatttatctgcaggtctgatggtcactgcattgaaaaaatgcagaaatgtgattttaaatatgactgccctgacaaatcagatgaagcatcctgtgttatggaagtttgcagctttgagaaaagaagcctgtgtaaatggtatcaaccaatcccagtacatttgcttcaagattcaaacacattcaggtgggggcttgggaacgggatcagcattcatcatggggaagaaaaccacaggccatcagtggatcatacacaaaataccactgatggctggtacctgtatgctgacagttctaatgggaaatttggtgacacggctgacattctcactcctatcatttcactcacgggaccaaaatgtaccttggtgttctggacacatatgaatggggccaccgttggttctctccaggtgctcatcaagaaagataacgttacttctaaattgtgggctcaaactggacagcaaggtgcacagtggaagagagcagaagtgtttttaggcattcgttcacatacacagattgtcttcagagccaaacgtggtatcagttacataggagatgtagcagtggatgatatttccttccaagattgctcccctttgcttagcccagagagaaagtgtactgatcatgaattcatgtgtgctaataagcactgcattgccaaagacaagctgtgtgattttgtgaatgattgtgctgataattcagatgagactactttcatttgccgtacctccagtgggcgctgtgatttcgaatttgatctttgttcctggaagcaggagaaagatgaggactttgactggaacctgaaagctagcagcatccctgcagcaggcacagagccagcagcagatcacactttgggaaattcatctggtcattacatctttataaagagtttgtttcctcagcagcccatgagagctgccagaatttcaagtccagttataagtaagagaagcaaaaactgcaagattatttttcattatcacatgtatggaaatggcattggggcactcaccttaatgcaggtgtcagtcacaaaccaaacgaaggttctacttaacctcactgtagaacaaggcaatttctggcggagagaagaactgtcactgtttggtgatgaagacttccaactcaaatttgaaggtagagttgggaaaggtcagcgtggagacattgcacttgatgacattgtgcttacagaaaattgtctatcactccatgattccgtgcaagaagaactggcagtgcctcttccaacaggtttctgcccacttggctatagggaatgtcataatggaaaatgctataggctggaacaaagctgtaacttcgtagataactgtggagataatactgatgaaaatgagtgtggtagctcctgtacttttgaaaaaggctggtgtggctggcaaaactcccaggctgacaactttgattgggttttaggggttggctctcatcaaagcttaagacctcccaaagaccacacacttggaaatgaaaatgggcacttcatgtatctggaagctactgcagtgggccttcggggtgacaaagcacacttcaggagtaccatgtggcgagaatccagtgcagcctgcaccatgagcttctggtatttcgtatctgcaaaggccacaggatccattcagattctcatcaagacagagaaaggactatcaaaagtatggcaagaaagtaagcagaaccctggtaatcattggcaaaaggctgacatcctgctaggaaagttaaggaattttgaagtcatatttcaaggtatcagaacaagggacctgggaggaggagctgcaattgatgatattgaatttaaaaactgcacaactgtgggagagatctctgagctttgtccggaaatcactgattttttgtgccgggacaagaagtgcattgcatcccaccttctttgtgactataagccagactgctctgataggtctgatgaagctcactgtgcacattatacaagcacaacaggaagctgcaattttgaaacaagttcaggaaactggaccacagcctgcagtcttactcaagactctgaggatgacttggactgggccattggcagcagaattcctgccaaagcattaattccagactctgatcacacgccaggtagtggtcagcacttcctgtacgtcaactcatctggctccaaggaaggatccgttgccagaattactacttccaaatccttcccagcaagccttggaatgtgtactgttcggttctggttctacatgattgatcccaggagtatgggaatattaaaggtgtataccattgaagaatcggggctaaacatcctggtgtggtcagtgattggaaataaaagaacgggatggacatatggctctgtgcctctctccagtaacagtccgtttaaggtggcatttgaagctgatttggatggaaatgaggacatctttattgctcttgatgacatctcttttaccccagagtgtgtgactggaggtcctgtcccagtgcagccatcaccctgtgaagctgatcagttttcttgtatctacacactccaatgtgtccctctctcagggaaatgtgatggacatgaagactgcatagatggatctgatgaaatggattgtcctctcagccccacccctccactctgtagtaacatggagttcccgtgctctacagacgagtgtataccttccctcctgctatgcgatggagtgcccgactgccactttaatgaagatgagctcatctgctccaacaaaagctgttctaatggagctctggtgtgtgcctcctccaacagctgtatcccagcccaccagcgctgtgatggttttgccgactgcatggatttccagcttgatgagtccagctgctccgatacatggactctcctgggtattggattagcattcctgatgactcacatcacagttgcagtcttgtgttttcttgcaaacagaaaggtaccaataaggaaaaccgagggaagtggtaactgtgcctttgtcaatccagtttacgggaactggagcaacccagagaaaacagagagttctgtctattccttctcaaacccattatatggcacaacatcaggaagcctggagaccctgtcacatcatctcaaatagcagcatcgagaccaagtctgatccaacatgtgtagtttctagaaaattgaagtctccacaatctgatagaaactcatcttctacaatggtaaaaagagaaaggattgtaaatgccagtgtaattataacatttatgaatgaattttcttgcagaatatagagaatgtttatatggaatcagaatcagtaccttatcttcactgaacatctgaatattttaataaaatttctattt

SEQ ID NO: 60399 - DNA, 929 bp, Homo sapiens
cggttgtggtcgctatatataaggtggggaggccgccggcccgttcggttccgggcgttaccatcgtccgtgcgcaccgcccggcgtccaggtgagtctcccatctgcagagacgcggacgcgccggcccgcagttggcctgcggagcgcggtggacggtttggcgcccaccaggcgatcaatactttggatttttaatttctagatttggcaattcttcgctgaagtcatcatgagctttttccaactcctgatgaaaaggaaggaactcattcccttggtggtgttcatgactgtggcggcgggtggagcctcatctttcgctgtgtattctctttggaaaaccgatgtgatccttgatcgaaaaaaaaatccagaaccttgggaaactgtggaccctactgtacctcaaaagcttataacaatcaaccaacaatggaaacccattgaagagttgcaaaatgtccaaagggtgaccaaatgacgagccctcgcctctttcttctgaagagtactctataaatctagtggaaacatttctgcacaaactagattctggacaccagtgtgcggaaatgcttctgctacatttttagggtttgtctacattttttgggctctggataaggaattaaaggagtgcagcaataactgcactgtctaaaagtttgtgcttattttcttgtaaatttgaatattgcatattgaaatttttgtttatgatctatgaatgtttttcttaaaatttacaaagctttgtaaattagattttctttaataaaatgccatttgtgcaagatttctcaaagattaggtatatatttaaatggaagagaaaatatttttatgggagaaaaatacatttgaaccatgaaatttcatcttttaaataacatccagtacagatttctgtgtaaaaaaaaaaaaaa

SEQ ID NO: 60400 - DNA, 815 bp, Homo sapiens
cggttgtggtcgctatatataaggtggggaggccgccggcccgttcggttccgggcgttaccatcgtccgtgcgcaccgcccggcgtccagatttggcaattcttcgctgaagtcatcatgagctttttccaactcctgatgaaaaggaaggaactcattcccttggtggtgttcatgactgtggcggcgggtggagcctcatctttcgctgtgtattctctttggaaaaccgatgtgatccttgatcgaaaaaaaaatccagaaccttgggaaactgtggaccctactgtacctcaaaagcttataacaatcaaccaacaatggaaacccattgaagagttgcaaaatgtccaaagggtgaccaaatgacgagccctcgcctctttcttctgaagagtactctataaatctagtggaaacatttctgcacaaactagattctggacaccagtgtgcggaaatgcttctgctacatttttagggtttgtctacattttttgggctctggataaggaattaaaggagtgcagcaataactgcactgtctaaaagtttgtgcttattttcttgtaaatttgaatattgcatattgaaatttttgtttatgatctatgaatgtttttcttaaaatttacaaagctttgtaaattagattttctttaataaaatgccatttgtgcaagatttctcaaagattaggtatatatttaaatggaagagaaaatatttttatgggagaaaaatacatttgaaccatgaaatttcatcttttaaataacatccagtacagatttctgtgtaaaaaaaaaaaaaa

SEQ ID NO: 60401 - DNA, 2778 bp, Homo sapiens
ctcattttgatgtctagaatcaggggatccaggatcatcaccaaggtcattttcccaggtatggaggggtctttctgcttctttcttgtcatgcacagctgctgaggaaggggctgggagtaaagacagtgaaatggggaggaggagtccattcaaaccgagaaacaaagtgtttggtttttcttacccctggtgtagaagctaccaaccttttccaagaaagagggcctggcccccttctcgggtctggctgggtgcctgctgtgcctctctggcctcccctccgaagggcaccattccctcgggtgagtactaccggcctgcaccgtcttccagtggggacagcctgagaagagagtctggggccttacttcagtaccttccttcactggcctcaccctgtgcaaatcatgccacacgctgcagcctccttttccctatctataaaataaaaatgaccctgctctatctcactgggctggcaagaacacactgttgttgccttgcagacagatgtgctgaggctgtagaaagtgctttttatttggttgggagcttgtgcataaatgcgagaggggctgcacatctgacggactagaggtgactcatggctgaaccggaacaggacatcggggagaagccagcagccatgctgaactctccacagggccctgtgaaaagctcttcacctcctctgccctctggatctagtgaagcctattcatccttcagatgtcagctcaaataatcaaccttcatggaggcctcccttgacccctaacatgctttcaaagtactgtgtatttcacattcatcatgccccgacaactgtgatttcccatttattaatatctgtctcttctgctggcctgcaaactccaggagcacagagacatctttgggatttttgaacatgatttccccagggcttagcccagtgcctggtgcaaagcaggctttcaacatgttcagtggatattgtaagaaagaaagaaatacacaaaaggcctggcatatgcaaagcactctaaatattcactcctttcccttccctctgggtgagaaaatttctccttataaagacaccctcctaactgtatctctgctagagaactgaagacataaagcactctgtgccaaaaatatttaagtaaaaacttgagctaagcacagagattataaatatttcttccccagattacgcaccatttaaaaatactgtctcagctccttttcatgatttgggtggtgattaaagaaaattactcttcaagactgaaagtcattactgcccttttcctgacttgccttttcccttgagaaggggaggataagctgcagggcaggaagtggaagtggggcatccttgtcctttgtctggcagacagccaactggtcaggtactgctccttctcaactctttcctgattcccaggtgaatataaacaagaaggcacaaatccacacttgccaacaacggacccaagtgataacaagaaacccagtgacacctgtctaggtgaagactcagcccctatgtgaccaggttgcaaagccaaactgaccatctgctttccatttggacttttagttcatactgtatcttctcaggacagttaagttggaatacaatgccactgtcctgaaagatggtagaattatcctatttctggaggagtgggggtggtgggtaggaatctcaagagcgatttgctcctctgcacaatagcttctttaaggacaccagggcccccagggctatacatttccctgaagctttccagataagcaacaaggtatgagcacctgctatgtattgcccaagggtgatgtgtttaaatatccattgcatattttaaatccttggctggcttaaagctgcaagctttctgtcttcagtggatataatgggggcatacatcccagagcttgcccaacactccaagaaaagaaccctcagctaatgcaaagtgtgtatgtgcccatgaaagctccatgtctacttaacattcagtttttaggattatttatgctgtaataatagatatgaaaatctctgacaggtattttgtttcctttacaaactgtatttgaatttatgggtgatttagagcttgtgtttaaagtcagaattcagaaccccaaagaaaatgacttcattgaaattgaactgaagagacaagaactgagttaccaaaacctactaaacgtgagttgctgtgaactggggattaaaccagaacgagtggagaagatcagaaagctaccaaacacactgctcagaaaggacaaagacattcgaagactgcgggactttcaggaagtggaactcattttaatgaaaaatggaagctccagattgacagaatatgtgccatctctgacagaaaggccctgctatgatagcaaagctgcaaaaatgacttattaaatactcccaggaatggccgcgcatggtggctcaccccctgtaatcccagcactttgggaagccaaggtgggcggatcacctgaggtcaggagttctagaccagcctggccaacatatagtgaaacccagtctctactaaaaaaaatacaaaaattagctaggtgtggtggcgcacacctgtagtagtcccagctacatgggaagctgaggcaggagaatcacctgaacccaggaggcagaggttgcagtgagctgagattgcgccactgcactccagcctggcgacagagcaagactctgtctctcaaaataaataaataaataaataaataaataaataaataatc

SEQ ID NO: 60402 - DNA, 1895 bp, Homo sapiens
gtgacagatgagcagtggtctgtctgcaatgagcatgtgctcaagctaacatggataccatcttggtcttcagcctaatcattgcatcctatgatgccaacaagaaagacctcagagatagcagttgccgactggaacagctgcctgggatcttcccaaaagacgtgagaagcatcagagaattgcaaatgcaagaaactcacacagaaaccaaaaggacaacattcattcaaaaccggactatagctaccctgcagtgccttggctctgacagcaaagtaaaagtcaaccttgtatatttggagagaaggccaaaggtcaagcatattttgaagaacctgagaatcattgctgctccccgcagaaacagctctgcctcctcaagctgtcacctaatccccacatccaagtttcagactggatctcttctaaaaggcaaagcttttttaccagggatctcacaatgtaaagtcctgggggcttcatcagagacttttcccaccactgccccttctataactcctgggaataaagaaggagagaaaactacaagtaccgacacagatgagaacctagagaagagacagaaatggagtattgtggtcaaaattctgattgctgtcaccctgttgctcagtggagttgccattatagtatttgtaatttttgaagtcccatgtccttatcaatgcctaggagccaggaagctgtgccaatgccagtggttgtggagatggcaaaagaagggaggccagccacctgggacagctgaatccaagcctgactctcagccccagaaggttggacaagatgctgccaattcatcaaacccaaagaaagctgcagagatcactgttatccaccagacatacttctgaaaagttctgctctatctcaaagactgaatgatactacacagtcctctccctattaatatgggcacattcttgccaatttcacacttgtatcttcagcagggacattacaatcaaacaccaattcctggttaatgaagggagagtgtgggcttagcagagttaccctcatgcccctatctgagccacaaccttctgtaattcacttcatacatccatctaaatggatacctttccatcccctcaaacgagaacaaaaagtattccctgcaagcactatgaatggaccttactactctctttgacagaagactcaaacacagcctctaagaaacaaggcagctgttagtgtgacatagcttccagctcctctgttatcttcacagctgacttcacactcactggccctcaatagcttagagtgggactcctgatctccctggttgacgtttataaggttttgtaatttagcttctggtactacatgtatctatccacacactgctgaagggaacttgaccctacgcattccaaaagccttcctcataagttatccccaaggggttcagggactacagaccattagtacccaagtgaagtcttctgacgatccagaattcctaaggtggctctgatattatatcatactttaatagagagttgcataccttttggacaaagattccagagcaaaataattatgataatgctgtttctcacaggagaatagctatgagtcaaatctaacctgcttaaataagagtttggtgagaaagtgaaaccacctgatcttgaatcaatgttgaggtgaaaaaggaaatgtcaggagggataagacagggtgaggccctgcttcttttcctaagagtctgaaaccattccatttcattttggtgaaatgtgtctgtttctaagaaattctgttttcttagttctctggttaaaaaaaaaaatacataaactgtatccttctttctttcacttcaaaaaaaaaaaaaaaaaaaaaaaaaaaaaaaaaaa

SEQ ID NO: 60403 - DNA, 2907 bp, Homo sapiens
cagactgtggagccgggagccggcagtaagcccagaggtctccaccccacgggaggaaggctgaggccaagaccccggaagagatggaccgcgtgaccagataccccatcctgggcatccctcaggcacaccgtggcaccggcctggtgctggatggagacaccagctacacataccatctggtgtgcatgggccccgaggccagcggctggggccaggatgagccgcagacatggcccactgaccacagggcccagcagggcgtgcagaggcagggggtgtcctacagcgtgcatgcctacactggccagccgtccccacgggggctccactcggagaacagggaggatgagggttggcaggtttaccgcctgggcgccagggatgcccaccagggacgtccaacatgggcactccgcccagaggacggggaggacaaggagatgaagacctaccgcctggatgctggggacgctgaccccaggaggctgtgtgacctggagcgggagcgctgggccgtcatccagggccaggcagtcaggaagagcagcaccgtggccacgctccagggcactcctgaccacggagaccccaggacccccggcccacctcggtccacgcccctggaggagaacgtggttgacagggagcagattgacttcctggcagcgagacagcagttcctgagtctggagcaggcgaacaagggggcccctcatagctccccggccagggggacccctgcaggcacaaccccaggggccagccaggcccccaaggccttcaacaagccccacctggccaacgggcacgtggttcccatcaagccccaggtgaagggggtggtcagggaagagaacaaggtgcgtgctgtgcccacctgggccagtgtccaagttgtggatgaccctggctccttggcctcagtggagtccccggggacccccaaggagacgcccatcgagcgggagatccgtctggctcaggagcgtgaggcagacctgcgagagcagagggggcttcggcaggcaaccgaccaccaggagctggtggaaatccccaccaggccgctgctgaccaagctgagcctgatcacagccccacggcgggagagagggcgcccgtccctctacgtgcagcgggacatagtacaggagacacagcgtgaggaagaccaccggcgggagggcctgcacgtgggccgggcgtccacacccgactgggtctcggagggtccccagcccggactccggagagccctcagctcagattccatcctcagcccggccccagatgcccgtgcggccgacccagctccagaagtgaggaaggtgaaccgcatcccacctgatgcctaccagccgtacctgagccccgggaccccccagctagaattctcagccttcggagcattcggcaagcccagcagtctctccacagcggaggccaaggctgcgacttcaccaaaggccacgatgtccccgaggcatctctcagaatcctctggaaaacccctgagcacaaagcaagaggcatcgaagccccctcggggatgcccgcaagccaacaggggtgtcgtgcggtgggagtacttccgcctgcgtcctctgcggttcagggccccagacgagccccagcaggcccaagtcccccatgtctggggctgggaggtggctggggcccctgcactgaggctgcagaagtcccagtcatctgatctgctggaaagggagagggagagtgtcctgcgccgggagcaagaggtggcagaggagcggagaaatgctctcttcccagaggtcttctccccaacgccagatgagaactctgaccagaactccaggagctcctcccaggcatccggcatcacgggcagttactcggtgtctgagtctcccttcttcagccccatccacctacactcaaacgtggcgtggacagtggaagatccagtggacagtgctcctcccgggcagagaaagaaggagcaatggtacgctggcatcaacccctcggacggtatcaactcagaggtcctggaagccatacgggtgacccgtcacaagaacgccatggcagagcgctgggaatcccgcatctacgccagtgaggaggatgactgagcctcgggatggggcgcccaccccctgccctgccctgaccctcgtgggaactgccaagaccatcgccaagcccccaccctaggaaatgggtcctaggtccaggatccaagaaccacagctcatctgccaacaatcccaccatgggcacatttgggactgttgggtttttcgtttccgtttctatcttcctttagaaatgtttctgcctttggggtctaaagcttttggggatgaaatgggacccctgctgattctttctgcttctaagactttgccaaatgccctgggtctaagaaagaaagagacccgctcctccactttcaggtgtaatttgcttccgctagtctgagggcagagggaccggtcaaagagggtggcacagatcgcagcaccttgaggggctgcgggtctgagggaggagacactcagctcctccctctgagaagtcccaagctgagaggggagacctgcccctttccaaccctgggaaaccatccagtctgagggaggaggccaaactcccagtgctgggggtccctgtgcagccctcaaacccttcaccttggtgcacccagccacacctggtggacacaaagctctcacatcgataggatcccatgaggatggtccccttcacctgggagaaaagtgacccagtttaggagctggaggggggtctttgtcccccacccccaaactgccctgaaataaacctggagtgagctgccaaaaaaaaaaaaaaaaaaaaaaaaaaaaaaaaaaaaaaaaaaaaaaaaaaaaaaaa

SEQ ID NO: 60404 - DNA, 670 bp, Homo sapiens
cagtctgcacgtgggtgagccggatggggcagtgccgtgtgctgtgacggggctggggctgagctttctgggggcgcctggcatcgccggccccgggtgcgggtcctgttagggacctatcccctgccccatggggggccttggactgggcatggggtccctgctgcacgcctggcctcaggcgccccctccccagccccagcagccactcctgggcctgtcctgggatgtgtgccctgaagcccctccccaccagcccccaccccgccccccatgcaccaccctccccagggctctctccgcagaccacagtgagctgcagggcaaggcccggctgcgggcccgggacgtggtgtgtgttctcatctgtattgagtccctgtgccagcgccacacgtgcctggaggccgtctcaggcctggagagcaacagcagggtcttcacgctacaggtgcaggggctgctgcagctgcaggctggacagtacgcttctgtgtttgtggacaatggctccggggccgtcctcaccatccaggcgggctccagcttctccgggctgctcctgggcacgtgagggcgcccaggggggctggcgaggagctgccgccggatcccggggaccctcctactgatgcccgtggtcaccacaataaagagccctccaccctcc

SEQ ID NO: 60405 - DNA, 1024 bp, Homo sapiens
gcgctgagccgcctcgggacggagccatgcggcgctgggcctgggccgcggtcgtggtcctcctcgggccgcagctcgtgctcctcgggggcgtcggggcccggcgggaggcacagaggacgcagcagcctggccagcgcgcagatccccccaacgccaccgccagcgcgtcctcccgcgaggggctgcccgaggcccccaagccatcccaggcctcaggacctgagttctccgacgcccacatgacatggctgaactttgtccggcggccggacgacggcgccttaaggaagcggtgcggaagcagggacaagaagccgcgggatctcttcggtcccccaggacctccaggtgcagaagtgaccgcggagactctgcttcacgagtttcaggagctgctgaaagaggccacggagcgccggttctcagggcttctggacccgctgctgccccagggggcgggcctgcggctggtgggcgaggcctttcactgccggctgcagggtccccgccgggtggacaagcggacgctggtggagctgcatggtttccaggctcctgctgcccaaggtgccttcctgcgaggctccggtctgagcctggcctcgggtcggttcacggcccccgtgtccggcatcttccagttctctgccagtctgcacgtggaccacagtgagctgcagggcaaggcccggctgcgggcccgggacgtggtgtgtgttctcatctgtattgagtccctgtgccagcgccacacgtgcctggaggccgtctcaggcctggagagcaacagcagggtcttcacgctacaggtgcaggggctgctgcagctgcaggctggacagtacgcttctgtgtttgtggacaatggctccggggccgtcctcaccatccaggcgggctccagcttctccgggctgctcctgggcacgtgagggcgcccaggggggctggcgaggagctgccgccggatcccggggaccctcctactgatgcccgtggtcaccacaataaagagccctcc

SEQ ID NO: 60406 - DNA, 1024 bp, Homo sapiens; identical to SEQ ID NO: 60405

SEQ ID NO: 60407 - DNA, 670 bp, Homo sapiens; identical to SEQ ID NO: 60404

SEQ ID NO: 60408 - DNA, 783 bp, Homo sapiens
cctttctgagcagctgtgtttgaagaaagctagtgggaaaagttccaggattacatgtcaggaaactacaagaggtagaaacatttgttgatttaccagtgtttttaacttcctgctgggctgaaaactgcttgtttcgtggaaaagcaaaacttgacagcaaacatctaaaatgaagagctcccaaacttttgaggaacaaacggaatgcattgtgaacactctactcatggacttcttgagcccaacattgcaggttgccagccggaacctatgctgtgtagatgaagtagattcaggagagccttgttcttttgatgtggctatcattgctggtcgccttcggatgttgggtgaccagttcaacggagaattggaagcttctgccaaaaacgtcattgcagaaaccattaagggacagacaggagctatactccaggacactgtggaatctctcagcaagacctggtgtgctcaggattccagcttagcttatgagagagcttttctggcagtgtcagtgaaacttcttgagtacatggctcacattgctcctgaagtagtgggacaggtggctatccccatgacgggtatgatcaatgggaaccaagccatccgggagttcatccagggccagggaggttgggaaaatctggagagctgaagagttggagctattcacgagactgaacatcacttccttgttgactgattgggtgattgattcctgggaattcaaacaaacaaataaaaaagcacttttttcattttatcagaactgaa

SEQ ID NO: 60409 - DNA, 2004 bp, Homo sapiens
agagcagaccaggcccggtggagaattaggtgctgctgggagctcctgcctcccacaggattccagctgcagggagcctcagggactctgggccgcacggagttgggggcattccccagagagcgtcgccatggtctgcagggagcagttatcaaagaatcaggtcaagtgggtgtttgccggcattacctgtgtgtctgtggtggtcattgccgcaatagtccttgccatcaccctgcggcggccaggctgtgagctggaggcctgcagccctgatgccgacatgctggactacctgctgagcctgggccagatcagccggcgagatgccttggaggtcacctggtaccacgcagccaacagcaagaaagccatgacagctgccctggacagcaacatcacagtcctggaggctgacgtcaatgtagaagggctcggcacagccaatgagacaggagttcccatcatggcacacccccccactacctacagtgacaacacactggagcagtggctggacgctgtgctgggctcttcccaaaagggcatcaaactggacttcaagaacatcaaggcagtgggcccctccctggacctcctgcggcagctgacagaggaaggcaaagtccggcggcccatatggatcaacgctgacatcttaaagggccccaacatgctcatctcaactgaggtcaatgccacacagttcctggccctggtccaggagaagtatcccaaggctaccctatctccaggctggaccaccttctacatgtccacgtccccaaacaggacgtacacccaagccatggtggagaagatgcacgagctggtgggaggagtgccccagagggtcaccttccctgtacggtcttccatggtgcgggctgcctggccccacttcagctggctgctgagccaatctgagaggtacagcctgacgctgtggcaggctgcctcggaccccatgtcggtggaagatctgctctacgtccgggataacactgctgtccaccaagtctactatgacatctttgagcctctcctgtcacagttcaagcagctggccttgaatgccacacggaaaccaatgtactacacgggaggcagcctgatccctcttctccagctgcctggggatgacggtctgaatgtggagtggctggttcctgacgtccagggcagcggtaaaacagcaacaatgaccctcccagacacagaaggcatgatcctgctgaacactggcctcgagggaactgtggctgaaaaccccgtgcccattgttcatactccaagtggcaacatcctgacgctggagtcctgcctgcagcagctggccacacatcccggacactggggcatccatttgcaaatagtggagcccgcagccctccggccatccctggccttgctggcacgcctctccagccttggcctcttgcattggcctgtgtgggttggggccaaaatctcccacgggagtttttcggtccccggccatgtggctggcagagagctgcttacagctgtggctgaggtcttcccccacgtgactgtggcaccaggctggcctgaggaggtgctgggcagtggctacagggaacagctgctcacagatatgctagagttgtgccaggggctctggcaacctgtgtccttccagatgcaggccatgctgctgggccacagcacagctggagccataggcaggctgctggcatcctccccccgggccaccgtcacagtggagcacaacccagctgggggcgactatgcctctgtgaggacagcattgctggcagctagggctgtggacaggacccgagtctactacaggctaccccagggctaccacaaggacttgctggctcatgttggtagaaactgagcacccaggggtggtgggccagcggacctcagggcggaggcttcccacggggaggcaggaagaaataaaggtctttggctttctccaaaaaaaaaaaaaaaaaaaaaaaaaaaaaa

SEQ ID NO: 60410 - DNA, 2041 bp, Homo sapiens
acaggagaatgagaggcctccgctggcgttacactcggctgcccagccaggtggaggacaccctgtctggggaggagggtaacgaagaggaagaggaggaggaggcagctccagacccagctgctgctcctgaggatcccacggtgccccagctgacagaagccagccaggttttgagtgcctcagagattcggcagctcagctttcacttcccaccaagagtcaccggccatccctggagtctggtcttctgcacgtcaagggacggtttcagcctgcagagcctgtaccggcggatggagggctgcagcgggccagtgctgctggtgctcagggaccaggacgggcagatatttggagccttctcctcctcggctatccgactcagcaaaggcttctatggtactggcgagacattcctcttctccttctccccacagctgaaggtctttaagtggactggaagcaactctttctttgtgaagggagacttggattcactgatgatgggcagtggcagtggccggtttgggctgtggttggatggagacttgttccgcgggggaagctccccttgcccgaccttcaacaacgaggtgctggcccggcaggagcagttctgcatccaggagctggaggcttggcttctcagctgacagccctgcggcaacagaattctatgattgaagcctctaaatgaattgtgcaggagagggagtttgtaaacaactgactacagacattcacattgggtcatctttaaaaagctggactctgcttttggatgcttctcggaggcgagttggattttggactgaagtactgtcgttccattcctttttttgaggtgttatgagtggggctataacatcgccatcctattaagaagagagagaaaaacaggcaatagagaaaagccagtttccatcatcttatttctgagtgaaagtctcaagtgcgcacatcctcatcttgcatatagattgcttctagctgtcctcaatccagggaaactccaaattacatatgccctgtgcttggggcaaattagaaacactacagtcttacgcaggaagagccttcatgaaaacagccactggcctctgcagagatgactgggagcagcataccactgcccacctctatggcctccttcacacaccttcacggagcacaaactctgtcctgttttcccaggagaaagacgggatgcactgaacccctagcttctctctcgcctggtcccctctgcaataaaaggcccaggtctacaagatggcaaagaaggggaggaagaacagtatgtacctgcagaatttaaatttttctctgcatcaaagctctaacgttggtcccatcagcataggctccagccaaagaagctcctccacccaaaataagggagagatccaaagggaggcgatacaatgacgtgaaaccatagaggtaagaagcaaggcctcctaatacttgactctatgctaaactgttctgaacttgtgggtagatcttctttggttacaagatgatgcacgatcttggagagcctctgttgtaccaggaatacaatgctggtgggaggattcgtgctcctcatctgcttatttgctctcagatccattcttcactcttcctctccctactctgtctcacaggagctactccggtaaattacatttctcagctcccatgcctgttggtttccagttagatttggtcagtgggaggctctggtgggagactggaggtgagaagagggcagagaagtcaggttttttctctccctacctcctctggcacgagcggcagtggcagtgactattctgtggttctagcttttgcaggtggccccagctcctggactcccacctgctcccttggtctctcctatcctagaggtggtagcagcttcctgctgttgaatcactgtcctctatgctcatttagctctgccaaaacttttgtatctcacccccatgttaaattttttctgttgaactacactggatctgacttgatagaactattaaaaatagttttt

SEQ ID NO: 60411 - DNA, 2033 bp, Homo sapiens
aaatagaagattgtggatccctgggaacgcagagcaggaatgcgtggcaggaaggaatctcccagggattcacagttcacccctaaatcaatccgtggggcccgaggggcaaagtatctgagtgacccagccctcagtcttgtgtccgttcctgagaaggagctcagccttgcccctcaggagctgcatgtaccaaataccacagatggaggcgtgacacagactgtccactgcagagaccatggacggaggcagcctccgagccagcccagcagccatggacggaggagccttggagccagcccagcagctctcctcactggaggggtggacgggacaggaccggctgctcattccacgctggagggaggccaggagtctcagctggatgcagtcacctgacctggagagttcaaagtgcctaacacagggacgctgctacccacaagcctggatcctggcgtgctccgcggctctccttcaagccctggcctcatcagacctccaaggctccctagacagggttaattattcacgtggcctgggacccagggttcgtttgtttgtctttcccgacacagtagggtccacgaggaagtcaggatccaccggcaatatttgcagtgttatgttgaatgtggcaactggctgcgtgaggatagagaagtaaacagcatgtccggtggcagtcggttaccacacagaatttaggaggcccagtgaaatgcaaatgctaggtaagtgacacgtaagtttttgatataagcataccccaggcaacatttatttattggaaattgaaactcacatttaaccggccatattatttttttttaatttttttgttctctaaatctatcttttgtttgccgaatttctagcaaccttagatggagaggtggctctgagattagcatccccacaggcccacctctggctggagagacaaagggaggtggggtgctgccggggagggagagccaaggtctacttccacgccgctcccagacctggggccagaggcccgcttgctgggggctggggctcagaggggagcgagcggctgctgtcaggctgtctgaaaatgctgtgcggattccccgattttctctcgcctggcaggtcacctggcccacactctcctcccctgatcccctgagtgctcccctccccctgcaggtccccctcccctctgggtgagcctggatgccagcaccctgttccgcccgcccagcatgcagaacaaaagcacaacgcacagaaacacagccggtgcgcgcagggcggcaggctggcttctccctccctcctgccgaggtctccggccccttcccccttccctccttccctcccctctcctcttctattagaaaatgggagtgttagggttgaattgtgtccccccaaaacaggtatgttggggtcctgattcccagtcccctagaatgtgaccgtgcttggagataagacctttacagagtaactgattaaaatgaggtcattagcagggaccctagtgcagcatgactggtgtcctttcaaaaaggagaaatttggatacagacatagacacacactgagggaaggtgaagtaaaggggcaaggagaagacggcctgcaacgggagtgacgcccttacaagccgagggacgcctggcagtgccagctgacaccaggagcagggagaggccaggaagcctggcagtgccagctgacaccaggagcagggagaggcctggaacggttctccctggagacatccgggacacaccttgatttcaggattccatgatagcttccagaactgccaaagaacgcatttctgtgttttcagccacccagtctgtggtatcttgtgactgccgccctaggaaagtaaaacaaggagttaattcatgaagggtgggggaaatacgtaccctttgaaataccacctagaggaaggggtaatagtacacccgatcatgtgctccagtttatgaaatagttgcacgtcactcggaattttgaaaaacaatatattttcaggactc

SEQ ID NO: 60412 - DNA, 891 bp, Homo sapiens
atgaacctgtggctcctggcctgcctggtggccggcttcctgggagcctgggcccccgctgtccacacccaaggtgtctttgaggactgctgcctggcctaccactaccccattgggtgggctgtgctccggcgcgcctggacttaccggatccaggaggtgagcgggagctgcaatctgcctgctgcgatattctacctccccaagagacacaggaaggtgtgtgggaaccccaaaagcagggaggtgcagagagccatgaagctcctggatgctcgaaataaggtttttgcaaagctccaccacaacacgcagaccttccaagcaggccctcatgctgtaaagaagttgagttctggaaactccaagttatcatcgtccaagtttagcaatcccatcagcagcagtaagaggaatgtctccctcctgatatcagctaattcaggactgtgagccggctcatttctgggctccatcggcacaggaggggccggatctttctccgataaaaccgtcgccctacagacccagctgtccccacgcctctgtcttttgggtcaagtcttaatccctgcacctgagttggtcctccctctgcacccccaccacctcctgcccgtctggcaactggaaagagggagttggcctgattttaagccttttgccgctccggggaccagcagcaatcctgggcagccagtggctcttgtagagaagacttaggatacctctctcactttctgtttcttgccgtccaccccgggccatgccagtgtgtccctctgggtccctccaaaactctggtcagttcaaggatgcccctcccaggctatgcttttctataacttttaaataaaccttggggggtgatggagtcattcctgcctgtta

SEQ ID NO: 60413 - DNA, 3697 bp, Homo sapiens
agggagtgttcccgggggagatactccagtcgtagcaagagtctcgaccactgaatggaagaaaaggacttttaaccaccattttgtgacttacagaaaggaatttgaataaagaaaactatgatacttcaggcccatcttcactccctgtgtcttcttatgctttatttggcaactggatatggccaagaggggaagtttagtggacccctgaaacccatgacattttctatttatgaaggccaagaaccgagtcaaattatattccagtttaaggccaatcctcctgctgtgacttttgaactaactggggagacagacaacatatttgtgatagaacgggagggacttctgtattacaacagagccttggacagggaaacaagatctactcacaatctccaggttgcagccctggacgctaatggaattatagtggagggtccagtccctatcaccatagaagtgaaggacatcaacgacaatcgacccacgtttctccagtcaaagtacgaaggctcagtaaggcagaactctcgcccaggaaagcccttcttgtatgtcaatgccacagacctggatgatccggccactcccaatggccagctttattaccagattgtcatccagcttcccatgatcaacaatgtcatgtactttcagatcaacaacaaaacgggagccatctctcttacccgagagggatctcaggaattgaatcctgctaagaatccttcctataatctggtgatctcagtgaaggacatgggaggccagagtgagaattccttcagtgataccacatctgtggatatcatagtgacagagaatatttggaaagcaccaaaacctgtggagatggtggaaaactcaactgatcctcaccccatcaaaatcactcaggtgcggtggaatgatcccggtgcacaatattccttagttgacaaagagaagctgccaagattcccattttcaattgaccaggaaggagatatttacgtgactcagcccttggaccgagaagaaaaggatgcatatgttttttatgcagttgcaaaggatgagtacggaaaaccactttcatatccgctggaaattcatgtaaaagttaaagatattaatgataatccacctacatgtccgtcaccagtaaccgtatttgaggtccaggagaatgaacgactgggtaacagtatcgggacccttactgcacatgacagggatgaagaaaatactgccaacagttttctaaactacaggattgtggagcaaactcccaaacttcccatggatggactcttcctaatccaaacctatgctggaatgttacagttagctaaacagtccttgaagaagcaagatactcctcagtacaacttaacgatagaggtgtctgacaaagatttcaagaccctttgttttgtgcaaatcaacgttattgatatcaatgatcagatccccatctttgaaaaatcagattatggaaacctgactcttgctgaagacacaaacattgggtccaccatcttaaccatccaggccactgatgctgatgagccatttactgggagttctaaaattctgtatcatatcataaagggagacagtgagggacgcctgggggttgacacagatccccataccaacaccggatatgtcataattaaaaagcctcttgattttgaaacagcagctgtttccaacattgtgttcaaagcagaaaatcctgagcctctagtgtttggtgtgaagtacaatgcaagttcttttgccaagttcacgcttattgtgacagatgtgaatgaagcacctcaattttcccaacacgtattccaagcgaaagtcagtgaggatgtagctataggcactaaagtgggcaatgtgactgccaaggatccagaaggtctggacataagctattcactgaggggagacacaagaggttggcttaaaattgaccacgtgactggtgagatctttagtgtggctccattggacagagaagccggaagtccatatcgggtacaagtggtggccacagaagtaggggggtcttccttgagctctgtgtcagagttccacctgatccttatggatgtgaatgacaaccctcccaggctagccaaggactacacgggcttgttcttctgccatcccctcagtgcacctggaagtctcattttcgaggctactgatgatgatcagcacttatttcggggtccccattttacattttccctcggcagtggaagcttacaaaacgactgggaagtttccaaaatcaatggtactcatgcccgactgtctaccaggcacacagagtttgaggagagggagtatgtcgtcttgatccgcatcaatgatgggggtcggccacccttggaaggcattgtttctttaccagttacattctgcagttgtgtggaaggaagttgtttccggccagcaggtcaccagactgggatacccactgtgggcatggcagttggtatactgctgaccacccttctggtgattggtataattttagcagttgtgtttatccgcataaagaaggataaaggcaaagataatgttgaaagtgctcaagcatctgaagtcaaacctctgagaagctgaatttgaaaaggaatgtttgaatttatatagcaagtgctatttcagcaacaaccatctcatcctattacttttcatctaacgtgcattataattttttaaacagatattccctcttgtcctttaatatttgctaaatatttcttttttgaggtggagtcttgctctgtcgcccaggctggagtacagtggtgtgatcccagctcactgcaacctccgcctcctgggttcacatgattctcctgcctcagcttcctaagtagctgggtttacaggcacccaccaccatgcccagctaatttttgtatttttaatagagacggggtttcgccatttggccaggctggtcttgaactcctgacgtcaagtgatctgcctgccttggtctcccaatacaggcatgaaccactgcacccacctacttagatatttcatgtgctatagacattagagagatttttcatttttccatgacatttttcctctctgcaaatggcttagctacttgtgtttttcccttttggggcaagacagactcattaaatattctgtacattttttctttatcaaggagatatatcagtgttgtctcatagaactgcctggattccatttatgttttttctgattccatcctgtgtccccttcatccttgactcctttggtatttcactgaatttcaaacatttgtcagagaagaaaaacgtgaggactcaggaaaaataaataaataaaagaacagccttttcccttagtattaacagaaatgtttctgtgtcattaaccatctttaatcaatgtgacatgttgctctttggctgaaattcttcaacttggaaatgacacagacccacagaaggtgttcaaacacaacctactctgcaaaccttggtaaaggaaccagtcagctggccagatttcctcactacctgccatgcatacatgctgcgcatgttttcttcattcgtatgttagtaaagttttggttattatatatttaacatgtggaagaaaacaagacatgaaaagagtggtgacaaatcaagaataaacactggttgtagtcagttttgtttgttaa

SEQ ID NO: 60414 - DNA, 2119 bp, Homo sapiens
cggtctccagggttcctggacttcccgctctttgtgctgggcagggaaggaaagtgagccctgggggtagatggcagaggtggggtcaaagttactttcctgccaccacccctgtctgtcctgggagctgcagttactgcagtgtgtgtgtgagtttgtagcagggtgggagaggagagaagggaggtggaggggctgcacctggagtgaggactgtatctgtgtgtgcaagccggggcgacagacggcctggcacactgaagtcaggtgccgggacccatggggcctgctgactcatggggacaccactggatgggaatcctgctttcagcctcgctttgtaccgtatggagtcctccagctgcagcccagctcaccctcaatgccaacccacttgatgccacccaaagtgaggatgttgttctgcctgtgtttgggacccccaggacaccccagattcatggcagatccagagagctggccaaaccctccattgcagtcagcccaggcactgccatagagcagaaggacatggtgaccttctactgcaccactaaggacgtcaacattaccatccactgggtttccaacaacctctccattgtgttccatgagcgcatgcagctgtccaaggatggcaagatcctcaccattctcattgtccagcgggaggactcagggacttaccaatgtgaagctcgagatgcccttctgagccagaggagcgaccccatcttcctggatgtgaagtatggtcctgatcctgttgaaatcaaattggagtctggtgttgccagtggggaggtggttgaggtgatggagggctccagcatgaccttcttagcggaaacaaagtctcacccaccctgtgcctatacttggtttctccttgactccattctgtctcacaccacgagaacattcaccatccatgctgtgtccagagaacatgagggcctgtacaggtgcttggtgtccaacagtgccacccacctgtccagcctgggtactctgaaggtccgagtacttgaaacactgaccatgcctcaagtcgtgccttcaagcctgaaccttgtggagaatgctaggtctgtggacctgacctgccaaaccgtcaatcagagtgtgaatgtccagtggttcctaagtggccagcccctcctgcccagtgagcacctgcagctgtcagctgacaacaggaccctaatcatccatggcctccagcggaatgacaccgggccctatgcctgtgaggtctggaactggggcagccgggcccggagtgagccccttgagctgaccatcaactatggtcctgaccaagtgcacatcaccagggagtcggcatctgagatgatcagcaccatagaggcagagctcaactccagcctgaccctgcagtgttgggccgagtccaagccaggtgctgagtatcgctggactcttgaacactccaccggggagcacctgggtgagcagctgattatcagggctctgacctgggaacacgacgggatctacaactgcacagcctccaactctctcactggcctggcccgctccacttcagtcctggtcaaggtggtaggtccccagtcctcctccctgtcctcaggggccatcgctggtattgtcatcgggatcctggctgtcattgctgtggcctcagaactgggctattttctctgcatcagaaatgccagacggccctcaaggaaaacaacagaggaccccagtcatgagacctcacaacccatcccgaaggaggagcaccccacagagcccagttccgaaagcctgagtcctgagtattgcaatatatcccagcttcagggacggatcagagtcgaactgatgcaaccaccagaccttccagaggagacctatgagacgaagctgccttcagcaagccgtagaggcaattctttcagcccctggaagccaccacccaaacctctgatgcccccactcagattggtctccactgtgccaaaaaacatggagtcaatctatgaggtgttggggatgcagcagtgatcaacatcgataaaatgcttttccttatggaattgacatcgtagtggtaggtcggacagtagaccaaataaataattaaaat

SEQ ID NO: 60415 - DNA, 3957 bp, Homo sapiens
gtggcgtggcgacggagtcgcgcgagggacacgccgcgttgtgggttctcggcctgaggtgcgagagaagcggtgaccgcggccctggctgctcggacccgggaacatgatggtcgctggagcagaaggcgctgagaagggaccacggcggcgctgggtcgtgcgagccagtagcgggctgaaacgtagaggccagaaccaggtctcagggggcactaaaggcggtcggaggtaatccccacaccgcttcctcctggaagtcaggctggccgggagctcccgtatccaggacggttggtcgcctctggcctggcagggatcctagtgtctcgggacctcccggtgacgcgcctgcctcccctgctgcaccataggcccgggagtacggcgtccccacagcttggaccggcaggggctcgtgaaatgtttgtcaagtggataaatgaccatggccgtggtctccgcgggaggtgaggaaactgaaagccaccgaggaaaaggggggcgctccttaagaagtgccgcggtcacgtgtacgtttcaaaagaatggcgtgactgagtagggaggggaccgcggagaccctcagaccctggactgtaaggagatgaggggccgtgaaggggaacccaggaaactgagtcctgaaagcaaggaggaacttccagaatgaagggcgccgacactccttcctgcctttgctcaagcggttccttcaccccgatcaagttccttcccatttctccatctgggggatcctgaacgtgcacatcctcagagaagccctcctggggtctccaattctagtttattgccccctcctatcgatcccccagcgcgctcatcgggcctgtggacaaggacaggtttgaagagaggattccctggatcgcggaagggctgcaggaatggcacagccccttccgaggatgccaaaggagcccgggcaaaggaaagtggccgtgcccgggcctgcctaccactagatccccacccacctatgactgctcagtcccgctctcctaccacacccacctttcccggcccaagccagcgcaccccgctgactccctgcccagtccaaactccaaggctgggcaaggcactgatccactgctggacagacccggggcagcctctgggtgaacagcagcgtgtccgccggcagcgaaccgagaccagcgagccgaccatgcggctgcacagacttcgtgcgcggctgagcgcggtggcctgtgggcttctgctgcttcttgtccggggccagggccaggactcagccagtcccatccggaccacacacacggggcaggtgctggggagtcttgtccatgtgaagggcgccaatgccggggtccaaaccttcctgggaattccatttgccaagccacctctaggtccgctgcgatttgcaccccctgagccccctgaatcttggagtggtgtgagggatggaaccacccatccggccatgtgtctacaggacctcaccgcagtggagtcagagtttcttagccagttcaacatgaccttcccttccgactccatgtctgaggactgcctgtacctcagcatctacacgccggcccatagccatgaaggctctaacctgccggtgatggtgtggatccacggtggtgcgcttgtttttggcatggcttccttgtatgatggttccatgctggctgccttggagaacgtggtggtggtcatcatccagtaccgcctgggtgtcctgggcttcttcagcactggagacaagcacgcaaccggcaactggggctacctggaccaagtggctgcactacgctgggtccagcagaatatcgcccactttggaggcaaccctgaccgtgtcaccatttttggcgagtctgcgggtggcacgagtgtgtcttcgcttgttgtgtcccccatatcccaaggactcttccacggagccatcatggagagtggcgtggccctcctgcccggcctcattgccagctcagctgatgtcatctccacggtggtggccaacctgtctgcctgtgaccaagttgactctgaggccctggtgggctgcctgcggggcaagagtaaagaggagattcttgcaattaacaagcctttcaagatgatccccggagtggtggatggggtcttcctgcccaggcacccccaggagctgctggcctctgccgactttcagcctgtccctagcattgttggtgtcaacaacaatgaattcggctggctcatccccaaggtcatgaggatctatgatacccagaaggaaatggacagagaggcctcccaggctgctctgcagaaaatgttaacgctgctgatgttgcctcctacatttggtgacctgctgagggaggagtacattggggacaatggggatccccagaccctccaagcgcagttccaggagatgatggcggactccatgtttgtgatccctgcactccaagtagcacattttcagtgttcccgggcccctgtgtacttctacgagttccagcatcagcccagctggctcaagaacatcaggccaccgcacatgaaggcagaccatggtgatgagcttccttttgttttcagaagtttctttgggggcaactacattaaattcactgaggaagaggagcagctaagcaggaagatgatgaagtactgggccaactttgcgagaaatgggaaccccaatggcgagggtctgccacactggccgctgttcgaccaggaggagcaatacctgcagctgaacctacagcctgcggtgggccgggctctgaaggcccacaggctccagttctggaagaaggcgctgccccaaaagatccaggagctcgaggagcctgaagagagacacacagagctgtagctccctgtgccggggaggagggggtgggttcgctgacaggcgagggtcagcctgctgtgcccacacacacccactaaggagaaagaagttgattccttcattcacttcgccattcattcatacttccgtccatccattcagaaagcatttattaagaatttactcaggcatgatggcccatacttgtaatcccagctattgggaaggatgagatgggaggatggcttgaggccagaggtttgagaccgaccagccagggcaacacagtgagaccccttctcaaaaaaaaaaaaaaaaaagagagagtgtgtgattagaagctaaataggaaagttttgagcttcaagtcagtgaggagtaaaaaagatttttaaaaagcaaagaaaacaaaatataagggaaaaatatgagaaaaataaaaataaaaagagaataataggccaggcactgtggctcatgcccctaatcccagcacttttgggaggtcaaggtgagcagaacacctgaggacaggagtttgagaccagcctgcccaacgtggtgaaaccccatctctatgaaaaatacaaaaatcagacgggcacagtggtggtgcccacctgtgatcccagctactcaggaggctgaggcaggagaattacttgaacctgggaggcagaggttgcagtgagctgagattgtgccactgtactccagcctgggcaacaagagcgagactccgtttccaaaaaaataagagagaatagaagaagctactgcatgatgttagttaccaagcctgccatgggtcctctcttgctagacacactccatagatccccccactgagctgtggatgggcaaaccccggtggaatcccaccctccccaacaccccactgagccctgggccccctcctcccttcctcacctccaccttctccctgccttctctcttctctcgtctgagcccccaggccttttccactttgagggaggtgcttcgaagaatgttgcccacacctaagtgttagaagcctatgtccgttcatccctgagaggtctgaaagaataaaaataaattctaaaaaaaaaaaaaaaaaaaca

SEQ ID NO: 60416 - DNA, 3909 bp, Homo sapiens
gtggcgtggcgacggagtcgcgcgagggacacgccgcgttgtgggttctcggcctgaggtgcgagagaagcggtgaccgcggccctggctgctcggacccgggaacatgatggtcgctggagcagaaggcgctgagaagggaccacggcggcgctgggtcgtgcgagccagtagcgggctgaaacgtagaggccagaaccaggtctcagggggcactaaaggcggtcggaggtaatccccacaccgcttcctcctggaagtcaggctggccgggagctcccgtatccaggacggttggtcgcctctggcctggcagggatcctagtgtctcgggacctcccggtgacgcgcctgcctcccctgctgcaccataggcccgggagtacggcgtccccacagcttggaccggcaggggctcgtgaaatgtttgtcaagtggataaatgaccatggccgtggtctccgcgggaggtgaggaaactgaaagccaccgaggaaaaggggggcgctccttaagaagtgccgcggtcacgtgtacgtttcaaaagaatggcgtgactgagtagggaggggaccgcggagaccctcagaccctggactgtaaggagatgaggggccgtgaaggggaacccaggaaactgagtcctgaaagcaaggaggaacttccagaatgaagggcgccgacactccttcctgcctttgctcaagcggttccttcaccccgatcaagttccttcccatttctccatctgggggatcctgaacgtgcacatcctcagagaagccctcctggggtctccaattctagtttattgccccctcctatcgatcccccagcgcgctcatcgggcctgtggacaaggacaggtttgaagagaggattccctggatcgcggaagggctgcaggaatggcacagccccttccgaggatgccaaaggagcccgggcaaaggaaagtggccgtgcccgggcctgcctaccactagatccccacccacctatgactgctcagtcccgctctcctaccacacccacctttcccggcccaagccagcgcaccccgctgactccctgcccagtccaaactccaaggctgggcaaggcactgatccactgctggacagacccggggcagcctctgggtgaacagcagcgtgtccgccggcagcgaaccgagaccagcgagccgaccatgcggctgcacagacttcgtgcgcggctgagcgcggtggcctgtgggcttctgctgcttcttgtccggggccagggccaggactcagccagtcccatccggaccacacacacggggcaggtgctggggagtcttgtccatgtgaagggcgccaatgccggggtccaaaccttcctgggaattccatttgccaagccacctctaggtccgctgcgatttgcaccccctgagccccctgaatcttggagtggtgtgagggatggaaccacccatccggccatgtgtctacaggacctcaccgcagtggagtcagagtttcttagccagttcaacatgaccttcccttccgactccatgtctgaggactgcctgtacctcagcatctacacgccggcccatagccatgaaggctctaacctgccggtgatggtgtggatccacggtggtgcgcttgtttttggcatggcttccttgtatgatggttccatgctggctgccttggagaacgtggtggtggtcatcatccagtaccgcctgggtgtcctgggcttcttcagcactggagacaagcacgcaaccggcaactggggctacctggaccaagtggctgcactacgctgggtccagcagaatatcgcccactttggaggcaaccctgaccgtgtcaccatttttggcgagtctgcgggtggcacgagtgtgtcttcgcttgttgtgtcccccatatcccaaggactcttccacggagccatcatggagagtggcgtggccctcctgcccggcctcattgccagctcagctgatgtcatctccacggtggtggccaacctgtctgcctgtgaccaagttgactctgaggccctggtgggctgcctgcggggcaagagtaaagaggagattcttgcaattaacaagcctttcaagatgatccccggagtggtggatggggtcttcctgcccaggcacccccaggagctgctggcctctgccgactttcagcctgtccctagcattgttggtgtcaacaacaatgaattcggctggctcatccccaaggtcatgaggatctatgatacccagaaggaaatggacagagaggcctcccaggctgctctgcagaaaatgttaacgctgctgatgttgcctcctacatttggtgacctgctgagggaggagtacattggggacaatggggatccccagaccctccaagcgcagttccaggagatgatggcggactccatgtttgtgatccctgcactccaagtagcacattttcagtgttcccgggcccctgtgtacttctacgagttccagcatcagcccagctggctcaagaacatcaggccaccgcacatgaaggcagaccatgttaaattcactgaggaagaggagcagctaagcaggaagatgatgaagtactgggccaactttgcgagaaatgggaaccccaatggcgagggtctgccacactggccgctgttcgaccaggaggagcaatacctgcagctgaacctacagcctgcggtgggccgggctctgaaggcccacaggctccagttctggaagaaggcgctgccccaaaagatccaggagctcgaggagcctgaagagagacacacagagctgtagctccctgtgccggggaggagggggtgggttcgctgacaggcgagggtcagcctgctgtgcccacacacacccactaaggagaaagaagttgattccttcattcacttcgccattcattcatacttccgtccatccattcagaaagcatttattaagaatttactcaggcatgatggcccatacttgtaatcccagctattgggaaggatgagatgggaggatggcttgaggccagaggtttgagaccgaccagccagggcaacacagtgagaccccttctcaaaaaaaaaaaaaaaaaagagagagtgtgtgattagaagctaaataggaaagttttgagcttcaagtcagtgaggagtaaaaaagatttttaaaaagcaaagaaaacaaaatataagggaaaaatatgagaaaaataaaaataaaaagagaataataggccaggcactgtggctcatgcccctaatcccagcacttttgggaggtcaaggtgagcagaacacctgaggacaggagtttgagaccagcctgcccaacgtggtgaaaccccatctctatgaaaaatacaaaaatcagacgggcacagtggtggtgcccacctgtgatcccagctactcaggaggctgaggcaggagaattacttgaacctgggaggcagaggttgcagtgagctgagattgtgccactgtactccagcctgggcaacaagagcgagactccgtttccaaaaaaataagagagaatagaagaagctactgcatgatgttagttaccaagcctgccatgggtcctctcttgctagacacactccatagatccccccactgagctgtggatgggcaaaccccggtggaatcccaccctccccaacaccccactgagccctgggccccctcctcccttcctcacctccaccttctccctgccttctctcttctctcgtctgagcccccaggccttttccactttgagggaggtgcttcgaagaatgttgcccacacctaagtgttagaagcctatgtccgttcatccctgagaggtctgaaagaataaaaataaattctaaaaaaaaaaaaaaaaaaaca

SEQ ID NO: 60417 - DNA, 1125 bp, Homo sapiens
atgaagcctctgcttgaaaccctttatcttttggggatgctggttcctggagggctgggatatgatagatccttagcccaacacagacaagagattgtggacaagtcagtgagtccatggagcctggagacgtattcctataacatataccaccccatgggagagatctatgagtggatgagagagatcagtgagaagtacaaggaagtggtgacacagcatttcctaggagtgacctatgagacccaccccatgtattatctgaagatcagccaaccatctggtaatcccaagaaaatcatttggatggactgtggaattcacgccagagaatggattgctcctgctttttgccaatggttcgtcaaagaaattctacaaaaccataaagacaactcaagtatacgcaagctccttaggaacctggacttctatgtccttccagttcttaacatagatggttatatctacacttggacaactgatcgtctttggaggaaatcccgttcaccccataataatggcacatgttttgggacggatctcaatcgaaatttcaatgcatcttggtgtagtattggtgcctctagaaactgccaagatcaaacattctgtgggacagggccagtgtctgaaccagagactaaagctgttgccagcttcatagagagcaagaaggatgatattttgtgcttcctgaccatgcactcttatgggcagttaattctcacaccttacggctacaccaaaaataaatcaagtaaccacccagaaatgattcaagttggacagaaggcagcaaatgcattgaaagcaaagtatggaaccaattatagagttggatcgagtgcagatattttatatgcctcatcagggtcttcaagagattgggcccgagacattgggattcccttctcatatacgtttgagctgagggacagtggaacatatgggtttgttctgccagaagctcagatccagcccacctgtgaggagaccatggaggctgtgctgtcagtcctggatgatgtgtatgcgaaacactggcactcggacagtgctggaagggtgacatctgccactatgctgctgggcctgctggtgtcctgcatgtctcttctctaa

SEQ ID NO: 60418 - DNA, 11344 bp, Homo sapiens
ctcttacctgccaacctgggaggttgatgatgaacatgtctttaccttttctttggagtttgcttaccttattaatatttgctgaagtaaatggcgaacgtggagaacttgagctgcagagacaaaaaagaagcatcaatctccaacagcctcgaatggctacagagagaggaaatttggtgtttcttacggggtctgctcaaaacattgagtttagaaccggatccctgggaaaaattaaattaaatgatgaagatctcagtgagtgtttacatcagatccagaaaaacaaagaagatattatagagttaaaagggagcgcaattggtctgcctcaaaatatatctagtcaaatctatcagcttaattccaagctggtggatcttgagagaaaattccaaggcttgcagcagactgttgacaaaaaggtttgcagcagcaatccttgccagaatggtgggaactgcctcaatctgcatgattcctttttttgtatctgtcccccacagtggaagggtcctctctgctcagctgatgttaacgaatgtgagatttactcaggaacacccttgagctgccagaatggaggcacatgtgttaatacaatgggaagttacagttgtcactgcccacctgagacgtacggaccccagtgtgcatccaaatatgacgactgtgaagggggttctgtggcacgctgtgtccatggcatctgtgaggatttaatgcgagagcaagctggagagcccaagtacagctgcgtctgtgatgctgggtggatgtcttcacccaacagccctgcctgcacgctggacagagacgagtgcagcttccagcccgggccttgctccacacttgtgcagtgtttcaacactcaaggctctttctactgtggggcctgtccaacaggctggcaaggcaatggatatatttgcgaagatatcaatgaatgtgagataaataatggcggctgttctgtggctccacccgttgagtgtgtgaatacacctgggtcttcccactgccaggcctgtccaccagggtaccagggtgacggaagagtgtgcacactcacagacatctgctcagtcagtaatggaggctgccacccagatgcctcatgctcctcaactctaggttccttacctctctgcacgtgtctcccgggttatactggaaatggttatgggccaaatggatgtgtgcagctcagtaatatttgcctaagtcacccctgtctaaatggacaatgcatcgacactgtctctggttatttttgtaagtgtgactcaggttggacaggtgtcaactgtacagaaaacatcaatgagtgtttgagcaacccctgtttgaatggaggaacttgtgttgatggcgttgattctttcagttgtgaatgcacacgtctctggactggagctctctgtcaggttcctcagcaagtttgtggagagtccctctcaggaataaatggaagcttcagctacaggagcccggatgttggttatgttcatgatgttaactgcttctgggttatcaaaactgaaatgggaaaggtcctgcgtatcactttcacttttttccggttagaatccatggacaactgtccacacgagtttcttcaggtttatgatggagattcctcttctgcttttcaacttggaagattttgtggctccagcctccctcatgaactcctcagcagtgacaatgctctctattttcatctctattctgaacatttaagaaatgggagaggctttacagtaagatgggaaacacagcaaccagagtgtggaggtatcctgactggtccttacggttctattaagtctccggggtatcctggaaactatcccccaggaagagattgtgtctggattgttgtaactagtcctgacctcctggtaacatttacttttgggaccttgagcctcgagcaccatgatgactgcaacaaagattaccttgagattcgagatggtcctttgtatcaggacccccttcttgggaagttctgcaccactttctctgtcccaccgctccagactactggcccctttgccagaattcacttccattcagactcccagattagtgaccaaggcttccatatcacctacttaacatcaccttcggatctgcgttgtggtgggaactacacggacccagagggtgaactcttcttgcctgagttgtctgggcctttcactcacaccaggcaatgcgtctatatgatgaagcagccccagggagaacaaatacaaatcaacttcacccacgtggagctgcaatgccagagtgacagttctcagaattacattgaggttcgagatggtgaaaccttacttggaaaagtctgtggcaacggaaccatctctcacattaaatccattactaatagtgtctggatcaggtttaaaatagatgcttctgttgaaaaagctagtttcagagctgtttatcaagtcgcttgcggggatgaattaactggagaaggggtcattcgctcgcctttttttcctaacgtgtatcctggagaaagaacctgtaggtggaccatccaccagccccaaagccaagtcattctcctcaacttcactgtctttgaaattggaagttctgcccactgtgaaacagattatgttgagattggtagcagttccattttgggttctcctgaaaataaaaagtattgcggtacagacataccttcatttataacatctgtgtacaattttctttatgtcacattcgtgaaaagttcttctactgaaaaccatggtttcatggctaagttcagtgctgaggatttggcatgtggagaaattcttacagaatcaacagggaccattcaaagtcctggccatccaaatgtctacccccacggtatcaactgtacttggcatatattagtccaacctaatcacctgattcatttaatgttcgaaacatttcatctggagtttcattacaattgcacaaacgactacttggaagtttatgacaccgactctgagacatcccttggaagatactgtggaaagtcgatcccgccatctctcacaagcagtggtaactcattgatgctggtgtttgtgactgactccgacctcgcttatgaaggcttcttaataaactatgaagcaatcagtgcagcaacagcatgtttgcaagactacacagatgatttggggacattcacttctccaaacttccccaataattatcccaacaactgggaatgcatttatcggatcacagtgagaactggccaactgattgcagtgcacttcacaaacttctccttggaggaagccattggaaactattatacagattttctggaaatcagagatggaggctatgaaaaatcaccattgctgggaatattctatggctcaaatctacccccaacaatcatctctcatagtaacaaactatggttaaaatttaagagtgaccaaatagacacaaggtctggattctcagcttactgggatgggtcatcaacaggttgcgggggtaatctcaccacttcaagcggtacgttcatatctcccaactacccgatgccctattaccacagctctgaatgctactggtggttgaaatctagccacggcagcgcatttgaactggaattcaaagactttcacttggagcatcatccaaactgcactttagattacctggctgtatatgatggcccaagtagcaactctcatctgctaactcagctttgtggggatgagaaaccccctcttattcgttctagtggagacagcatgtttataaaactgaggacagatgaaggtcagcaaggacgtggcttcaaggctgaataccggcagacatgtgagaatgtggtaatagtcaatcaaacctatggcatcttagagagtatagggtatccgaatccttattctgaaaatcagcattgcaactggaccatccgggcaacaacaggcaacactgtgaactacacatttttagcatttgacttggaacatcacataaactgctccacagattatttagagctctatgatggaccacggcagatgggacgctactgtggagtagacctgccccctccagggagtactacaagctccaagcttcaagtgctgctccttacagatggggttggccgccgtgagaaaggatttcagatgcagtggtttgtttacggttgtggtggagagctgtctggggccacaggctccttcagcagccccgggttccccaacaggtatccaccaaacaaggagtgtatctggtacattaggacggaccccgggagtagcattcagctcaccatccatgacttcgatgtggagtatcattcaaggtgcaactttgatgtcttggagatctatggaggccccgatttccactctcccagaatagcccaactgtgtacccagagatcacctgagaaccccatgcaggtctccagcactggaaatgagctagcaattcgattcaagaccgacttgtccataaatgggagaggcttcaatgcgtcatggcaagcagtcactggaggttgtggtgggattttccaggctcccagtggagagattcattctccaaattaccccagtccttataggagcaacacagactgttcttgggtcattcgggttgacagatatcatcgtgttctcttgaacttcactgactttgatcttgaaccacaagactcttgtattatggcatacgatggcttaagctccacaatgtcccgccttgccaggacgtgtggaagggagcagctggctaaccccatcgtctcctcaggaaacagcctcttcttgagatttcagtctggcccttccagacagaacagaggcttccgagctcaattcaggcaagcctgcggaggccacatcctcaccagctcatttgatactgtttcctctccacggttccctgccaattatccaaacaatcagaactgcagctggatcattcaagcgcaacctccattaaatcatatcaccctctcttttacccactttgaacttgaaagaagcacaacgtgtgcacgtgactttgtagaaattttggatggcggccacgaagacgcgcccctccgaggccgttactgtggcaccgacatgccccatcctatcacatccttcagcagcgccctgacgctgagattcgtctctgattctagcatcagtgctgggggtttccacaccacggtcaccgcatcagtgtcggcttgtggtggaacgttctacatggctgaaggcatcttcaacagccctggctacccagacatttatccccctaatgtggaatgtgtctggaacatcatcagttcccctggcaaccggctccagctgtcttttatatctttccagttggaagactctcaggactgcagcagagattttgtggagatccgtgaaggaaatgccacgggtcacttggtgggacgatactgtggaaactccttccctctcaattattcttccatcgttggacataccctgtgggtcagatttatctcagatggttctggcagcggcacgggcttccaggccacatttatgaagatatttggcaatgataatattgtgggaactcatgggaaagtcgcctctcctttctggcctgaaaactacccacataactccaattaccaatggacagtaaatgtgaatgcatctcacgttgtccatggtagaatcttggagatggacatagaagaaatacaaaactgctattatgacaaattaaggatctatgatgggcctagcattcacgcccgcctaattggagcttactgtggtacccagactgaatctttcagctccactggaaattctttgacatttcatttttactccgactcttcaatctcggggaagggattccttctggagtggtttgcagtggatgcacctgatggtgttttacctaccattgctccaggtgcttgtggtggcttcctgaggacgggagatgcacccgtgtttctcttctccccgggctggcctgacagttacagtaatagagtggactgtacgtggctcatccaggctcccgactctaccgtggaactcaacattctttccctggacattgaatctcaccgaacgtgtgcctatgatagccttgtgatacgagatggagataataacttggcccagcagctagcagttctctgtggcagagagatccctgggcccatccggtctactggagagtacatgttcatccgcttcacctcggactccagtgtaaccagggcaggcttcaatgcatcctttcacaagagctgcggtggatatttgcatgcagacagagggatcatcacgtcccccaagtatccagagacttacccatccaacctcaactgttcttggcacgtcctggtccaaagtggcctgaccattgctgtccattttgaacagcctttccagattccaaatggagattcttcttgcaaccagggggattacttggtgctaagaaatggtcctgatatctattctccacccttgggaccccctggaggaaatggtcatttttgtggcagtcatgcttcatcaactctgttcacctcggataatcaaatgtttgttcagtttatttctgatcacagtaatgaagggcaaggatttaaaatcaaatatgaggcaaagagtttagcctgtgggggcaacgtctacatccatgatgctgattctgctgggtatgtgacctcccccaaccaccctcataattatcccccgcacgctgattgcatttggatcttagcggctccaccggaaacacgcatacagctgcaatttgaagatcgattcgatattgaagtaacacccaactgtacttccaactaccttgagttgcgggatggagtggattcggatgcaccaatactttccaaattttgtgggacatctttgcccagcagtcagtggtcctcaggagaggttatgtatttgagatttcgatctgacaacagccccacacatgtgggattcaaggccaagtattctatagctcagtgtgggggaagagtaccagggcaaagtggtgttgttgaaagcattggacatccaacacttccatacagagacaacttattctgtgagtggcatctccaggggctctctggacactatctcaccatctcttttgaagactttaaccttcagaattcttctggctgtgaaaaagacttcgtggagatctgggacaatcatacctctggaaacatcttgggcagatactgtggaaacaccattcctgacagcatagacacttctagcaatactgctgtggtcaggtttgtcacagacggctctgtgactgcctcaggattcagactgcgatttgaatccagtatggaagagtgtggtggggatcttcagggctctattggaacatttacttctcccaactacccgaacccaaatcctcatggccggatctgcgagtggagaatcactgccccggagggaaggcggatcaccctaatgtttaacaacctgaggctggccacgcatccgtcctgcaacaatgagcatgtgatagtattcaatggcattagaagtaactcaccccagctagagaaactgtgtagtagtgtgaatgtaagcaatgagattaaatcttcaggaaacacaatgaaagtcatttttttcacggatggatccaggccatatggcggcttcactgcttcctatacctccagtgaagatgcagtgtgtggtgggtctcttccaaatactcctgaaggaaactttacttctcctggctatgacggagtcaggaattactcaagaaacctgaactgcgaatggactctcagcaatccaaatcagggaaattcatccatttccattcactttgaagatttttacctagaaagtcaccaagactgtcaatttgatgtcctcgagtttcgagtgggtgatgctgatgggcccctgatgtggagactttgtggtccttcaaagcctacattgccattggttataccttattctcaggtatggattcactttgtcaccaacgaacgtgtagaacacattggattccatgcaaagtattcctttacagattgtggcggaatacagataggtgacagtggagtgatcacaagccccaactatccaaatgcttatgacagcctgacccactgctcttggctgttggaggccccacaagggcacaccatcactctcacatttagtgactttgatattgaaccccatacaacttgtgcttgggactctgtcactgtcaggaatggtgggtcccctgaatcacccatcataggacaatactgtggaaattcaaaccccaggacaatacagtcaggttccaatcagctggtcgtgacttttaactcagaccattcattgcaaggtggtggattttatgctacgtggaacacacaaactttaggttgtggtggaatatttcattctgataatggtacaatcagatcccctcactggcctcagaattttcccgaaaacagcagatgttcctggacggccattactcacaaaagtaaacacttggagatcagctttgacaacaacttcctaatccccagcggtgatggacaatgtcagaatagcttcgtgaaggtgtgggcaggaactgaggaggtggacaaagccctgctagccactggctgtgggaacgtggctccgggtcccgttatcacaccaagtaacacattcactgccgtcttccagtctcaggaggcaccagctcagggcttctccgcgtcctttgttagccgatgtggaagtaatttcactggcccttcaggttacatcatttctccaaattacccaaaacaatatgacaacaacatgaattgcacctatgtcatagaggctaatcctctgtcagtggtcctcttgacttttgtgtccttccacttagaagctcgttccgctgtgacgggaagctgtgtcaacgatggcgtgcacattatcagaggttacagcgtcatgtccaccccatttgctactgtgtgtggggatgagatgccagctcccctcaccatcgctgggccggttctgcttaacttctactccaacgagcaaatcacagacttcggattcaagttttcctataggataatctcctgtggtggtgtgttcaatttctcttctggaatcatcacaagtcctgcctattcatacgcagactacccaaatgatatgcactgtctgtataccatcaccgttagtgacgacaaggtgatcgagctcaagttcagtgattttgatgtggttccctccacctcctgctcccatgactacctggcaatttacgatggtgccaataccagcgatccccttcttggcaaattctgcggttccaagcgcccaccaaatgtgaagagcagcaataatagtatgctcctggtgttcaagacagattcatttcagacagcaaaaggctggaagatgtctttccggcagacattggggcctcagcaaggatgtggtggttatctgacaggctcgaataatacctttgcctctcctgattctgattcgaatggaatgtatgacaagaatttaaactgtgtatggatcataattgcacctgtaaacaaagtaattcacctcaccttcaatacatttgctctggaggcagcaagtactaggcaaagatgcctttatgattatgtaaagttatatgatggggatagtgaaaatgcgaacttggctggaacgttttgtggttccacagtacctgctccttttatctcttctggtaacttccttacggttcaattcatcagtgacttaacattagagagggaaggatttaatgctacatacaccatcatggacatgccttgtggtggaacgtacaatgcaacttggaccccacaaaatatttcatcacccaattcatcagacccagatgtcccattttccatctgtacttgggtcattgattcccctccgcatcagcaggtcaagataactgtgtgggcattacagctgacctcgcaagactgcacgcagaattacttacagcttcaggactcaccgcagggtcacggaaattcaagatttcagttctgtggcagaaatgcttcggctgtgccagtgttttattcttctatgagtactgcaatggtcattttcaaatctggagttgtaaacagaaactctagaatgagtttcacctatcagattgcagattgcaacagagactatcacaaggcatttggcaacctgagaagccctggatggccagataactacgacaatgacaaggattgcaccgttactctcacagccccccagaaccacaccatttccctcttttttcattcacttggcatcgagaactcagttgaatgcagaaacgatttcttggaggtgagaaatggaagtaacagcaattcaccattactgggcaagtactgtggaactctgctgccaaaccctgtcttctctcaaaataatgaactatacctacgatttaagagtgatagtgtaacttctgatcgtggatatgaaatcatctggacttcatcaccctctggatgtggtggaactctttatggagacagaggctcattcaccagccccggctatccaggcacatacccaaacaacacgtactgcgagtgggtccttgttgctcctgctggaaggcttgtcaccatcaacttctacttcatcagcattgacgatccaggagactgtgtccagaactatctcacactctatgatgggcccaacgccagctctccatcctctggaccatactgcggaggcgacaccagcatagctcccttcgtggcttcctcaaatcaggtcttcataaaatttcatgctgattatgcacggcgtccatccgcattccgattaacttgggacagctaagtgggtaacaactcgtgttcactcagcactttccctctgcagcacgctggacagcactctgccatcctgatacatgacccctgctgatgccacagagaataagctgaacttgtatggtttttcaccaaaccatggatagaatcaatatttgtaggccaggcgtggtggctcacccccctgtattctcagcactttgggaggccgaggcaggttgatcacctgaggtcaggagtttgagactagcctggccagcatggtgaaacctcatccctctaacaatataataattagccaggcgtggtggtgggtgcctgtaattccagccactcgagaggctgaggcaggagaattgcttgaacccaggaggcagaggttgcagtgagctaagatcacaccactacactccagcctgggcgagacggcaagactccatctcaaaaaaaaaa

SEQ ID NO: 60419 - DNA, 1953 bp, Homo sapiens
ggagagagagaggacagagagcaagtcactcccggctgcctttttcacctctgacagagcccagacaccatgaacgcaagtgaattccgaaggagagggaaggagatggtggattacgtggccaactacatggaaggcattgagggacgccaggtctaccctgacgtggagcccgggtacctgcggccgctgatccctgccgctgcccctcaggagccagacacgtttgaggacatcatcaacgacgttgagaagataatcatgcctggggtgacgcactggcacagcccctacttcttcgcctacttccccactgccagctcgtacccggccatgcttgcggacatgctgtgcggggccattggctgcatcggcttctcctgggcggcaagcccagcatgcacagagctggagactgtgatgatggactggctcgggaagatgctggaactaccaaaggcatttttgaatgagaaagctggagaagggggaggagtgatccagggaagtgccagtgaagccaccctggtggccctgctggccgctcggaccaaagtgatccatcggctgcaggcagcgtccccagagctcacacaggccgctatcatggagaagctggtggcttactcatccgatcaggcacactcctcagtggaaagagctgggttaattggtggagtgaaattaaaagccatcccctcagatggcaacttcgccatgcgtgcgtctgccctgcaggaagccctggagagagacaaagcggctggcctgattcctttctttatggttgccaccctggggaccacaacatgctgctcctttgacaatctcttagaagtcggtcctatctgcaacaaggaagacatatggctgcacgttgatgcagcctacgcaggcagtgcattcatctgccctgagttccggcaccttctgaatggagtggagtttgcagattcattcaactttaatccccacaaatggctattggtgaattttgactgttctgccatgtgggtgaaaaagagaacagacttaacgggagcctttagactggaccccacttacctgaagcacagccatcaggattcagggcttatcactgactaccggcattggcagataccactgggcagaagatttcgctctttgaaaatgtggtttgtatttaggatgtatggagtcaaaggactgcaggcttatatccgcaagcatgtccagctgtcccatgagtttgagtcactggtgcgccaggatccccgctttgaaatctgtgtggaagtcattctggggcttgtctgctttcggctaaagggttccaacaaagtgaatgaagctcttctgcaaagaataaacagtgccaaaaaaatccacttggttccatgtcacctcagggacaagtttgtcctgcgctttgccatctgttctcgcacggtggaatctgcccatgtgcagcgggcctgggaacacatcaaagagctggcggccgacgtgctgcgagcagagagggagtaggagtgaagccagctgcaggaatcaaaaattgaagagagatatatctgaaaactggaataagaagcaaataaatatcatcctgccttcatggaactcagctgtctgtggcttcccatgtctttctccaaagttatccagagggttgtgattttgtctgcttagtatctcatcaacaaagaaatattatttgctaattaaaaagttaatcttcatggccatagcttttattcattagctgtgatttttgttgattaaaacattatagattttcatgttcttgcagtcatcagaagtggtaggaaagcctcactgatatattttccagggcaatcaatgttcacgcaacttgaaattatatctgtggtcttcaaattgtcttttgtcatgtggctaaatgcctaataaacaattcaagtgaaatactaaaaaaaaaaaaaaaaa

SEQ ID NO: 60420 - DNA, 3108 bp, Homo sapiens
acgtgcagggctgtccttggagggccagcacagccccttccaagtgggcaagacccaggggtggctcaaaagatagctgtgccctagccctggaacctctgaatgttgatttttgtagcaaaaaaggacttgcagatgtgagtaaaggctgttgagataaggacatcctccctgctctctgggaggaccccaaatgcaggtgcacagatcttaagaagaagaggcagagactggggtgatgcagccacaactaaggaaagccaaggattgctggcagcctgcagaaactggagggcaaggagcatcccccaaccgcccggagcctccaggaggcgcaaggtcctactgactccctgacttcagacgtccagtctccggaattttgagaggatccatttctgttattttaagcaaccaaacttgtggtagtttcaccagtctcaggaaatgaatacgaatggaaagtcaaagattccaagaaatgagtggcggggtgcggtggctcacacttgtaatcccagcatttgcgggaagattgcttgggctcaggacttggagaccttgtgtctgtgagaaacttaaaaaataggctgggtgcgatggctcacgcctgtaatcccagcactttgggaggccgaggcaggcggatcacaaggtcacgagtttgagaccagtgtgaccaacatggtgaaaccctgtctctactaaaaatacaaaaattagccgggtgtggtggtgcgtgcctgtaatcccagctactcgggaggctgaggcagaagaattgcttgaacccaggaagcagaggttgcagtgagccgagatagtattactgcactccaggctgggcagcagagcaagattccgcctcaaaaaaaaaaaaaaaaaaaaaaaaaaaaaaaaaaactgagcatggtagcatgcacctgtggtcctggctacgccggaggattgcctgaagccaggagttcaagaccagtctggacaaaagagcaagaccccatctctaccaaaaaaatttaaaaattagccaggcatggtgccgtacccatagtcttagctactcaggaggctgaggagggaggattatctgagccctggcggttgaggctataatgagccatgattgtgccactgcactccagccttggcaacacagtgtgagaccctgtctcaaaaacaataaaaacccaaaacaaaagaaccaagaaattactggacctgaggcctggcctttagctgctgccctgcccttgtgacctggtcactcgggatcccctgggcctaaacacacagcctattgtctacctcaagaaggctccccactgcttggctggcaattggggtgggctttgcaggccccacctgtcctggccccacggcgctggtgctgcaggcccccaccactgcttgttccgagctccccagcctcctgcagagttgcctgcacctgatggcgatgaatcaggaaggcaggcgtgtcctgggccacagagcagtcatggctgtcagccaccagggggctccatttgcaactttggatgtggctttggcctctttgtccaaagtgaccttggggcccccagacaagagacagggagactggagcccagccccaccctcccgcacatacctggcccatccctgccctatcctggaagatgggggccaccacacgtgcaagggacacgggataggaacctttggccttgttatcagacattttaaaactaagtgcaaacgtgattatcaggtgcagtttttacagcagcaagaaacctgtgcttacagaaagaaacacgtgctagcaacccacctatgcggaaagccacacagagccattgttttctgcactctcaggtgacggctcacatttgccccagggaaggtcacagctgcctgaacttttaaaactcccagacacgcactgcctgtgcaggatccggagcccagcagcactgccagggccttgaagtgcttcttcagagacctttcttcatagactacttttttttctttaagcagcaaaaggagaaaattgtcatcaaaggatattccagattcttgacagcattctcgtcatctctgaggacatcaccatcatctcaggatgaggggcatgaagctgctgggggcgctgctggcactggcggccctactgcagggggccgtgtccctgaagatcgcagccttcaacatccagacatttggggagaccaagatgtccaatgccaccctcgtcagctacattgtgcagatcctgagccgctatgacatcgccctggtccaggaggtcagagacagccacctgactgccgtggggaagctgctggacaacctcaatcaggatgcaccagacacctatcactacgtggtcagtgagccactgggacggaacagctataaggagcgctacctgttcgtgtacaggcctgaccaggtgtctgcggtggacagctactactacgatgatggctgcgagccctgcgggaacgacaccttcaaccgagagccagccattgtcaggttcttctcccggttcacagaggtcagggagtttgccattgttcccctgcatgcggccccgggggacgcagtagccgagatcgacgctctctatgacgtctacctggatgtccaagagaaatggggcttggaggacgtcatgttgatgggcgacttcaatgcgggctgcagctatgtgagaccctcccagtggtcatccatccgcctgtggacaagccccaccttccagtggctgatccccgacagcgctgacaccacagctacacccacgcactgtgcctatgacaggatcgtggttgcagggatgctgctccgaggcgccgttgttcccgactcggctcttccctttaacttccaggctgcctatggcctgagtgaccaactggcccaagccatcagtgaccactatccagtggaggtgatgctgaagtgagcagcccctccccacaccagttgaactgcaggaagagaggacccatcctgccacaggacccagaaaaaaagcccaacacacactcgggttaagaaatacctttaaatttaggtaaataaagctcaaggaggtggggctgtcaaaaaaaaaaa

SEQ ID NO: 60421 - DNA, 1738 bp, Homo sapiens
cgggggggtactgtgcgagccctcaaggaggtggctgttctgtagctggagagctccgtgggtggcaggactgaacttgaacaccagaaacaacccccaagccttgtgacctgggaggcaggaggcgggtctgtctccctgggacttgggtggctgagccgaggtactcgggaccctgtcccgcgcatggcagagtggctcctcacagcctgaagctcatccttctgcacgggccagccaggccagcacagaggcaccagggcagcagtgcacacaggtccccggggaccccaccatgtggagcggatggtggctgtggccccttgtggccgtctgcactgcagacttctttcgggacgaggcagagaggatcatgagggactcccctgtcattgatgggcacaatgacctcccctggcagctgctggatatgttcaacaaccggctgcaggacgagagggccaacctgaccaccttggccggcacacacaccaacatccccaagctgagggccggctttgtgggaggccagttctggtccgtgtacacgccctgcgacacccagaacaaagacgccgtgcggaggacgctggagcagatggacgtggtccaccgcatgtgccggatgtacccggagaccttcctgtatgtcaccagcagtgcaggcattcggcaggccttccgggaagggaaggtggccagcctgatcggcgtggagggcggccactccattgacagcagtttgggcgtcctgcgggcactctatcagctgggcatgcggtacctgaccctcacccacagctgcaacacgccctgggctgacaactggctggtggacacgggagacagcgagccccagagccaaggcttgtcaccctttgggcagcgtgtggtgaaggagctgaaccgtctgggggtcctcatcgacttggctcacgtgtctgtggccaccatgaaggccaccctgcagctgtccagagccccggtcatcttcagccactcctcggcctacagcgtgtgcgcaagccggcgcaacgtgcctgacgacgtcctgaggctggtgaaacagacagacagcctggtgatggtgaacttctacaacaattacatttcctgcaccaacaaggccaacctgtcccaagtggccgaccatctggatcacatcaaggaggtggcaggagccagagccgtgggttttggtggggactttgatggtgttccaagggtccctgaggggctggaggacgtctccaagtatccagacctgatcgctgagctgctcaggaggaactggacggaggcggaggtcaagggcgcactggctgacaacctgctgagggtcttcgaggctgtggaacaggccagcaacctcacacaggctcccgaggaggagcccatcccgctggaccagctgggtggctcctgcaggacccattacggctactcctctggggcttccagcctccatcgccactgggggctcctgctggcctccctcgctcccctggtcctctgtctgtctctcctgtgaaacctgggagaccagagtcccctttagggttcccggagctccgggaagacccgcccatcccaggactccagatgccaggagccctgctgcccacatgcaaggaccagcatctcctgagaggacgcctgggcttacctggggggcaggatgcctggggacagttcaggacacacacacagtaggcccgcaataaaagcaacacccctt

SEQ ID NO: 60422 - DNA, 3913 bp, Homo sapiens
ctttcactggcaagagacggagtcctgggtttcagttccagttgcctgcggtgggctgtgtgagtttgccaaagtcccctgccctctctgggtctcggttccctcgcctgtccacgtgaggttggaggagctgaacgccgacgtcatttttagctaagagggagcagggtccccgagtcgccggcccagggtctgcgcatccgaggccgcgcgccctttcccctcccccacggctcctccgggccccgcactctgcgccccggctgccgcccagcgccctacaccgccctcagggggccctcgcgggctccccccggccgggatgccagtgccccgcgccacgcgcgcctgctcccgcgccgcctgccctgcagcctgcccgcggcgcctttatacccagcgggctcggcgctcactaatgtttaactcggggccgaaacttgccagcggcgagtgactccaccgcccggagcagcggtgcaggacgcgcgtctccgccgcccgcggtgacttctgcctgcgctccttctctgaacgctcacttccgaggagacgccgacgatgaagacaccgtggaaggttcttctgggactgctgggtgctgctgcgcttgtcaccatcatcaccgtgcccgtggttctgctgaacaaaggcacagatgatgctacagctgacagtcgcaaaacttacactctaactgattacttaaaaaatacttatagactgaagttatactccttaagatggatttcagatcatgaatatctctacaaacaagaaaataatatcttggtattcaatgctgaatatggaaacagctcagttttcttggagaacagtacatttgatgagtttggacattctatcaatgattattcaatatctcctgatgggcagtttattctcttagaatacaactacgtgaagcaatggaggcattcctacacagcttcatatgacatttatgatttaaataaaaggcagctgattacagaagagaggattccaaacaacacacagtgggtcacatggtcaccagtgggtcataaattggcatatgtttggaacaatgacatttatgttaaaattgaaccaaatttaccaagttacagaatcacatggacggggaaagaagatataatatataatggaataactgactgggtttatgaagaggaagtcttcagtgcctactctgctctgtggtggtctccaaacggcacttttttagcatatgcccaatttaacgacacagaagtcccacttattgaatactccttctactctgatgagtcactgcagtacccaaagactgtacgggttccatatccaaaggcaggagctgtgaatccaactgtaaagttctttgttgtaaatacagactctctcagctcagtcaccaatgcaacttccatacaaatcactgctcctgcttctatgttgataggggatcactacttgtgtgatgtgacatgggcaacacaagaaagaatttctttgcagtggctcaggaggattcagaactattcggtcatggatatttgtgactatgatgaatccagtggaagatggaactgcttagtggcacggcaacacattgaaatgagtactactggctgggttggaagatttaggccttcagaacctcattttacccttgatggtaatagcttctacaagatcatcagcaatgaagaaggttacagacacatttgctatttccaaatagataaaaaagactgcacatttattacaaaaggcacctgggaagtcatcgggatagaagctctaaccagtgattatctatactacattagtaatgaatataaaggaatgccaggaggaaggaatctttataaaatccaacttagtgactatacaaaagtgacatgcctcagttgtgagctgaatccggaaaggtgtcagtactattctgtgtcattcagtaaagaggcgaagtattatcagctgagatgttccggtcctggtctgcccctctatactctacacagcagcgtgaatgataaagggctgagagtcctggaagacaattcagctttggataaaatgctgcagaatgtccagatgccctccaaaaaactggacttcattattttgaatgaaacaaaattttggtatcagatgatcttgcctcctcattttgataaatccaagaaatatcctctactattagatgtgtatgcaggcccatgtagtcaaaaagcagacactgtcttcagactgaactgggccacttaccttgcaagcacagaaaacattatagtagctagctttgatggcagaggaagtggttaccaaggagataagatcatgcatgcaatcaacagaagactgggaacatttgaagttgaagatcaaattgaagcagccagacaattttcaaaaatgggatttgtggacaacaaacgaattgcaatttggggctggtcatatggagggtacgtaacctcaatggtcctgggatcgggaagtggcgtgttcaagtgtggaatagccgtggcgcctgtatcccggtgggagtactatgactcagtgtacacagaacgttacatgggtctcccaactccagaagacaaccttgaccattacagaaattcaacagtcatgagcagagctgaaaattttaaacaagttgagtacctccttattcatggaacagcagatgataacgttcactttcagcagtcagctcagatctccaaagccctggtcgatgttggagtggatttccaggcaatgtggtatactgatgaagaccatggaatagctagcagcacagcacaccaacatatatatacccacatgagccacttcataaaacaatgtttctctttaccttagcacctcaaaataccatgccatttaaagcttattaaaactcatttttgttttcattatctcaaaactgcactgtcaagatgatgatgatctttaaaatacacactcaaatcaagaaacttaaggttacctttgttcccaaatttcatacctatcatcttaagtagggacttctgtcttcacaacagattattaccttacagaagtttgaattatccggtcgggttttattgtttaaaatcatttctgcatcagctgctgaaacaacaaataggaattgtttttatggaggctttgcatagattccctgagcaggattttaatctttttctaactggactggttcaaatgttgttctcttctttaaagggatggcaagatgtgggcagtgatgtcactagggcagggacaggataagagggattagggagagaagatagcagggcatggctgggaacccaagtccaagcataccaacacgagcaggctactgtcagctcccctcggagaagagctgttcacagccagactggcacagttttctgagaaagactattcaaacagtctcaggaaatcaaatatgcaaagcactgacttctaagtaaaaccacagcagttgaaaagactccaaagaaatgtaagggaaactgccagcaacgcaggcccccaggtgccagttatggctataggtgctacaaaaacacagcaagggtgatgggaaagcattgtaaatgtgcttttaaaaaaaaatactgatgttcctagtgaaagaggcagcttgaaactgagatgtgaacacatcagcttgccctgttaaaagatgaaaatatttgtatcacaaatcttaacttgaaggagtccttgcatcaatttttcttatttcatttctttgagtgtcttaattaaaagaatattttaacttccttggactcattttaaaaaatggaacataaaatacaatgttatgtattattattcccattctacatactatggaatttctcccagtcatttaataaatgtgccttcattttttcagaaaaaaaaaaaaaaa

SEQ ID NO: 60423 - DNA, 3829 bp, Homo sapiens
tcccactcggctcctcttacggagtcctcattccaccccccttgtttccgcattcatcctgagtggctggtgggaacgtgaaaagggagaggaaaaggcgcaagaagccagagagaggggtgtgggaaaagcgaaaacaggctgccaaatcaggggattccttccaatttaaaaaggaagtctgctgacgttagttagttaaatttaacatctttttatgtgtaacacttgactttggaagcaaaaatgaactttgcggagagagagggctctaagagatactgcattcaaacgaaacatgtggccattctctgtgcggtggtggtgggtgtaggattaatagtgggacttgccgtgggcttgaccagatcgtgtgactccagcggggacggcgggccgggcactgcgccagctccttcccacctgccttcttccacggccagcccctcaggtcctcctgcccaggaccaggacatctgcccggccagtgaggatgagagcggacagtggaaaaactttcgactgccggacttcgtcaacccagtccactacgacctgcacgtgaagcccctgttggaggaggacacctacacgggcaccgtgagcatctccatcaacctgagcgctcccacccggtacctgtggctgcacctccgggagaccaggatcacccggctcccggagctgaagaggccctctggggaccaggtgcaagtccggaggtgtttcgagtacaaaaagcaggagtacgtggtggtcgaggcggaggaagagcttacccccagcagtggagatggcctgtatctcctgaccatggagttcgccggctggctgaacggctccctcgtgggattttatagaaccacctacacggagaacggacgagtcaagagcatagtggccaccgatcatgaaccaacagatgccaggaaatcttttccttgttttgatgagcccaacaaaaaggcaacttatacaatatctatcacccatcccaaagaatacggagcactttcaaatatgccagtggcgaaagaagagtcagtggatgataaatggactcgaacaacttttgagaagtctgtccccatgagcacgtacctggtgtgctttgctgtacatcaatttgactctgtaaagagaatatcaaatagtggaaaacctcttacaatttatgtccagccagagcaaaagcacacagccgaatatgctgcaaacataactaaaagtgtgtttgattattttgaagaatactttgctatgaattattctcttcctaaattagataaaatcgctattccagattttggcactggtgccatggagaactggggactcatcacgtacagagaaacgaacctgctttatgaccctaaggaatcagcctcatcaaaccaacagagggtggccactgtggttgcccatgaacttgtgcatcagtggtttggaaatattgtgaccatggactggtgggaagacttgtggctaaatgaaggatttgcttctttctttgagtttctgggagtaaaccatgcagaaacagactggcaaatgcgtgaccaaatgttacttgaagatgtattacctgttcaagaggatgattctttgatgtcttcgcatccaattattgtgactgtgacaacccctgatgaaataacatctgtttttgatggaatatcctatagcaagggatcttctattttgagaatgcttgaagactggataaaaccagagaattttcaaaaaggatgtcagatgtacttggaaaaataccaattcaagaatgcaaaaacttctgatttttgggcagcactggaagaggcaagtaggctaccagtgaaagaagtaatggacacctggaccagacagatgggttatcctgtgcttaacgtgaacggtgtcaagaacatcacacagaaacgctttttgttggacccaagagctaacccttctcagcccccttcagatcttggttatacatggaatatcccagttaaatggactgaagataatataacaagcagtgtgttatttaataggtcagaaaaagaaggaatcactttgaactcctctaatcctagtggaaatgcttttctcaaaataaacccagatcatattgggttttatcgtgtaaattatgaagtagcaacttgggactcgatagctacagcgctctccttgaaccacaagacattttcttcagcagatcgtgcaagtcttattgatgatgcttttgccttggcaagagctcaacttctagattataaggtggctttgaacttgaccaagtatctcaaaagggaagagaattttttaccatggcagagagtaatttcagctgtaacctacatcattagcatgtttgaagatgataaagagctatatcctatgattgaggaatacttccaaggtcaagtgaagcctattgcagattctctgggatggaatgatgctggagaccatgtcacaaagttactccgttcctccgtgttagggtttgcgtgcaagatgggagacagagaagccttgaacaatgcttcctcgttatttgagcagtggctaaatgggactgtaagccttcccgtaaatctcaggcttctggtgtatcggtatgggatgcagaactctggcaatgagatttcatggaactacactcttgagcaataccagaaaacttcattagctcaagaaaaagaaaaactgctgtatggattagcatcagtgaagaacgttactcttttgtcaaggtatttggatttgctcaaggacacgaaccttattaaaactcaggatgtgtttacagtcattcgatatatctcatataacagctatgggaagaacatggcctggaattggatacaactcaactgggactatctagtcaacagatatacactcaataacagaaaccttggccgaattgtcacaatagcagagccattcaacactgaactgcaactgtggcagatggagagcttttttgcaaaatatccacaagctggagcaggagaaaaacctagggaacaagtgctggaaacagtgaaaaacaatatagagtggctaaaacaacatagaaacaccatcagagaatggttttttaatttacttgagagtggttaatgtattcaaatgttagagtttaattttgtgaatctattgtttctcctctgaagcatttggtggcctaatttacaagcacgatggagagagccttataaacagataatgcttttactaagcactgtgtttatatgtcttgcaaagcctttaaattgttcctctttgtttatgaagaaagatactaatagagtacttaatatactcagggattccttctaagtgtacttcataagatattctttacaaactgaagataatgaaatagttattttaatacctttaaatatcattctttgtatcttaaatctgtgaagtagaacaatttggtcttagctttacattttcagtaccaaagaaacaccacttaatcttctctcttgattgatttttaaagtttaaataccagtacttgagggaccaatattaccatcttaatctttattttattattcagaattatacagacctaatatcattttattcacatatgtcttactactttaaatcctaccaaagtaacctgggcttaagttttacttgaggatcatatgaattagccaaaagaatggctgactgttgcctttactcttataaaatcaataagagaactctcctctttttttaaaaataaatctaaatgattatcttgaaaaagtattgttttccagtgtcacttgactcttgaataaaaataactgcagtgttcccc

SEQ ID NO: 60424 - DNA, 1877 bp, Homo sapiens
gtccatctggaaggcccagcatgagaggcctggccgtcctcctcactgtggctctggccacgctcctggctcccggggccggagcaccggtacaaagtcagggctcccagaacaagctgctcctggtgtccttcgacggcttccgctggaactacgaccaggatgtggacacccccaacctggacgccatggcccgagacggggtgaaggcacgctacatgacccccgcctttgtcaccatgaccagcccctgccacttcaccctggtcaccggcaaatatatcgagaaccacggggtggttcacaacatgtactacaacaccaccagcaaggtgaagctgccctaccacgccacgctgggcatccagaggtggtgggacaacggcagcgtgcccatctggatcacagcccagaggcagggcctgagggctggctccttcttctacccgggcgggaacgtcacctaccaaggggtggctgtgacgcggagccggaaagaaggcatcgcacacaactacaaaaatgagacggagtggagagcgaacatcgacacagtgatggcgtggttcacagaggaggacctggatctggtcacactctacttcggggagccggactccacgggccacaggtacggccccgagtccccggagaggagggagatggtgcggcaggtggaccggaccgtgggctacctccgggagagcatcgcgcgcaaccacctcacagaccgcctcaacctgatcatcacatccgaccacggcatgacgaccgtggacaaacgggctggcgacctggttgaattccacaagttccccaacttcaccttccgggacatcgagtttgagctcctggactacggaccaaacgggatgctgctccctaaagaagggaggctggagaaggtgtacgatgccctcaaggacgcccaccccaagctccacgtctacaagaaggaggcgttccccgaggccttccactacgccaacaaccccagggtcacacccctgctgatgtacagcgaccttggctacgtcatccatgggagaattaacgtccagttcaacaatggggagcacggctttgacaacaaggacatggacatgaagaccatcttccgcgctgtgggccctagcttcagggcgggcctggaggtggagccctttgagagcgtccacgtgtacgagctcatgtgccggctgctgggcatcgtgcccgaggccaacgatgggcacctagctactctgctgcccatgctgcacacagaatctgctcttccgcctgatggaaggcctactctcctgcccaagggaagatctgctctcccgcccagcagcaggcccctcctcgtgatgggactgctggggaccgtgattcttctgtctgaggtcgcataacgccccatggctcaaggaagccgccgggagctgcccgcaggccctgggccggctgtctcgctgcgatgctctgctggtcgcggacggaccctgcctccccagcttatcccaggccagaggctgcatgccactgtccccggcagcgccaacccctgcttggctgttatggtgctggtaataagcctcgcagcccaggtccagagcccccggcgagccggtcccataaccggccccctgcccctgcccctgctcctgctcctccccttcgggccccctcctcctgcaaaacccgctcccgaagcggcgctgccgtctgcagccacgcgggggcgcgcgggagctctgcgggcgctggaacctgcagacccggcctcggtcagctgggaggggcccgccccggcacaaagcacccatgggaataaaggccaagccgcgacagtcagcaaaaaaaaaaaaaaaaaaaaaaaaaaaaaaaaaaaa

SEQ ID NO: 60425 - DNA, 2126 bp, Homo sapiens
ccaggtgcacagcgcatcgcccgaggctgtcaccgccctgccccgcccaccccagctgtcctggacccaggggcagggagaggctggacgccaggtgcgcggacacagaagcgtctaagcacagcttcctccttgccgctccgggaagtgggcagccagcccaggaaccagtaccacctgcaccatggggctgtcccggaaggagcaggtcttcttggccctgctgggggcctcgggggtctcaggcctcacggcactcattctcctcctggtggaggccaccagcgtgctcctgcccacagacatcaagtttgggatcgtgtttgatgcgggctcctcccacacgtccctcttcctgtatcagtggccggcgaacaaggagaatggcacgggtgtggtcagccaggccctggcctgccaggtggaagggcctggaatctcctcctacacttctaatgctgcacaggctggtgagagcctgcagggctgcttggaggaggcgctggtgctgatcccagaggcccagcatcggaaaacacccacgttcctgggggccacggctggcatgaggttgctcagccggaagaacagctctcaggccagggacatctttgcagcagtcacccaggtcctgggccggtctcccgtggacttttggggtgccgagctcctggccgggcaggccgaaggtgcctttggttggatcactgtcaactacggcttggggacgctggtcaagtactccttcactggagaatggatccagcctccggaggagatgctggtgggtgccctggacatgggaggggcctccacccagatcacgttcgtgcctgggggccccatcttggacaagagcacccaggccgattttcgcctctacggctccgactacagcgtctacactcacagctacctgtgctttggacgggaccagatgctgagcaggctcctcgtggggctggtgcagagccgcccggctgccctgctccgtcacccgtgctacctcagcggctaccagaccacactggccctgggcccgctgtatgagtcaccctgtgtccacgccacgcccccgctgagcctcccccagaacctcacagttgaagggacaggcaaccctggagcctgcgtctcagccatccgggaacttttcaacttctccagctgccagggccaggaggactgcgcctttgacggggtctaccagcccccgctgcggggccagttctatgtggaggccagctaccctgggcaggaccgctggctgcgggactactgtgcctcaggcctgtacatcctcaccctcctgcacgagggctacgggttcagcgaggagacctggcccagcctcgagttccgaaagcaggcgggcggtgtggacattggctggacactgggctacatgctgaacctgaccgggatgatcccggccgatgcgccggctcagtggcgggcagagagctacggcgtctgggtggccaaagtggtgttcatggtgctggccctggtggcggtggtgggggctgccttggtccagctcttctggttgcaggactagtgggaaggcggaggtgggcccccacagagcccacaggcagctgcgtcccggatgctggaggcttcctgagccctgagcgccgtggggccttgctctgtggctctgcccacggtcaggtgacagccacctccagggcaccgtcagggtggtgctggccacagaggctgcatgacctcccctcccggcgtccctcccccaacctccttccgcaactgggcttccagggccgtaggtgcctttctgcacacaggccgccaggactcgtggtgtctccaggctgtgtgactgcagggccacatgctgcctgcaaacagggcaagaccacggaggcacaggggtcctgctcctgatggggcctcaggaggggcggagaggggtggaagggagggagctgccccacctggacccccgctctccctgctgttgtctgagcagatggatggagtccaggcctgggggcttctgctgggccagcccggcctcccacacccacttggagggtgagactgcagtgggggttgtttttattaaaagcatcatggacacagcaaaaaaaaaaaaaaaa

SEQ ID NO: 60426 - DNA, 2166 bp, Homo sapiens
gcaggctctgcctgtggccactagcagagaagctgctgtccttccaccaccagcaccggaccacctgctccaagaccagcctcctggggggaccaggcacccggccttcactggcacccagggagccgtcctcagcagcgtcaacatgtcaaggcccagcagcagagccatttacttgcaccggaaggagtactcccagaacctcacctcagagcccaccctcctgcagcacagggtggagcacttgatgacatgcaagcaggggagtcagagagtccaggggcccgaggatgccttgcagaagctgttcgagatggatgcacagggccgggtgtggagccaagacttgatcctgcaggtcagggacggctggctgcagctgctggacattgagaccaaggaggagctggactcttaccgcctagacagcatccaggccatgaatgtggcgctcaacacatgttcctacaactccatcctgtccatcaccgtgcaggagccgggcctgccaggcactagcactctgctcttccagtgccaggaagtgggggcagagcgactgaagaccagcctgcagaaggctctggaggaagagctggagcaaagacctcgacttggaggccttcagccaggccaggacagatggagggggcctgctatggaaaggccgctccctatggagcaggcacgctatctggagccggggatccctccagaacagccccaccagaggaccctagagcacagcctcccaccatccccaaggcccctgccacgccacaccagtgcccgagaaccaagtgcctttactctgcctcctccaaggcggtcctcttcccccgaggacccagagagggacgaggaagtgctgaaccatgtcctaagggacattgagctgttcatgggaaagctggagaaggcccaggcaaagaccagcaggaagaagaaatttgggaaaaaaaacaaggaccagggaggtctcacccaggcacagtacattgactgcttccagaagatcaagcacagcttcaacctcctgggaaggctggccacctggctgaaggagacaagtgcccctgagctcgtacacatcctcttcaagtccctgaacttcatcctggccaggtgccctgaggctggcctagcagcccaagtgatctcacccctcctcacccctaaagctatcaacctgctacagtcctgtctaagcccacctgagagtaacctttggatggggttgggcccagcctggaccactagccgggccgactggacaggcgatgagcccctgccctaccaacccacattctcagatgactggcaacttccagagccctccagccaagcacccttaggataccaggaccctgtttcccttcggccctccagccccaaacctgcccagccagccctgaaaatgcaagtcttgtacgagtttgaagctaggaacccacgggaactgactgtggtccagggagagaagctggaggttctggaccacagcaagcggtggtggctggtgaagaatgaggcgggacggagcggctacattccaagcaacatcctggagcccctacagccggggacccctgggacccagggccagtcaccctctcgggttccaatgcttcgacttagctcgaggcctgaagaggtcacagactggctgcaggcagagaacttctccactgccacggtgaggacacttgggtccctgacggggagccagctacttcgcataagacctggggagctacagatgctatgtccacaggaggccccacgaatcctgtcccggctggaggctgtcagaaggatgctggggataagcccttaggcaccagcttagacacctccaagaaccaggccccgctgatgcaagatggcagatctgatacccattagagccccgagaattcctcttctggatcccagtttgcagcaaaccccacaccccagctcacacagcaaaaacaatggacaggcccagaggctgaagcaaacagtgtcccttctggctgtgttggagcctccccagtaaccacctatttattttacctctttcccaaacctggagcatttatgcctaggcttgtcaagaatctgttcagtccctctccttctcaataaaagcatcttcaagcttgtaaaaaaaaaaaaaaaaaa

SEQ ID NO: 60427 - DNA, 2256 bp, Homo sapiens
gcaggctctgcctgtggccactagcagagaagctgctgtccttccaccaccagcaccggaccacctgctccaagaccagcctcctggggggaccaggcacccggccttcactggcacccagggagccgtcctcagcagcgtcaacatgtcaaggcccagcagcagagccatttacttgcaccggaaggagtactcccagaacctcacctcagagcccaccctcctgcagcacagggtggagcacttgatgacatgcaagcaggggagtcagagagtccaggggcccgaggatgccttgcagaagctgttcgagatggatgcacagggccgggtgtggagccaagacttgatcctgcaggtcagggacggctggctgcagctgctggacattgagaccaaggaggagctggactcttaccgcctagacagcatccaggccatgaatgtggcgctcaacacatgttcctacaactccatcctgtccatcaccgtgcaggagccgggcctgccaggcactagcactctgctcttccagtgccaggaagtgggggcagagcgactgaagaccagcctgcagaaggctctggaggaagagctggagcaaagacctcgacttggaggccttcagccaggccaggacagatggagggggcctgctatggaaaggccgctccctatggagcaggcacgctatctggagccggggatccctccagaacagccccaccagaggaccctagagcacagcctcccaccatccccaaggcccctgccacgccacaccagtgcccgagaaccaagtgcctttactctgcctcctccaaggcggtcctcttcccccgaggacccagagagggacgaggaagtgctgaaccatgtcctaagggacattgagctgttcatgggaaagctggagaaggcccaggcaaagaccagcaggaagaagaaatttgggaaaaaaaacaaggaccagggaggtctcacccaggcacagtacattgactgcttccagaagatcaagcacagcttcaacctcctgggaaggctggccacctggctgaaggagacaagtgcccctgagctcgtacacatcctcttcaagtccctgaacttcatcctggccaggtgccctgaggctggcctagcagcccaagtgatctcacccctcctcacccctaaagctatcaacctgctacagtcctgtctaagcccacctgagagtaacctttggatggggttgggcccagcctggaccactagccgggccgactggacaggcgatgagcccctgccctaccaacccacattctcagatgactggcaacttccagagccctccagccaagcacccttaggataccaggaccctgtttcccttcggcggggaagtcataggttagggagcacctcacactttcctcaggagaagacacacaaccatgaccctcagcctggggaccccaactccaggccctccagccccaaacctgcccagccagccctgaaaatgcaagtcttgtacgagtttgaagctaggaacccacgggaactgactgtggtccagggagagaagctggaggttctggaccacagcaagcggtggtggctggtgaagaatgaggcgggacggagcggctacattccaagcaacatcctggagcccctacagccggggacccctgggacccagggccagtcaccctctcgggttccaatgcttcgacttagctcgaggcctgaagaggtcacagactggctgcaggcagagaacttctccactgccacggtgaggacacttgggtccctgacggggagccagctacttcgcataagacctggggagctacagatgctatgtccacaggaggccccacgaatcctgtcccggctggaggctgtcagaaggatgctggggataagcccttaggcaccagcttagacacctccaagaaccaggccccgctgatgcaagatggcagatctgatacccattagagccccgagaattcctcttctggatcccagtttgcagcaaaccccacaccccagctcacacagcaaaaacaatggacaggcccagaggctgaagcaaacagtgtcccttctggctgtgttggagcctccccagtaaccacctatttattttacctctttcccaaacctggagcatttatgcctaggcttgtcaagaatctgttcagtccctctccttctcaataaaagcatcttcaagcttgtaaaaaaaaaaaaaaaaaa

SEQ ID NO: 60428 - DNA, 2259 bp, Homo sapiens
gcaggctctgcctgtggccactagcagagaagctgctgtccttccaccaccagcaccggaccacctgctccaagaccagcctcctggggggaccaggcacccggccttcactggcacccagggagccgtcctcagcagcgtcaacatgtcaaggcccagcagcagagccatttacttgcaccggaaggagtactcccagaacctcacctcagagcccaccctcctgcagcacagggtggagcacttgatgacatgcaagcaggggagtcagagagtccaggggcccgaggatgccttgcagaagctgttcgagatggatgcacagggccgggtgtggagccaagacttgatcctgcaggtcagggacggctggctgcagctgctggacattgagaccaaggaggagctggactcttaccgcctagacagcatccaggccatgaatgtggcgctcaacacatgttcctacaactccatcctgtccatcaccgtgcaggagccgggcctgccaggcactagcactctgctcttccagtgccaggaagtgggggcagagcgactgaagaccagcctgcagaaggctctggaggaagagctggagcaaagcagacctcgacttggaggccttcagccaggccaggacagatggagggggcctgctatggaaaggccgctccctatggagcaggcacgctatctggagccggggatccctccagaacagccccaccagaggaccctagagcacagcctcccaccatccccaaggcccctgccacgccacaccagtgcccgagaaccaagtgcctttactctgcctcctccaaggcggtcctcttcccccgaggacccagagagggacgaggaagtgctgaaccatgtcctaagggacattgagctgttcatgggaaagctggagaaggcccaggcaaagaccagcaggaagaagaaatttgggaaaaaaaacaaggaccagggaggtctcacccaggcacagtacattgactgcttccagaagatcaagcacagcttcaacctcctgggaaggctggccacctggctgaaggagacaagtgcccctgagctcgtacacatcctcttcaagtccctgaacttcatcctggccaggtgccctgaggctggcctagcagcccaagtgatctcacccctcctcacccctaaagctatcaacctgctacagtcctgtctaagcccacctgagagtaacctttggatggggttgggcccagcctggaccactagccgggccgactggacaggcgatgagcccctgccctaccaacccacattctcagatgactggcaacttccagagccctccagccaagcacccttaggataccaggaccctgtttcccttcggcggggaagtcataggttagggagcacctcacactttcctcaggagaagacacacaaccatgaccctcagcctggggaccccaactccaggccctccagccccaaacctgcccagccagccctgaaaatgcaagtcttgtacgagtttgaagctaggaacccacgggaactgactgtggtccagggagagaagctggaggttctggaccacagcaagcggtggtggctggtgaagaatgaggcgggacggagcggctacattccaagcaacatcctggagcccctacagccggggacccctgggacccagggccagtcaccctctcgggttccaatgcttcgacttagctcgaggcctgaagaggtcacagactggctgcaggcagagaacttctccactgccacggtgaggacacttgggtccctgacggggagccagctacttcgcataagacctggggagctacagatgctatgtccacaggaggccccacgaatcctgtcccggctggaggctgtcagaaggatgctggggataagcccttaggcaccagcttagacacctccaagaaccaggccccgctgatgcaagatggcagatctgatacccattagagccccgagaattcctcttctggatcccagtttgcagcaaaccccacaccccagctcacacagcaaaaacaatggacaggcccagaggctgaagcaaacagtgtcccttctggctgtgttggagcctccccagtaaccacctatttattttacctctttcccaaacctggagcatttatgcctaggcttgtcaagaatctgttcagtccctctccttctcaataaaagcatcttcaagcttgtaaaaaaaaaaaaaaaaaa

SEQ ID NO: 60429 - DNA, 584 bp, Homo sapiens
gaagaagtggggtgacttaggggctgagcctcagcaactgggagagtttataagctgggatagcagacccctcagcaccacccattctcctcatccctctgctctctggcctccagcctcccagcagcatggctttcaccggcaagttcgagatggagagtgagaagaattatgatgagttcatgaagctccttgggatctccagcgatgtaatcgaaaaggcccgcaacttcaagatcgtcacggaggtgcagcaggatgggcaggacttcacttggtcccagcactactccgggggccacaccatgaccaacaagttcactgttggcaaggaaagcaacatacagacaatggggggcaagacgttcaaggccactgtgcagatggagggcgggaagctggtggtgaatttccccaactatcaccagacctcagagatcgtgggtgacaagctggtggaggtctccaccatcggaggcgtgacctatgagcgcgtgagcaagagactggcctaagcagccaggcccggcccagggagctacaaacccaccaataaaactgatataaggacaaaaaaaaaaaaa

SEQ ID NO: 60430 - DNA, 2158 bp, Homo sapiens
agtcctccagtcctccgtgcgcgtcgggcccgagcccacagagtccatggaacccacggagccgatggaacctacggagcccatggaacctacggagcccatggaacctacggagcccatggaacctacggagcccatggaacctacggagcccatggaaccggcgcggagcgcgcaccgtgggggcgaggcgctgctgcgggagctggaggtgctggtgcaggacgtggtgaggacgagctcctggtgggagcgccacggcgtggactgcgccatcctcgcgctcagcctcttcgccttgccggcaggcttcctgtgcctgcgctgggagaatgccctggtctttgcatccggcatcaccatcttgggtgtgtgccactacacactcactgtcaagggcagccacctggccactcatggggccctcaccgagtccaaacgctggagcaagatctggctgcttttctttgtggaggtgtgcacagccttcactgcagagcacgccacgcatgggcacgtcaagatgcaccatgcctacaccaacgtggtgggcctgggggactccagcacgtggaggctgccttgcctcaaccgctatgtctacatgttccttgctcctttcctcctccccatcgccactccactggtggctgtcgagcggctgaggaaggtggagctcgggacagccctgcggacgctggccctgatttctctgggcctttattctcactactggctgctcctgaacgtgtcaggcttcaagaaccccagctcagccctgggctgcatgttcctcaccagatccctgttggcccacccctacctccacgtcaacatcttccagcacatcggactgcccatgttctcccgggacaacaagccccgtcggattcacatgatgagcctgggggtgcttaacctggcccggctgcccgtgctggactgggcgttcggccactcgatcatcagctgccatgtggaacaccatctattccccaggctctctgataacatgtgcctgaaggtggagcccgtggtgtcccagttcctacgtgagaagcagctaccgtacaacgaggactcatacctggctcgcttccagctgtttctccgtcgctatgaggaattcatggtgcaggccccacccatcactgagcttgtggggctgtaatgaggccgggccggtgcagccaccctgcccctccctggcctggccctggccctcctgctgctgctggtccagggggtgtggctcagtggctggtggtggacctggagagtggaggcaccggccaggcaggggggcaggggagctcaggcctggggtctgggggccacctgccttgcgtgcttttctgggttttgaggggtgtctgggggaagcggtaatggtggctgtgcattctggtcagtctggacctcagcaacttcatctcaggactaaagagctgggtccttccccctgctccatctgagccttggtagggttaaagggaggtgacagggtgaagagggatcctgtgcaggggccacctgggagatagcagggggcacagagagagcagggtcagctccctcggctgggacctccctggcattgggagagccccacacggccttggctattgcttccttcaggctctgcccaccaaggtgccctctccccggggaccttagggtgagcttgcttttggcaggccttcctcgatcctcagccaaaggaacctgtgcaagacactggctcagcagttccccaggccacagtatcagcaagataaaagtgagtgtgttttgtcgggagggaactccaggggaagtgaggggagaaggttccccagggacagagttagggaaagagtataaatagccagccaggggcggtggctcatgcctgtaatcccagcactttgggaggccaaggcgggtggatcgcgagatcaggagctcgagaccaccctggccaacatggtgaaaccccgtctctactaaaaatacaaaaaattagctggatgtggtggcatacacttgtagtcccagctacttggcaggctgaggcagaagaatcacctgaacccgggaggtggaggttgcagtgagccaagattgcaccattgcattccagcctgggtgacagagcgagactccatctcaaaaaaat

SEQ ID NO: 60431 - DNA, 2365 bp, Homo sapiens
atttacagctggaagggcagacggaggcatcttggtgtatacacagccctgctgggccacatcccgggtctcctccctctgcgatgccatagcaggggcgccttccgaaagccctctggattgaggcagcaggatctatggtggaacctgccccggcgtcgccaacgcccctaggaccccagcacactgactggggagcatccctgtgtcgtttctgcccggagaggagcagaggccaggctgctgctctgggagatgagactttctggtgcacctgcacttccacatgagacttccgggtgcacctgcactcccagatgcagacttcctggtgcacctgcacttcctggtgcagacttcttggttcatctgcaacttcctggtgagaatcccttgggcatctgcacttcctgatgcacctgcacttctagttattttagagaaaacgttccctgaacatgccacatgcagaggatgctgggtatcaggctacctttgctggacagctccaggtaactgcatttgctctgccaatgttggctttttaaaaatagaaaacacatatagacaaatccatcacacacacatgcacagacacacacacacacacacagacaaatccatcacacacacatgcacagacacacacacacagagtcagcgacataggctcacaagtagagctcttcgtctgtttatacttaatgcaattactgatacatctaagtttggagctgctgttttcttttacgtatactgtttgtttgcagattctgtgtataaattctttcctttcttgccgccttttagatgatttcccccagcttaccttgaggactttcgagcaaacagacacgttgaaagaatagacaaggaccacttgcatgcccctcagttagattcaccaactgtcaatattttgcactgtatgtatacacgtacatgtctgtgtatacacatatacacatacagtcacacatcgcccgatggcagggatggttctgaggaaggcgctgttaggcgatttcgtcgctgtgcgagcatcatagtgtgaacttactcaaacctagatggcacagactcatcgcctcccacacgcctgggctgtatggcaggacctcctgctaccgggctacaaacccaggcagggtggtactgtactgaatggtgcaggtgattgtaacacaatggtaagtatttgtgcatgtaaacatacctaaacatagaaacagtgtagtaaaaatatggtataaaagatcaaatacagtacacctgtacaaggtctgctctgttctaatcttatggggccaccactgtatatgccgtctattcttgacagaagtgctttatgtggcacatgactgtacatggaaatacacacacactcacacacatccacacacaagcatatgcatacacacatatatacatgtatatacacgtgcatataacatatgtagatatctgccaattgctatccaacgtgaattccataaatttacactcctaccagcagcatttgggtatctgaggtgtcacacatccttgccagcactggatattatcccggcttggagattttgccagcctggtgggtgtgaagtggatcttgttgtggttttaatttccatttctctaattatgcagaggctgagtgccaggcttcctctcctgggaagagcctgccggcttgcgggctgtcagcactcactgtgggtgcgggtggcgtgcctgcctgcacggcccttgcctctcttagtctacagggtctccactcctgagttcccggaaacaagatacagatttcagaatggcacctgaacattgtttactgatttccggctggaagtgagggtccgagggattcttctatggaattgtatgactcagcatctttctgattgcaagcagcagcatcgcagcctaaatgaatctattggctttgcttagggttggttccccttcattcttgagctggttgtgggcaactcctgccccctgtggggggactggactgccttagatcacatgtgtgtccctgactctctgtggtcaggggatagaatattcagattggaggggagccagcttctcctaaaccacgtggatctccaaacggaagtcagagcagatgggaagggggagcagacgttgagctcaatcaataaacacccaccttgggagctgcagcctggagggcttggtgactgccacgctggctgctcagagctcctcgcttacttttgggcatatgcctgtgaaccagatggtggcacctcctgaaaatcgggtctgtggataatgggaggattttttaaattatgaaaatgttcattatggaagaataaatgaagaatagcatatg

SEQ ID NO: 60432 - DNA, 3070 bp, Homo sapiens
acttttttcatgttctccttgagtgaaggatgaggaaattgaaagcagagtatgcaccttttattaggagattcaaactgcatcctactggattagcctcaaaagtcctaaaatacaaagacatccatctgacagatcactgaggggaggacttgtttttctgttttagaatagtttccgattaaactttttagctcaagaagaaaagaagctagttatttctcacccaggagtggatttgtggtttggcttcaccatggcttcctgccgtgcctggaaccttagggtgctggtggctgtcgtgtgtggactactgactggcatcattttgggactgggcatctggaggattgtgatcaggatccaaagaggaaaatctacttcctcatcaagcacccctacagagttctgcaggaatggtggaacctgggaaaatggcagatgtatttgtacagaagagtggaaaggactgagatgtacaattgctaatttttgtgaaaatagtacctatatgggttttacttttgccagaatcccagtgggcagatatggaccatccttgcaaacatgtggcaaggatactccaaatgcgggcaatccaatggcagtccggttgtgcagtctctctctatatggagagatagaattacaaaaagtgacaataggaaattgcaatgaaaatctggaaaccctggaaaagcaggtagaggatgtcacagcaccacttaataacatttcttctgaagtccagattttaacatctgatgccaataaattaactgctgagaacatcactagtgctacgcgagtggttggacagatattcaacacttccagaaatgcttcacctgaggcaaagaaagttgccatagtaacagtgagtcaactcctagatgccagtgaagatgcttttcaaagagttgctgctactgctaatgatgatgcccttacaacgcttattgagcaaatggagacttattccttgtctttgggtaatcaatcagtggtggaacctaacatagcaatacagtcagcaaatttctcttcagaaaatgcggtggggccttcaaatgttcgcttctctgtgcagaaaggagctagcagttctctagtttctagttcaacatttatacatacaaatgtggatggccttaacccagatgcacagactgagcttcaggtcttgcttaatatgacgaaaaattacaccaagacatgcggctttgtagtttatcaaaatgacaagcttttccaatcaaaaacttttacagctaaatcggattttagtcaaaaaattatctcaagcaaaactgatgaaaatgagcaagatcagagtgcttctgttgacatggtctttagtccaaagtacaaccaaaaagaatttcaactctattcctatgcctgtgtctattggaatttgtcagcgaaggactgggacacatatggctgtcaaaaagacaagggcactgatggattcctgcgctgccgctgcaaccatactactaattttgctgtattaatgactttcaaaaaggattatcaatatcccaaatcacttgacatattatccaacgttggatgtgcactgtctgttactggtctggctctcacagttatatttcagattgtcaccaggaaagtcagaaaaacctcagtaacctgggttttggtcaatctgtgcatatcaatgttgattttcaacctcctctttgtgtttggaattgaaaactccaataagaacttgcagacaagtgatggtgacatcaataatattgactttgacaataatgacatacccaggacagacaccattaacatcccgaatcccatgtgcactgcgattgccgccttactgcactattttctgttagtgacatttacctggaacgcactcagcgctgcacagctctattaccttctaataaggaccatgaagcctcttcctcggcatttcattcttttcatctcattaattggatggggagtcccagctatagtagtggctataacagtgggagttatttattctcagaatggaaataatccacagtgggaattagactaccggcaagagaaaatctgctggctggcaattccagaacccaatggtgttataaaaagtccgctgttgtggtcattcatcgtacctgtaaccattatcctcatcagcaatgttgttatgtttattacaatctcgatcaaagtgctgtggaagaataaccagaacctgacaagcacaaaaaaagtttcatccatgaagaagattgttagcacattatctgttgcagttgtttttggaattacctggattctagcatacctgatgctagttaatgatgatagcatcaggatcgtcttcagctacatattctgccttttcaacactacacagggattgcaaatttttatcctgtacactgttagaacaaaagtcttccagagtgaagcttccaaagtgttgatgttgctatcgtctattgggagaaggaagtcattgccttcagtgacgcggccgaggctgcgtgtaaagatgtataatttcctcaggtcattgccaaccttacatgaacgctttaggctactggaaacctctccgagtactgaggaaatcacactctctgaaagtgacaatgcaaaggaaagcatctagacagtaaaacttacctgttgtggtctttttaatcacctcgtttgagttttatctgtttctctcctttatttcccagtcctctcagaaagtcttcctcaatgtattttgctcaggattaagaattagataaaacctgttgtttattattattcggcataatggacttggtagtttttctatttttcaatagatttgtacttgaataaggtgaagaatttcacacaacatacaagagtaccattgttccttatatcgttaaatctttgtgacacactttgacaaaaatgtagaacctataacaaattcttttacaagttactataaaggacacaaagagaaaactttaccttccagaacaaaatgactcctgatgaacagtgtgtggggatttgcttgtatgtattaaacttttgacctctg

SEQ ID NO: 60433 - DNA, 2305 bp, Homo sapiens
gcaaaagcgctagggttgcaagtggcaccagagacgtgcccttgtcccggggtccatttgagggtgagcgtgttggtgccgagctgtttttttgttttgttttgttttgttttgtttttgagaccgaatctcgttctgtcgcccaggctggaatgcagtggtgtgatcttggctcactgcaacctccaccttccgggttcaagtgaatctcctgcctcagcctcctgagtagctgggattactggcacccaccaccacgaccagctaatttttgtatttttagtagagacgggttttcaccatgttggccaggatggtctcaatctcctgacctcaggcgatctgccttcctcagcttcccaaagtgctgggattacaggtgtgagccaccgcacccggccagtgctgagctgttttgacaacttggaccccgggtcctctgtgggtaggaaaatcagctccctctttgctcctctggggcagctgcacctcgggccagctttctgcctgtctgcctgccggcactgctgggtcgctgtacccaaacgcacagccggtgccccgtgctagaaggtcttcagtttccagaagagccaaagcatctttggacctacctagggaaggacctgcctgtgacctttgccctgtcctggagggtccagctttgggctgaatggcagcacccacgctgggccgtctggtgctgacccacctgctggtggccctttttggcatgggctcctgggctgctgtgaacgggatctgggtggagctgcctgtggtggtaaaagaccttccagagggttggagcctcccctcatacctctctgtggttgtggcgctgggaaacctgggtctgctggtggtgaccctgtggaggcggctggccccgggcaagggcgagcaggtccccatccaggtggtacaggtgctgagtgtagtgggcacagccctgctggcccctctgtggcaccacgtggccccagtggcagggcagctccactctgtggccttcctaactctggccttggtgttggcaatggcctgttgtacctctaatgtcactttcctgcccttcctgagccacctgccacctcctttcttacggtctttcttcctgggtcagggtctcagtgccctactcccctgtgtgctggccctagtgcaaggtgtgggccgcctcgagtgcccaccagcgcccaccaatggcacctctgggcctcccctcgacttccctgagcgttttcctgccagcaccttcttctgggcactgactgcccttctggtcacttcagctgccgccttccggggtctcctgttgctgttgccatcactaccctctgtaaccacagggggctcagggcctgaacttcaactgggatccccaggagcagaggaggaagagaaggaggaagaagaggctttgccattgcaggagccaccgagccaggcagcaggcaccatccctggcccagaccctgaggtccatcagctgttctcagcccatggtgccttcctgctgggcctgatggccttcaccagtgccgtgaccaatggcgtgctgccttctgtgcagagcttttcctgtttgccctatgggcgcctggcctaccacctggctgtggtgctgggcagtgccgccaacccccttgcctgcttcctggccatgggcgtgctgtgcaggtccctggcagggctggttggtctttctctgctgggcatgctctttggggcctacctgatggcactggcaatcctgagcccctgcccacccctggtgggcaccactgcaggggtggtccttgtggtgctgtcgtgggtgctgtgtctgtgtgtgttctcatatgtgaaggtggctgcaagctccctgctgcatggtgggggtcggccggcattgctggcagctggtgtggccatccaagtgggctccctgcttggtgccggtgccatgttccctcccaccagcatctaccacgtgtttcaaagcagaaaggactgtgtagacccctgtggcccctgagcctgggcaggtggggacccaactccaccccacctgtcttcatcgtgaggctgccacagtgcctgactacttgtggcccaggcaggcttcccccaacacaggaacgctcatggacacctgcacactccacagaagacgttggcatgtgaggccagggtgggcaccaaagaccaggcccagagccaggggacaggttggggctgtgggcttggacccagggcctgagacctttgtgggatttgtgcaataaagtgtttttatttaaaaccaaaaaaaaaaaaaaaa

SEQ ID NO: 60434 - DNA, 3745 bp, Homo sapiens
cgcaaagcaagtgggcacaaggagtatggttctaacgtgattggggtcatgaagacgttgctgttggacttggctttgtggtcactgctcttccagcccgggtggctgtcctttagttcccaggtgagtcagaactgccacaatggcagctatgaaatcagcgtcctgatgatgggcaactcagcctttgcagagcccctgaaaaacttggaagatgcggtgaatgaggggctggaaatagtgagaggacgtctgcaaaatgctggcctaaatgtgactgtgaacgctactttcatgtattcggatggtctgattcataactcaggcgactgccggagtagcacctgtgaaggcctcgacctactcaggaaaatttcaaatgcacaacggatgggctgtgtcctcatagggccctcatgtacatactccaccttccagatgtaccttgacacagaattgagctaccccatgatctcagctggaagttttggattgtcatgtgactataaagaaaccttaaccaggctgatgtctccagctagaaagttgatgtacttcttggttaacttttggaaaaccaacgatctgcccttcaaaacttattcctggagcacttcgtatgtttacaagaatggtacagaaactgaggactgtttctggtaccttaatgctctggaggctagcgtttcctatttctcccacgaactcggctttaaggtggtgttaagacaagataaggagtttcaggatatcttaatggaccacaacaggaaaagcaatgtgattattatgtgtggtggtccagagttcctctacaagctgaagggtgaccgagcagtggctgaagacattgtcattattctagtggatcttttcaatgaccagtacttggaggacaatgtcacagcccctgactatatgaaaaatgtccttgttctgacgctgtctcctgggaattcccttctaaatagctctttctccaggaatctatcaccaacaaaacgagactttgctcttgcctatttgaatggaatcctgctctttggacatatgctgaagatatttcttgaaaatggagaaaatattaccacccccaaatttgctcatgctttcaggaatctcacttttgaagggtatgacggtccagtgaccttggatgactggggggatgttgacagtaccatggtgcttctgtatacctctgtggacaccaagaaatacaaggttcttttgacctatgatacccacgtaaataagacctatcctgtggatatgagccccacattcacttggaagaactctaaacttcctaatgatattacaggccggggccctcagatcctgatgattgcagtcttcaccctcactggagctgtggtgctgctcctgctcgtcgctctcctgatgctcagaaaatatagaaaagattatgaacttcgtcagaaaaaatggtcccacattcctcctgaaaatatctttcctctggagaccaatgagaccaatcatgttagcctcaagatcgatgatgacaaaagacgagatacaatccagagactacgacagtgcaaatacgacaaaaagcgagtgattctcaaagatctcaagcacaatgatggtaatttcactgaaaaacagaagatagaattgaacaagttgcttcagattgactattacaacctgaccaagttctacggcacagtgaaacttgataccatgatcttcggggtgatagaatactgtgagagaggatccctccgggaagttttaaatgacacaatttcctaccctgatggcacattcatggattgggagtttaagatctctgtcttgtatgacattgctaagggaatgtcatatctgcactccagtaagacagaagtccatggtcgtctgaaatctaccaactgcgtagtggacagtagaatggtggtgaagatcactgattttggctgcaattccattttacctccaaaaaaggacctgtggacagctccagagcacctccgccaagccaacatctctcagaaaggagatgtgtacagctatgggatcatcgcacaggagatcattctgcggaaagaaaccttctacactttgagctgtcgggaccggaatgagaagattttcagagtggaaaattccaatggaatgaaacccttccgcccagatttattcttggaaacagcagaggaaaaagagctagaagtgtacctacttgtaaaaaactgttgggaggaagatccagaaaagagaccagatttcaaaaaaattgagactacacttgccaagatatttggactttttcatgaccaaaaaaatgaaagctatatggataccttgatccgacgtctacagctatattctcgaaacctggaacatctggtagaggaaaggacacagctgtacaaggcagagagggacagggctgacagacttaactttatgttgcttccaaggctagtggtaaagtctctgaaggagaaaggctttgtggagccggaactatatgaggaagttacaatctacttcagtgacattgtaggtttcactactatctgcaaatacagcacccccatggaagtggtggacatgcttaatgacatctataagagttttgaccacattgttgatcatcatgatgtctacaaggtggaaaccatcggtgatgcgtacatggtggctagtggtttgcctaagagaaatggcaatcggcatgcaatagacattgccaagatggccttggaaatcctcagcttcatggggacctttgagctggagcatcttcctggcctcccaatatggattcgcattggagttcactctggtccctgtgctgctggagttgtgggaatcaagatgcctcgttattgtctatttggagatacggtcaacacagcctctaggatggaatccactggcctccctttgagaattcacgtgagtggctccaccatagccatcctgaagagaactgagtgccagttcctttatgaagtgagaggagaaacatacttaaagggaagaggaaatgagactacctactggctgactgggatgaaggaccagaaattcaacctgccaacccctcctactgtggagaatcaacagcgtttgcaagcagaattttcagacatgattgccaactctttacagaaaagacaggcagcagggataagaagccaaaaacccagacgggtagccagctataaaaaaggcactctggaatacttgcagctgaataccacagacaaggagagcacctatttttaaacctaaatgaggtataaggactcacacaaattaaaatacagctgcactgaggcagcgacctcaagtgtcctgaaagcttacattttcctgagacctcaatgaagcagaaatgtacttaggcttggctgccctgtctggaacatggactttcttgcatgaatcagatgtgtgttctcagtgaaataactaccttccactctggaaccttattccagcagttgttccagggagcttctacctggaaaagaaaagaaatgaatagactatctagaacttgagaagattttattcttatttcatttattttttgtttgtttatttttatcgtttttgtttactggctttccttctgtattcataagattttttaaattgtcataattatattttaaatacccatcttcattaaagtatatttaactcataatttttgcagaaaatatgctatatattaggcaagaataaaagctaaagg

SEQ ID NO: 60435 - DNA, 4154 bp, Homo sapiens
gagggtatcagaaccaatactggacatggacatggcaaattacagtgaagttttggacccaacttacacaactttggagtttgaaactatgcagattctatataattcaagtgatagttctgccccagagacaagtatgaataccacagacaacggtgtcaactgtctgtgtgctatctgtggggacagagcaacaggaaaacactatggggcatccagctgtgatgggtgcaagggtttcttcagacgcagcattcgtaagagtcacgtttattcttgcaggttcagtcggcaatgtgttgttgacaaggacaaaaggaatcaatgtagatattgtcgattaagaaagtgttttagagcgggaatgaaaaaagaagctgtacaaaatgaacgtgacagaataagcaccagaagaagcacatttgatggcagcaacatcccctccattaacacactggcacaagctgaagttcggtctcgccagatctcagtctcaagccctgggtcaagcactgacataaacgttaagaaaattgcaagtattggtgatgtctgtgaatctatgaaacagcagctcttagtcttggtggaatgggctaaatatattcctgccttctgtgaattaccattggatgatcaggtggcactgttgagagctcacgcaggggagcacttactgcttggagctacaaagagatccatgatgtataaagatattttgcttttgggaaacaactatgttattcaccgcaacagctgtgaagttgagattagccgtgtggccaatcgtgttctagatgagctggttagaccatttcaagaaatccagattgatgacaatgagtatgcttgtttaaaggcaattgtattttttgatccagatgcaaaagggctaagcgatccagtaaaaattaagaacatgaggttccaagtgcagatcggtttggaggactacatcaatgatcggcagtatgactcccgggggaggtttggagagttgcttctgctcctgcccacactgcagagcatcacgtggcaaatgattgagcaaatacagtttgttaaactttttgggatggttaaaattgacaatctacttcaggaaatgctattaggtggggcttccaatgatggcagtcatctccatcatccaatgcatccacatttgtctcaagacccattaactggacaaactatacttttaggtcccatgtcaacactggttcatgcagaccagatctcaactcctgaaaccccactcccttccccaccacaaggctctgggcaagaacagtacaaaatagctgcaaaccaagcatcagtcatttcacaccagcatctctccaaacaaaagcaattgtgaaaatgtgtttacttcagaacggcactacataaatgtgaaaagttgttgatcttgaaatatctcaggatagcacttttggcaaactcttagccaaggcttcttcattggtgctgttataagatggtgtcctattttcttgtttatacgttcattctgtttgttattgctactatgtaaaactttcacatgcaaccaatgtatatctgagtttgaagatgtttatatagggtattttttccaactgcccctgcattgtgcctgaaccaattgaatcttatgtatgagtttcatttgttttattaatgttaatttaaatctgtaaataattgctttattgtgatgtgatacagaacaaagtgttcgtttttgactgaaaatagtagatcagaaatctcagtttaatataaaatgagctaagtttttaaaaataaattataaacttggagattagaaaaataaagcagttgctgtagaataggctgtatctttttcaagaagaatctcttatggacagtctgtggtaaagaagcaactctttgctttagagttaaatattcctatcttaagtttagaaaaatacaaaaaaccattccaaggatgactggatactttttgaaatctgactttctttgaagatgtatgttaagcaaaaacatgttgcttttatcagttaggatacagggtgaactgtaacaaagaaacccctaaaacagtgactaaatcaagagaggaatctatttctttctcctgaaacaatttagaaaatagttatccattgactagaaattagtacatgcccacagctggctcccacggtagccaggagaattatctataggtggaaagtctgtgtcagccaaagccatgtcactctgagagaactgattctgaggacaagttagccatctaccacccatgtcccttatttggtcctcacaataacactttaggagagatatcattatcgctgttttataaataagggaaactttagcttgagggtttaaggaacataaccaaagttcacaaacataacgagtgagagaaacacattcaagcccaggtctagttgactttaatgaatctttggtgtggaatgaaaaatgtgaacttcttactcatagtgtggtttttaaatatatgcagttgagtgatgattggatactattcatcatattgcctataatatatatttaccgataagcagcgagtgtaaaattgttgtagcttgaataagaaaccacttttgtagttttaaccagactttctcttaaaaacattagataaaataaaagattcaccggatggattctgatgaaaacgaaaacaaagtaaaatgactggcttagcagattctttgaaatgtagcagcccagggatgtaccaaatgtcgaattctagactgaggagtagagttcattggagtcttaaactctctgatatcacttaaagctggagtttattttaaaacaaatgaagcatgggccacctcatgatgcagtggctcctctctggttgaggagagggaaaattggaaaaactggtcgagtaattatcaataattttttttaaaaagaggatcccaaactgtaaaagattgaaataatctttctcaggattttttaaatgtctaagattatgatgtcatatctcccacttaccttataagtaaaaaggttaatatcaagtaacttattagctcttaaagtaaaattgaacttattaaaagctatctatgatttaatagatttaataaaattccttcacgacctggtacccttgtgaaactgtaaaatatatcatatggggggagctttttaactcttattttttgaaaatttactgtagcttctatttcgtgaataagaatgttttgattttgatcatacaaataacttttgtagatttttgtttacttttgggggggttcccttagaagacattaaaaaaaaatactgccttggtctgtgcaggctgctgtaatgaaatactatgaacttggcagcttataaacaacagaaatttatttctcgctgttctcaatggtgggaagtccaagattaagggatcaacaaattaggcctctggatcatacatggcattttctagctgtgtccttatacataaaaggaaaaaggtagctctctcgagtctctttaataaagatactaattctcatgactgaatcaccctccaaaggccccacctcctaataccatcactctggggactaggtgtcagcatgtgaattttggaaaacacaaaaattcagaacatagcaaatacctttgaagtataaaagataaaattcatttttagtgaaccctgtaatttattcgtgtatatttactaaacagctgtatctttgaaattgttagtaatgattctgcttcaataactatggtcagggaatttataatattatatttttatatactgaactgccatagatgctggaaaaaaggaactgatgttttcagcatattttcaaaatattgataagggaagttattacttttatatagtattcaacctttttcaggtaatagaagtgaataatttattgtgaaataattcattttataaatgtataattatttttataaattttattgttggaaatcaaaaattagtagattttttaccatgttaaattatagtgagattaaagtattactaaactgtgatgctatgtttgtttcactaaactttctaaataaaaactgagaaaaaaaaaaaaaaaaaaaaaaaaaaaaaaaaaaaaaaaaagaaaaaaaaaaaaaaaaaaaca

SEQ ID NO: 60436 - DNA, 1427 bp, Homo sapiens
ctgggaatatgattatgcttaatctatgctcagtcgaaaggggctggggctgctttctcccctcccttcttgactctctgttcacagaactcaggctgcctccagccagcctttgcccgctagactcactggccctgagcacttgaaggtgcagcaagtcactgagaatgagcactttcttctcggacacagcatggatctgcctggctgtccccacagtactatgtgggacagtattttgcaaatacaagaagagctcagggcagctgtggagctggatggtctgcctggcaggcctctgtgcagtctgcctgctcatcctgtcccctttttggggcttgatcctcttctcggtgtcatgcttcctcatgtatacttacttatctggccaagaattgttacctgtggatcagaaggcagtcctggtgacaggtggtgattgcgggcttggccatgctttgtgcaagtatctggatgagctgggcttcacggtatttgccggagttttgaatgaaaatggcccaggagctgaggaattgcgaagaacctgctctccgcgcctctcggtgctccaaatggacatcacgaagccagtgcagataaaagatgcttacagcaaggttgcagcaatgctgcaggacagaggactgtgggctgtgatcaacaatgctggggtgcttggctttccaactgatggggagcttcttcttatgactgactacaaacaatgcatggccgtgaacttctttggaactgtggaggtcacaaagacgtttttgcctcttcttagaaaatccaaagggaggctggtgaatgtcagcagcatgggaggaggggccccaatggaaaggctggcatcttatggctcatcaaaggcggctgtgaccatgttctcatcagttatgagactggagctttccaagtggggaattaaagttgcttccatccaacctggaggcttcctaacaaatatcgcaggcaccagtgacaagtgggaaaagctggagaaggacattctggaccacctccccgctgaggtacaggaagactacggccaggactacatcttagcacagcggaatttcctcctattgatcaactcgttagccagcaaggacttctctccggtgctgcgggacatccagcatgctatcttggcgaagagcccttttgcctattacacgccagggaaaggcgcttacttgtggatctgccttgctcactatttgcctattggcatatatgattactttgctaaaagacattttggccaagacaagcccatgcccagagctctaagaatgcctaactacaagaaaaaggccacctaggcaatggaagccctcaaagaagtcggaatgtcatagtcttgaaatgaaagggaaactgggaaactgggtttctcattaaagttgtttcccactctg

SEQ ID NO: 60437 - DNA, 1899 bp, Homo sapiens
gtagcctcatggaagagaagcagatcctgtgcgtggggctagtggtgctggacgtcatcagcctggtggacaagtaccctaaggaggactcggagataaggtgtttgtcccagagatggcagcgcggaggcaacgcgtccaactcctgcaccgttctctccctgctcggagccccctgtgccttcatgggctcaatggctcctggccatgttgctgattttgtcctggatgacctccgccgctattctgtggacctacgctacacagtctttcagaccacaggctccgtccccatcgccacggtcatcatcaacgaggccagtggtagccgcaccatcctatactatgacaggagcctgccagatgtgtctgctacagactttgagaaggttgatctgacccagttcaagtggatccacattgagggccggaacgcatcggagcaggtgaagatgctgcagcggatagacgcacacaacaccaggcagcctccagagcagaagatccgggtgtccgtggaggtggagaagccacgagaggagctcttccagctgtttggctacggagacgtggtgtttgtcagcaaagatgtggccaagcacttggggttccagtcagcagaggaagccttgaggggcttgtatggtcgtgtgaggaaaggggctgtgcttgtctgtgcctgggctgaggagggcgccgacgccctgggccctgatggcaaattgctccactcggatgctttcccgccaccccgcgtggtggatacactgggagctggagacaccttcaatgcctccgtcatcttcagcctctcccaggggaggagcgtgcaggaagcactgagattcgggtgccaggtggccggcaagaagtgtggcctgcagggctttgatggcatcgtgtgagagcaggtgccggctcctcacacaccatggagactaccattgcggctgcatcgccttctcccctccatccagcctggcgtccaggttgccctgttcaggggacagatgcaagctgtggggaggactctgcctgtgtcctgtgttccccacagggagaggctctggggggatggctgggggatgcagagcctcagagcaaataaatcttcctcagagccagcttctcctctcaatgtctgaactgctctggctgggcattcctgaggctctgactcttcgatcctccctctttgtgtccattccccaaattaacctctccgcccaggcccagaggaggggctgcctgggctagagcagcgagaagtgccctgggcttgccaccagctctgccctggctggggaggacactcggtgccccacacccagtgaacctgccaaagaaaccgtgagagctcttcggggccctgcgttgtgcagactctattcccacagctcagaagctgggagtccacaccgctgagctgaactgacaggccagtggggggcaggggtgcgcctcctctgccctgcccaccagcctgtgatttgatggggtcttcattgtccagaaatacctcctcccgctgactgccccagagcctgaaagtctcacccttggagcccaccttggaattaagggcgtgcctcagccacaaatgtgacccaggatacagagtgttgctgtcctcagggaggtccgatctggaacacatattggaattggggccaactccaatatagggtgggtaaggccttataatgtaaagagcatataatgtaaagggctttagagtgagacagacctggattcaaatctgccatttaattagctgcatatcaccttagggtacagcacttaacgcaatctgcctcaatttcttcatctgtcaaatggaaccaattctgcttggctacagaattattgtgaggataaaaatcatatataaaaaaaaaa

SEQ ID NO: 60438 - DNA, 1899 bp, Homo sapiens
gtagcctcatggaagagaagcagatcctgtgcgtggggctagtggtgctggacgtcatcagcctggtggacaagtaccctaaggaggactcggagataaggtgtttgtcccagagatggcagcgcggaggcaacgcgtccaactcctgcaccgttctctccctgctcggagccccctgtgccttcatgggctcaatggctcctggccatgttgctgacttcctggtggccgacttcaggcggcggggcgtggacgtgtctcaggtggcctggcagagcaagggggacacccccagctcctgctgcatcatcaacaactccaatggcaaccgtaccattgtgctccatgacacgagcctgccagatgtgtctgctacagactttgagaaggttgatctgacccagttcaagtggatccacattgagggccggaacgcatcggagcaggtgaagatgctgcagcggatagacgcacacaacaccaggcagcctccagagcagaagatccgggtgtccgtggaggtggagaagccacgagaggagctcttccagctgtttggctacggagacgtggtgtttgtcagcaaagatgtggccaagcacttggggttccagtcagcagaggaagccttgaggggcttgtatggtcgtgtgaggaaaggggctgtgcttgtctgtgcctgggctgaggagggcgccgacgccctgggccctgatggcaaattgctccactcggatgctttcccgccaccccgcgtggtggatacactgggagctggagacaccttcaatgcctccgtcatcttcagcctctcccaggggaggagcgtgcaggaagcactgagattcgggtgccaggtggccggcaagaagtgtggcctgcagggctttgatggcatcgtgtgagagcaggtgccggctcctcacacaccatggagactaccattgcggctgcatcgccttctcccctccatccagcctggcgtccaggttgccctgttcaggggacagatgcaagctgtggggaggactctgcctgtgtcctgtgttccccacagggagaggctctggggggatggctgggggatgcagagcctcagagcaaataaatcttcctcagagccagcttctcctctcaatgtctgaactgctctggctgggcattcctgaggctctgactcttcgatcctccctctttgtgtccattccccaaattaacctctccgcccaggcccagaggaggggctgcctgggctagagcagcgagaagtgccctgggcttgccaccagctctgccctggctggggaggacactcggtgccccacacccagtgaacctgccaaagaaaccgtgagagctcttcggggccctgcgttgtgcagactctattcccacagctcagaagctgggagtccacaccgctgagctgaactgacaggccagtggggggcaggggtgcgcctcctctgccctgcccaccagcctgtgatttgatggggtcttcattgtccagaaatacctcctcccgctgactgccccagagcctgaaagtctcacccttggagcccaccttggaattaagggcgtgcctcagccacaaatgtgacccaggatacagagtgttgctgtcctcagggaggtccgatctggaacacatattggaattggggccaactccaatatagggtgggtaaggccttataatgtaaagagcatataatgtaaagggctttagagtgagacagacctggattcaaatctgccatttaattagctgcatatcaccttagggtacagcacttaacgcaatctgcctcaatttcttcatctgtcaaatggaaccaattctgcttggctacagaattattgtgaggataaaaatcatatataaaaaaaaaa

SEQ ID NO: 60439 - DNA, 1817 bp, Homo sapiens
caaccatcctgaagctacaggtgctccctcctggaatctccaatggatttcagtcgcagaagcttccacagaagcctgagctcctccttgcaggcccctgtagtcagtacagtgggcatgcagcgcctcgggacgacacccagcgtttatgggggtgctggaggccggggcatccgcatctccaactccagacacacggtgaactatgggagcgatctcacaggcggcggggacctgtttgttggcaatgagaaaatggccatgcagaacctaaatgaccgtctagcgagctacctagaaaaggtgcggaccctggagcagtccaactccaaacttgaagtgcaaatcaagcagtggtacgaaaccaacgccccgagggctggtcgcgactacagtgcatattacagacaaattgaagagctgcgaagtcagattaaggatgctcaactgcaaaatgctcggtgtgtcctgcaaattgataatgctaaactggctgctgaggacttcagactgaagtatgagactgagagaggaatacgtctaacagtggaagctgatctccaaggcctgaataaggtctttgatgacctaaccctacataaaacagatttggagattcaaattgaagaactgaataaagacctagctctcctcaaaaaggagcatcaggaggaagtcgatggcctacacaagcatctgggcaacactgtcaatgtggaggttgatgctgctccaggcctgaaccttggcgtcatcatgaatgaaatgaggcagaagtatgaagtcatggcccagaagaaccttcaagaggccaaagaacagtttgagagacagactgcagttctgcagcaacaggtcacagtgaatactgaagaattaaaaggaactgaggttcaactaacggagctgagacgcacctcccagagccttgagatagaactccagtcccatctcagcatgaaagagtctttggagcacactctagaggagaccaaggcccgttacagcagccagttagccaacctccagtcgctgttgagctctctggaggcccaactgatgcagattcggagtaacatggaacgccagaacaacgaataccatatccttcttgacataaagactcgacttgaacaggaaattgctacttaccgccgccttctggaaggagaagacgtaaaaactacagaatatcagttaagcaccctggaagagagagatataaagaaaaccaggaagattaagacagtcgtgcaagaagtagtggatggcaaggtcgtgtcatctgaagtcaaagaggtggaagaaaatatctaaatagctaccagaaggagatgctgctgaggttttgaaagaaatttggctataatcttatctttgctccctgcaagaaatcagccataagaaagcactattaatactctgcagtgattagaaggggtggggtggcgggaatcctatttatcagactctgtaattgaatataaatgttttactcagaggagctgcaaattgcctgcaaaaatgaaatccagtgagcactagaatatttaaaacatcattactgccatctttatcatgaagcacatcaattacaagctgtagaccacctaatatcaatttgtaggtaatgttcctgaaaattgcaatacatttcaattatactaaacctcacaaagtagaggaatccatgtaaattgcaaataaaccactttctaattttttcctgtttctgaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 60440 - DNA, 6274 bp, Homo sapiens
gttcctagaaaatggagctgtcttggcatgtagtctttattgccctgctaagtttttcatgctgggggtcagactgggagtctgatagaaatttcatttccaccgctggtcctctaaccaatgacttgctgcacaacctgagtggtctcctgggagaccagagttctaactttgtagcaggggacaaagacatgtatgtttgtcaccagccactgcccactttcctgccagaatacttcagcagtctccatgccagtcagatcacccattataaggtatttctgtcatgggcacagctcctcccagcaggaagcacccagaatccagacgagaaaacagtgcagtgctaccggcgactcctcaaggccctcaagactgcacggcttcagcccatggtcatcctgcaccaccagaccctccctgccagcaccctccggagaaccgaagcctttgctgacctcttcgccgactatgccacattcgccttccactccttcggggacctagttgggatctggttcaccttcagtgacttggaggaagtgatcaaggagcttccccaccaggaatcaagagcgtcacaactccagaccctcagtgatgcccacagaaaagcctatgagatttaccacgaaagctatgcttttcagggcggaaaactctctgttgtcctgcgagctgaagatatcccggagctcctgctagaaccacccatatctgcgcttgcccaggacacggtcgatttcctctctcttgatttgtcttatgaatgccaaaatgaggcaagtctgcggcagaagctgagtaaattgcagaccattgagccaaaagtgaaagttttcatcttcaacctaaaactcccagactgcccctccaccatgaagaacccagccagtctgctcttcagcctttttgaagccataaataaagaccaagtgctcaccattgggtttgatattaatgagtttctgagttgttcatcaagttccaagaaaagcatgtcttgttctctgactggcagcctggcccttcagcctgaccagcagcaggaccacgagaccacggactcctctcctgcctctgcctatcagagaatctgggaagcatttgccaatcagtccagggcggaaagggatgccttcctgcaggatactttccctgaaggcttcctctggggtgcctccacaggagcctttaacgtggaaggaggctgggccgagggtgggagaggggtgagcatctgggatccacgcaggcccctgaacaccactgagggccaagcgacgctggaggtggccagcgacagttaccacaaggtagcctctgacgtcgccctgctttgcggcctccgggctcaggtgtacaagttctccatctcctggtcccggatcttccccatggggcacgggagcagccccagcctcccaggcgttgcctactacaacaagctgattgacaggctacaggatgcgggcatcgagcccatggccacgctgttccactgggacctgcctcaggccctgcaggatcatggtggatggcagaatgagagcgtggtggatgccttcctggactatgcggccttctgcttctccacatttggggaccgtgtgaagctgtgggtgaccttccatgagccgtgggtgatgagctacgcaggctatggcaccggccagcaccctcccggcatctctgacccaggagtggcctcttttaaggtggctcacttggtcctcaaggctcatgccagaacttggcaccactacaacagccatcatcgcccacagcagcaggggcacgtgggcattgtgctgaactcagactgggcagaacccctgtctccagagaggcctgaggacctgagagcctctgagcgcttcttgcacttcatgctgggctggtttgcacaccccgtctttgtggatggagactacccagccaccctgaggacccagatccaacagatgaacagacagtgctcccatcctgtggctcaactccccgagttcacagaggcagagaagcagctcctgaaaggctctgctgattttctgggtctgtcgcattacacctcccgcctcatcagcaacgccccacaaaacacctgcatccctagctatgataccattggaggcttctcccaacacgtgaaccatgtgtggccccagacctcatcctcttggattcgtgtggtgccctgggggataaggaggctgttgcagtttgtatccctggaatacacaagaggaaaagttccaatataccttgccgggaatggcatgcccataggggaaagtgaaaatctctttgatgattccttaagagtagactacttcaatcaatatatcaatgaggtgctcaaggctatcaaggaagactctgtggatgttcgttcctacattgctcgttccctcattgatggcttcgaaggcccttctggttacagccagcggtttggcctgcaccacgtcaacttcagcgacagcagcaagtcaaggactcccaggaaatctgcctactttttcactagcatcatagaaaagaacggtttcctcaccaagggggcaaaaagactgctaccacctaatacagtaaacctcccctccaaagtcagagccttcacttttccatctgaggtgccctccaaggctaaagtcgtttgggaaaagttctccagccaacccaagttcgaaagagatttgttctaccacgggacgtttcgggatgactttctgtggggcgtgtcctcttccgcttatcagattgaaggcgcgtgggatgccgatggcaaaggccccagcatctgggataactttacccacacaccagggagcaatgtgaaagacaatgccactggagacatcgcctgtgacagctatcaccagctggatgccgatctgaatatgctccgagctttgaaggtgaaggcctaccgcttctctatctcctggtctcggattttcccaactgggagaaacagctctatcaacagtcatggggttgattattacaacaggctgatcaatggcttggtggcaagcaacatctttcccatggtgacattgttccattgggacctgccccaggccctccaggatatcggaggctgggagaatcctgccttgattgacttgtttgacagctacgcagacttttgtttccagacctttggtgatagagtcaagttttggatgacttttaatgagcccatgtacctggcatggctaggttatggctcaggggaatttcccccaggggtgaaggacccaggctgggcaccatataggatagcccacgccgtcatcaaagcccatgccagagtctatcacacgtacgatgagaaatacaggcaggagcagaagggggtcatctcgctgagcctcagtacacactgggcagagcccaagtcaccaggggtccccagagatgtggaagccgctgaccgaatgctgcagttctccctgggctggtttgctcaccccatttttagaaacggagactatcctgacaccatgaagtggaaagtggggaacaggagtgaactgcagcacttagccacctcccgcctgccaagcttcactgaggaagagaagaggttcatcagggcgacggccgacgtcttctgcctcaacacgtactactccagaatcgtgcagcacaaaacacccaggctaaacccaccctcctacgaagacgaccaggagatggctgaggaggaggacccttcgtggccttccacggcaatgaacagagctgcgccctgggggacgcgaaggctgctgaactggatcaaggaagagtatggtgacatccccatttacatcaccgaaaacggagtggggctgaccaatccgaacacggaggatactgataggatattttaccacaaaacctacatcaatgaggctttgaaagcctacaggctcgatggtatagaccttcgagggtatgtcgcctggtctctgatggacaactttgagtggctaaatggctacacggtcaagtttggactgtaccatgttgatttcaacaacacgaacaggcctcgcacagcaagagcctccgccaggtactacacagaggtcattaccaacaacggcatgccactggccagggaggatgagtttctgtacggacggtttcctgagggcttcatctggagtgcagcttctgctgcatatcagattgaaggtgcgtggagagcagatggcaaaggactcagcatttgggacacgttttctcacacaccactgagggttgagaacgatgccattggagacgtggcctgtgacagttatcacaagattgctgaggatctggtcaccctgcagaacctgggcgtgtcccactaccgtttttccatctcctggtctcgcatcctccctgatggaaccaccaggtacatcaatgaagcgggcctgaactactacgtgaggctcatcgatacactgctggccgccagcatccagccccaggtgaccatttaccactgggacctaccacagacgctccaagatgtaggaggctgggagaatgagaccatcgtgcagcggtttaaggagtatgcagatgtgctcttccagaggctgggagacaaggtgaagttttggatcacgctgaatgagccctttgtcattgcttaccagggctatggctacggaacagcagctccaggagtctccaataggcctggcactgccccctacattgttggccacaatctaataaaggctcatgctgaggcctggcatctgtacaacgatgtgtaccgcgccagtcaaggtggcgtgatttccatcaccatcagcagtgactgggctgaacccagagatccctctaaccaggaggatgtggaggcagccaggagatatgttcagttcatgggaggctggtttgcacatcctattttcaagaatggagattacaatgaggtgatgaagacgcggatccgtgacaggagcttggctgcaggcctcaacaagtctcggctgccagaatttacagagagtgagaagaggaggatcaacggcacctatgacttttttgggttcaatcactacaccactgtcctcgcctacaacctcaactatgccactgccatctcttcttttgatgcagacagaggagttgcttccatcgcagatcgctcgtggccagactctggctccttctggctgaagatgacgccttttggcttcaggaggatcctgaactggttaaaggaggaatacaatgaccctccaatttatgtcacagagaatggagtgtcccagcgggaagaaacagacctcaatgacactgcaaggatctactaccttcggacttacatcaatgaggccctcaaagctgtgcaggacaaggtggaccttcgaggatacacagtttggagtgcgatggacaattttgagtgggccacaggcttttcagagagatttggtctgcattttgtgaactacagtgacccttctctgccaaggatccccaaagcatcagcgaagttctacgcctctgtggtccgatgcaatggcttccctgaccccgctacagggcctcacgcttgtctccaccagccagatgctggacccaccatcagccccgtgagacaggaggaggtgcagttcctggggctaatgctcggcaccacagaagcacagacagctttgtacgttctcttttctcttgtgcttcttggagtctgtggcttggcatttctgtcatacaagtactgcaagcgctctaagcaagggaaaacacaacgaagccaacaggaattgagcccggtgtcttcattctgatgagttaccacctcaagttctatgaagcaggcctagtttcttcatctatgtttaccggccaccaaacaccttagggtcttagactctgctgatactggacttctccataaagtcctgctgcaccgttagagatgactttaatcttgaatgatttcgacttgctgagtaaaatggaaatatctccatcttgctccagtatcagagttcatttgggcatttgagaagcaagtagctcttgcggaaacgtgtagatactggtctagtgggtctgtgaaccacttaattgaacttaacagggctgttttaagtttcagagttgttaagggttgttaagggagcaaaaaccgtaaaaatccttcctataagaagaaatcaactccattgcatagactgcaatatcatctcctgcccttctgcaagctctccctagcttcacatcttgtgttttccagaaaataaaaacagcagactgtcctttc

SEQ ID NO: 60441 - DNA, 1717 bp, Homo sapiens
gtggcagcggtgaccgcctcctgggttattttcttttctcccccagctgccccagggttctggtttcccgaatcacttggcaaataaccagcaggtgggcagatgtcttttttgcgttcctacggacgcgtaggcaagttcgatgcgccggagtgaacagccagggtcccatctctcagccggctcccgggcggtgctagcagggaagagggacgcgccggcgaatgaaacactactagcccggaaagccgccctggaccttccacccgggcagcgagtctggcggcccctcgccgccgccccctccgaccagaacagactgcgctgcgagccccgggcttccgccgcagcgcgcagcaattggaggtgccagaggagaccagcagcagcacttgatttagctgggctgcgggaattccgacctgtacactttccagaagcctgatctctccaagtccgcgcccagggactcgagccccggcttccaggttgacccgagcgcgcccccttcgtgctctcggccgcgttcaccgcgcgaggcctccgggtcctgttaagcccgagcagcacaggccgctgcctcagcatccaccccgcagcccacgtgtggcaagccggggaaggggtggagtgaacggccggagaccacgtggagaaaggggccgctttggcccttccatctgggtgccgggagcccctaggccctccggccatggccgacagcggcgatgctggcagctccggcccctggtggaaatcgctcaccaacagcagaaagaaaagcaaggaagccgcagtgggggtgccgcctcccgcccagcccgctcccggggagcccacgccacctgcgccgcccagcccggactggaccagcagctcccgggagaaccagcaccccaatctcctcgggggcgccggcgagccccccaaaccagacaagttatacggggacaaatccggcagcagccgccgcaatttgaagatctcgcgctccggccgctttaaggagaagaggaaagtgcgcgccacgctgctcccggaggcgggcaggtccccggaggaggcaggctttcctggtgacccccacgaggacaagcagtagccccaatagcctgcgcgctccaggactgcctacccagcactaccccaaacccccagttccaaacccgagacttcaggcccgcccccttacgcgttgtctcattccaccaaattcagaatatttacacaatgccttcatgattttatttttctggaaattgaagtgtcaattgggttctcaatatttcatgactccaaggatgcattaaatatttatttgtggtaagagaagatacctgccgcggaggagggtggcataattatttttttttcaaaaagctattctggggccctggccccctggctcctgtcacagctcagcttgaactctgtagcctctcaaatgaagaaggtggctgttatttaggactctgtggaaagcaaatcacagtgctgtttttaatgcctgagaaatgcactttaggggtagacttataccttaagtgaaggagtgggggaggaagaagcattcttaagtagaagcattttaaaataaggcaggattgcttttaatgttaaactacaaaactgtacagcctattttagtgtggactattaaaacccttgcactgtaaggaaaaaaaaaaaaaaaaaaaaaaaaaaaaaaaaaaaaaaa

SEQ ID NO: 60442 - DNA, 3348 bp, Homo sapiens
atacgaaggcattatgaaaaacctctatttcagagtcattaccatagttataggtctttattttactggaataatgacaaatgcatcaagaaaaagcaatattttattcaattctgaatgccaatggaatgaatatattctgacaaattgttcttttaccggaaagtgtgatatacctgtggacatatcacagacagcagccactgtggatgtaagtttcaatttctttagagttctcttacagtctcacacgaaaaaagaagagtggaaaataaaacatctggacctcagtaacaatctcatatcaaaaataaccttaagcccttttgcatatttacatgctttggaagtgttaaacctcagcaacaatgccatccactccctctcattggatctactcagtcctaagtcctcatgggtgaaacgccacagaagcagcttcagaaacaggtttccattgctgaaggtgctcattcttcaaagaaataaactcagtgacactcccaagggactgtggaaactgaagtcattgcagagtttggatctgtcattcaatgggatattgcaaatagggtggtctgattttcacaactgcctgcaactggagaatctctgtttaaagagcaacaagatattcaaaattcccccacaagccttcaaggacctcaaaaaattacaggtcatagaccttagcaacaatgctctgattaccatcctaccaatgatgatcatagctctagaatttccccatctagtggttgacttggctgataataactggcagtgtgatgatagtgtggcagtctttcaaaattttatttctgaatcctggaggaaaaagtggaatgtcatttgcaacaggtctatagggagtgaggaggccaacgggggcactccccagagcaggatttccagggaaacccgccttcctcccattcatctgcatcgcatgaaaagcctcataaggagcaaagcagagaggccccagggaggaaggcacacgggcatttctactctggggaagaaggcaaaggccggctctggtctcaggaagaagcagagacggctgccaaggagtgttagaagcacccgcgatgtgcaggctgccggcaaaaaagaggacgctccccaggacctggctctggcggtgtgcctgtcagtgttcatcacattccttgtcgccttcagcctgggggctttcacaaggccttatgttgacagactgtggcaaaaaaagtgccagagcaaaagccctggcctggacaacgcgtattcaaacgagggcttctacgatgacatggaagctgcggggcacacaccacacccagagacccatctgcgccaagtatttcctcatctaagcctctacgagaaccagacccctttctgggtgacacagccacacccacacgccaccgtaattcctgatagaactctgggaaggagcagaaaggatcctggcagttcgcagagcccaggacagtgcggggacaacaccggggcaggaagtggaaatgatggtgcagtctattccattctccagagacatccacatgccggtaaccgtgaactaatgtcagcagcgcaggaccacatccataggaatgatattctcggagaatggacttatgaaactgtggcccaggaagagcctctcagtgcacattcagtgggcgtctcttctgtagctggcacgtctcacgctgtctctggctcaagccgttatgattccaatgaattagacccttccctctccggagaaataacagcttccctctgtaaaatgctaacacatgcagaagcacagaggactggagatagtaaggaaagagggggcactgaacagtcactttgggactcgcagatggaattttctaaggaaaggcaagtgagttcatccattgatttgctgagcatacagcagccaaggctgtccggggcaagggctgaggaagcgctttcagcccactacagcgaggttccatacggtgacccaagagacacaggcccatcagtctttcctccaagatgggacagtggcctggatgtcactcctgctaacaaggaaccagtgcagaaatccactccttctgacacttgctgtgagttggagagtgactgtgactctgatgaggggtctctgttcactctgagctccataagttcagagagtgcaaggagcaagactgaagaggcagtgcctgatgaggagtccctgcaggacgagagctcaggggcaagcaaggacaatgtgacggctgtagacagtcttgaggaaaatgttaccttccaaacaattccagggaaatgcaagaatcaagaagatccctttgaaaaacctctcatttctgctccagactctggcatgtacaagactcatctggaaaatgcctctgacactgatagatctgagggcctgtcaccctggcccaggtcaccagggaatagtcccttaggggatgagtttccgggcatgttcacttatgattatgacacagctcttcaatccaaggcagcagaatggcattgctcacttagagacttagaattttcaaatgtggacgttttacagcaaacaccaccatgttctgctgaagttccctcagatcctgataaggctgccttccatgaaagagactcagacattttaaaataagaatctttcattaaggaaatattcacagctctaaacaatattcttttaaagatcatggcaggggaaaactaaagccttcacaacaagatcctgaaggagacaacatgaattccaaccaagtggacactgatgcaaatgagggttttgtgggcccacttgagggcgatgattctagaagggttataagctaaacacacttgttaacatcctatggggatgaacctgctcttcagtgtgaaagagaaagaggggaatattttgagatcattccaagaaccatgcaccattattacaagagctccaaacaaaaccagttcactgagaacacaggagtacttcatcaataggttggggtaaatattcagaagagaatctgttgcagttagacgaagtggttctaactttccttctcaaatacagacctggagcaatctgatgggatttggctctctgaaaagaacagctttaggatgacaaagacaaggatgttcaacttgatcatcaaagagaattcaaatgacattttttcatacatattgaagcacttaagtggaaatgctggatagattttaatgaattctgaacacacactagcacaactttttggaggctgatcgtgaaactgcaaaattggaaaagttctgagtaaatataaatgtttttaaataagttatgttaaaaaaaaaaaaaaa

SEQ ID NO: 60443 - DNA, 6656 bp, Homo sapiens
atgtcggggttcaggctgggtgaccacgtgtggctggagcctccctccacccacaagaccagcgtggccatcgggggcatcatcaaagaggcaaagccaggcaaagtcttggttgaagatgacgagggcaaggaacactggatccgagcagaggactttggtgtcctcagtcccatgcaccccaactcagtccagggtgtggacgacatgatccgcctgggggacctgaacgaggcaggcatggtgcacaacctcctgatccgctaccagcagcacaagatctatacatacacaggctccatcctggtggccgtcaacccgttccaggtgctgccgctctacaccctggagcaggtacagctctactacagccgccatatgggcgagctgcccccgcatgtctttgccatcgccaacaactgctacttcagcatgaagaggaacaagagggaccagtgctgcatcatcagcggcgagtctggggctggcaagacggagaccaccaagctcatcctgcagttcctggccaccatcagtggccagcattcgtggattgagcagcaggtcctggaagccaaccccatcctggaggcctttggaaatgccaagacaatccgcaacgacaactcaagccgctttgggaagtacattgacatctactttaaccccagcggggtgatcgagggcgcgcgcatcgagcaatttctcctggagaagtcccgggtctgccggcaggctcccgaggagcggaactaccatatcttctactgcatgctcatgggggtgagtgctgaggacaagcagctgctgagcctgggcacgccctccgagtaccactacctgaccatggggaactgcacttcctgtgaggggctcaacgacgccaaggactacgcccacatccgctcggccatgaagatcctccagttctccgactccgagagctgggacgtcatcaagctgctggctgccattctccacctggggaatgtggggttcatggcttcggtcttcgagaacctggacgcctcagacgtgatggagacgcccgcctttcccaccgtgatgaagttactggaggtgcagcaccaggagctccgggactgtctgatcaagcacaccatcctcatccgaggggaatttgtcaccaggtccctgaacattgcccaggctgctgaccggagggacgcctttgtcaagggcatctatgggcacctcttcctgtggattgtcaagaagatcaatgccgccatcttcacaccaccagcccaggaccccaaaaatgtgcggagggccatcggcctcctggacatatttggctttgaaaatttcgagaacaatagcttcgagcagctctgcatcaacttcgccaacgagcacctgcagcagttctttgtgcagcacgtgttcaccatggagcaagaggagtaccgctcggagaacatctcctgggactatatccactacaccgacaatcggcccaccctggacctgctggccctcaagcccatgagcatcatctccctcctggacgaagaaagccgcttcccgcaggggacagatctcaccatgctgcaaaagctgaacagcgtccatgccaacaacaaggccttcctacagcccaagaacatccacgatgccagatttggcattgcccattttgccggcgaggtgtactaccaagcagaaggcttcctggagaagaaccgagacgtgctgagcacagatatcctcaccctggtttactcctccaaaaacaagtttctgagggagatattcaacttggagttagcagagaccaagctgggccatgggaccatccgccaggcaaaggcaggaaaccatctcttcaagtctgcagactcaaataaacggccctccaccttaggaagccagttcaaacagtctctggaccagctgatgaaaatcctgaccaactgccagccttacttcatccgctgcatcaaacctaatgagtacaagaagccgctgctgttcgaccgggagctgtgcctgcggcagctgcgatactcgggcatgatggagaccgtgcacatccgcaagtcgggcttccccatccgctacacgttcgaggagttctcgcagaggttcggcgtgttgctgcccaacgccatgcggatgcagctgcaaggcaagctccgccagatgaccctgggcatcactgacgtgtggctgcggacagacaaagactggaaagcggggaagacaaaaattttcctgagggatcatcaggacactctgctggaggtacagagaagccaggtgctagacagagcggcgctcagcatccagaaagtccttcggggctacagatacaggaaggagttcctgaggcagaggcgggcagctgtgaccctgcaggcctggtggagaggctactgcaacaggaggaatttcaagctgatcctcgtgggctttgagcgcctgcaggctattgcccggagccagccgctggcgaggcagtaccaggccatgcggcagaggacagtccagctgcaggccctgtgcaggggatacctggtgcgccagcaagtccaggccaagaggagggcagtggtggtcattcaggcccatgccaggggcatggctgcccggcgcaacttccagcaaaggaaggccaatgcgccgctggtcatcccggccgaggggcagaaaagccaaggcgctctccctgccaagaagcgcagatccatctacgacaccgtcactgacacggagatggtggagaaggtgttcggcttcctccctgccatgattgggggccaggagggccaggcctcgccgcactttgaggatctggaatcaaagacccagaagctgcttgaggttgacctggacacagtccccatggcggaggagcctgaggaggatgtggatggcctggccgagtacaccttccccaagtttgctgtgacttacttccagaaatcagccagccacacacacatccggcggcccctccgatacccgttgctttaccacgaagatgacactgactgcttggccgccctggtcatatggaacgtcatcctgaggttcatgggtgatctcccagagccagtgctgtatgccaggagcagccagcagggcagctcagtgatgcggcagatccatgacacgctgggcagggagcacggtgcccaggttccacagcacagtagatctgcacaggtggccagccagctgaacattggagaggaggcattggagcctgatggccttggtgcagaccggcccatgtccaacctggagaaggtgcacttcatcgtgggctacgccatcctgcggcccagcctcagggatgagatttactgccagatctgcaagcagctctcggagaacttcaaaacaagcagcctggcccggggctggatcctgctcagcctctgcctcggctgcttcccaccctcagagaggttcatgaagtatctactgaacttcatcggccaagggccggcgacctacggccccttctgtgccgagcgcctgagacgcacctatgccaatggggtgcgtgcggagccccccacctggctggagctgcaggctgtcaagtccaagaagcacatccccatccaagtcatcttggccactggagagagcctaaccgtccccgtggactcagcctccacatctcgggaaatgtgcatgcacatcgctcacaagcagggcctcagcgaccacctgggcttctccctccaggtcgccgtgtacgacaagttctggtccctgggcagcgggcgcgaccacatgatggatgccatcgcccggtgtgagcagatggcccaggagaggggcgagagccagcgccagtcaccctggcgcatctacttccggaaggaattcttcaccccctggcacgactcccgggaggaccctgtcagcaccgagcttatttaccgccaagtcctccgaggagtctggtctggcgagtacagcttcgagaaggaggaagagctggttgagctgctggcccggcactgctacgtgcagctcggcgcctcagcagagagcaaggctgtccaggagctgctgcccagctgcatcccccacaagctgtacaggaccaagcccccagacaggtgggcgagcctcgtcactgccgcctgcgccaaggccccatacactcagaagcaagtcacaccactggccgtgcgagagcaggtggtggacgccgcccgcctgcagtggccgctgctcttctcccggctcttcgaagtcatcacactctcaggcccccgcctgcccaagacgcagctgatcttggctgttaactggaaggggctttgcttcctggaccagcaggagaagatgctgctggaactctctttcccagaggtcatgggtctggccaccaacagggaggcccagggcgggcagaggctgctgctctccacgatgcatgaggagtacgagtttgtgtcacccagcagtgtggccatcgctgagctggtggccctgttcctggagggcctgaaggagaggtccattttcgccatggccctgcaggacaggaaggccacagatgacaccaccctcctggccttcaagaagggggacctgttggtcctcacaaagaagcaggggctgctggcctctgagaactggaccctcggccagaacgacaggacaggcaagacggggctggtgcccatggcctgcctctacaccatccccacggtcactaagccctcggcacagctgctgagcttgcttgccatgtcaccagagaagaggaagctggcggctcaggaggggcagttcacagagccacgtcctgaggagccacccaaggaaaagctgcacaccctggaggagttctcctatgagttcttcagggctccagagaaggacatggtgagcatggccgtgctgcccctggcccgtgcccgtggccacctgtgggcctattcctgcgagccgctgcgacagccgctgctcaagcgagtccacgccaacgtcgacctctgggacatcgcctgccagatctttgtcgccatcctccggtacatgggcgactacccttctcggcaggcctggcccaccctggagctcaccgaccagatcttcacactggccctgcagcacccggccctccaggacgaggtctactgccagatcctgaagcagctgacgcacaactccaacaggcacagcgaagagcggggctggcagctgctgtggctgtgcacgggcctcttcccgcccagcaaggggctgctgccccatgcccagaagtttatagacactcggagggggaagctgctggcccccgactgcagccgccgaatccagaaggtcctgaggacggggccccggaagcagcccccgcaccaggtggaggtggaggccgcagagcagaacgtctcccgcatctgccacaagatctacttccccaatgacaccagtgagatgctggaggtggttgccaacacacgggtgcgggatgtgtgtgacagcattgccaccaggctgcagctggcctcctgggagggctgcagcctcttcatcaagatttcagacaaggtcatcagccagaaggagggagacttcttctttgattccttgagggaggtgtctgactgggtgaagaagaacaagccccagaaagaaggggcccccgtgacgctcccctaccaggtgtacttcatgcggaaattgtggctcaacatatctccagggaaggatgtgaatgcagacaccatactccattaccaccaggagctgcccaagtacctgcgcggattccacaagtgttcgcgggaggatgccatccacctggcgggcctcatctacaaggcccagttcaacaacgaccggtcccagctggctagtgtccccaagatcctgagggaactggtgcctgagaacctcacacgcctgatgtcctcggaggagtggaaaaagagcatccttctagcctacgacaagcataaggacaagacagtggaggaggccaaggtggccttcctgaagtggatctgccggtggcccaccttcggatccgccttcttcgaggtgaagcaaacctcggagccttcctacccggacgtcatcctcatcgccatcaaccgacatggggttctgctcatccaccccaagaccaaggacctgctcaccacctatcccttcaccaagatctccagctggagcagcggcagcacctacttccacatggcgctggggagcctgggccgtggcagccgcctgctgtgcgagacctccctgggctataagatggatgacctgctgacctcatatgtgcagcagctcctgagtgccatgaacaagcagcggggctccaaggccccagccctggccagcacctagcagcggatgctggcgtgtctgctcaggcgcccttcccgacctctagcctggcggcaccttcccaggccctctcaacccagggcctgtccttggcgggcagccttccatgctgccccccatacaaagcccactcagccccgcaggcggccccctctgtcctgggcgctgcccagggaggccaaaagacgggcccagaatggggtcgggagtctcggacccccaggctattggtggatgactgactgacaggacacctcccaaccccaccccaccccaccagaatgttcaataaaaactcctggagc

SEQ ID NO: 60444 - DNA, 681 bp, Homo sapiens; identical to SEQ ID NO: 13395

SEQ ID NO: 60445 - DNA, 1359 bp, Homo sapiens
atgtgtcccctggattttggtgcagccatttgcacaaccgatgcgcaggcagtgtcacttgcgctgacgtctgtctgtccgggtgcagggagaagggaggaagaggggagaggtggggcggtgcaaagccccctgcccgctgggcccatgcagctgttggggctcctcggcctcctctggatgctcaaggcctccccgtgggccacagtcagttccaacacctcaaccaccccgacgtccaagtttgccttcaaggttgaaaccactccacccaccgtgttggtctattcagccaccactgagtgcgtgtatccaacgagctttataatcaccatctcccaccccacctccatctgtgtgaccacgacgcaggtggccttcaccagctcttacacctcgactcccgtgacacagaagccagtgaccaccgtcaccagtacttactctatgaccactactgagaaaggaactcacctcacacagtactcccagattcacttcttcaatcaccactaccgagaccccctcacacagtactcccagattcacttcttcattcaccaataccaagaccacctcacacagatctcccagcttcacttctttgatcaccaccacggagaccacctcacacagtactcccagcttcacttcttcgatcaccaccaccgagaccacctcacacagtgctcgcagcttcacttcttcgatcaccaccaccgagaccacctcacacaatactcggagcttcacttcttcgatcaccaccaccgagaccaactctcacagtactaccagcttcacttcttcgatcaccaccaccgagaccacctcacacatcagcacatccacaactgccatcacctcacattttactacctcagagactgcggtgactcccacacctgtaaccccatcttctctgagtacagacatcccgaccacaagcctacgaactctcaccccttcgtctacccctcctgtactgacgtcagccactgggacccaaacatctcctgcacctactactgtcacctttggaagtacggattcctccacgtccactcttcatactcttactccatcaacagccttgagcacgatcgtgtcaacatcacaggcacctgtgacaatggtggcacctgggaacagggacagtgtgcttgccttccggggttttctggggaccgctgtcagctccagaccagatgccagaatgggggtcagtgggatggcctcaaatgccagtgccccagcaccttctatggttccagttgtgagtttgctgtggaacaggtggatctagcttctggagcctcccacagcaaggctgcatctctctgtgtctttctcccatag

SEQ ID NO: 60446 - DNA, 5482 bp, Homo sapiens
atggtaccttactggtctttggggttccagctgtgtcgctatggctaccagaatgactctgagatcgccagcttgtatgatgagatggtggctgcccagatcccttatgatgtgcagtactcagacatcgactacatggagcggcagctggacttcaccctcagccccaagtttgccgggtttccagctctgatcaatcgcatgaaggctgatgggatgcgggtcatcctcattctggatccagccatttctggcaatgagacacagccttatcctgccttcactcggggcgtggaggatgacgtcttcatcaaatacccaaatgatggagacattgtctggggaaaggtctggcctgattttcctgatgttgttgtgaatgggtctctagactgggacagccaagtggagctatatcgagcttatgtggccttcccagactttttccgtaattcaactgccaagtggtggaagagggaaatagaagaactatacaacaatccacagaatccagagaggagcttgaagtttgatggcatgtggattgatatgaatgaaccatcaagcttcgtgaatggggcagtttctccaggctgcagggacgcctctctgaaccaccctccctacatgccacatttggagtccagggacaggggcctgagcagcaagaccctttgtatggagagtcagcagatcctcccagacggctccctggtgcagcactacaacgtgcacaacctgtatgggtggtcccagaccagacccacatacgaagccgtgcaggaggtgacgggacagcgaggggtcgtcatcacccgctccacatttccctcttctggccgctgggcaggacattggctgggagacaacacggccgcatgggatcagctgaagaagtctatcattggcatgatggagttcagcctctttggcatatcctatacgggagcagatatctgtgggttctttcaagacgctgagtacgagatgtgtgttcgctggatgcagctgggggccttttaccccttctcaagaaaccacaataccattgggaccaggagacaagaccctgtgtcctgggatgctgcttttgtgaatatttccagaaatgtcctgcagaccagatacaccctgttgccatatctgtataccttgatgcaaaaggcccacacggagggcgtcactgttgtgcggcctctgctccatgagtttgtgtcagaccaggtgacatgggacatagacagtcagttcctgctgggcccagccttcctggtcagccctgtcctggagcgcgtgagtatggaggcctccgatgaggggaggatcccagctgtgaggcttggggaaaaggacgaggagaagaggcctgagctgaatgccagaaatgtcactgcatatttccctagagcccgttggtacgattactacacgggtgtggatattaatgcaagaggagagtggaagaccttgccagcccctcttgaccacattaatcttcatgtccgtgggggctacatcctgccctggcaagagcctgcactgaacacccacttaagtcgaaagaaccctcttggtcttattattgccctagatgaaaacaaagaagcaaaaggagaacttttctgggatgatgggcaaacaaaggatactgtggccaagaaagtatatcttttatgtgagttttctgtcactcaaaaccacttggaggtgactatttcacaatcaacctacaaggaccccaataatttagcattcaatgagattaaaattcttgggatggaggaacctagcaatgttacggtgaaacacaatggtgtcccaagtcagacttctcctacagtcacttatgattctaacctgaaggtcgccattatcacagacatcaatcttttcctgggagaagcatacacagtggagtggagcataaagataagggatgaagaaaaaatagactgttaccctgatgagaatggtgattctgcagaaaactgcactgcccgtggctgtatctgggaggcatccaattcttctggagtccctttttgctattttgtcaacgacctatactctgtcagtgatgttcagtataactcccatggggccacagctgacatctccttaaagtcttctgttcatgccaatgccttcccttccacacccgtgaacccccttcgcctggatgtcacttaccataagaatgaaatgctacagttcaagatttatgatcccaacaacaatcggtatgaagttccagtccctctgaacatacccagcgtgccatccagcacccctgagggtcaactctatgatgtcctcattaagaagaatccatttgggattgaaattcgccggaagagtacaggcactataatttgggactctcagctccttggcttcaccttcaatgacatgtttatccgcatctccacccgccttccctccaagtacctctatggctttggggagactgagcacacgtcctacaggagagacttggagtggcacacttgggggatgttctcccgagaccagcccccagggtacaagaagaattcctatggtgtccacccctactacatggggctagaggaggatggcagtgcccatggagtgctcctgctgaacagcaatgccatggatgtgacgttccagcccctgcctgccttgacataccgtaccacagggggagttctggacttttatgtgttcttggggccaactccagagcttgtcacccagcagtacactgagttgattggccggcctgtgatggtaccttactggtctttggggttccagctgtgtcgctatggctaccagaacgactctgagatctccagcttgtatgatgagatggtggctgcccagatcccttatgacgtgcagtactcagacatcgactacatggagcggcagctggacttcaccctcagccccaagtttgccgggtttccagctctgatcaatcgcatgaaggctgatgggatgcgggtcatcctcattctggatccagccatttctggcaatgagacacagccctatcctgccttcactcggggcgtggaggatgacgtcttcatcaagtacccaaatgatggagacattgtctggggaaaggtctggcctgattttcctgatgttgttgtgaatgggtctctagactgggacagtcaagtggagctatatcgagcttatgtggccttcccagactttttccgtaattcaactgccaagtggtggaagagggaaatagaagaactatacaacaatccacagaatccagagaggagcttgaagtttgatggcatgtggattgatatgaatgaaccatcaagcttcgtgaatggggcagtttctccaggctgcagggatgcctctctgaaccaccctccctacatgccgtatttggagtccagggacaggggcctgagcagcaagaccctgtgcatggagagtcagcagatcctcccagacggctccccggtgcagcactacaatgtgcacaacctgtacgggtggtcccagaccagacccacatacgaagccgtgcaggaggtgacaggacagcgaggggtcgtcatcacccgctccacatttccctcttctggccgctgggcaggacattggctgggagacaacacagccgcgtgggatcagctgaagaagtctatcattggcatgatggagttcagcctcttcggcatatcctatacgggagcagatatctgtgggttctttcaagatgctgaatatgagatgtgtgttcgctggatgcagctgggggccttttaccccttctcaagaaaccacaacaccattgggaccaggagacaagaccctgtgtcctgggatgttgcttttgtgaatatttccagaactgtcctgcagaccagatacaccctgttgccatatctgtataccttgatgcataaggcccacacggagggcgtcactgttgtgcggcctctgctccatgaatttgtgtcagaccaggtgacatgggacatagacagtcagttcctgctgggcccagccttcctggtcagccctgtcctggagcgtaatgccagaaatgtcactgcatatttccctagagcccgctggtatgattactacacgggtgtggatattaatgcaagaggagagtggaagaccttgccagcccctcttgaccacattaatcttcatgtccgtgggggctacatcctgccctggcaagagcctgcactgaacacccacttaagccgccagaaattcatgggcttcaaaattgccttggatgatgaaggaactgctgggggctggctcttctgggatgatgggcaaagcattgatacctatgggaaaggactctattacttggccagcttttctgccagccagaatacgatgcaaagccatataattttcaacaattacatcactggtacaaatcctttgaaactgggctacattgaaatctggggagtgggcagtgtccccgttaccagtgtcagcatctctgtgagtggcatggtcataacaccctccttcaacaatgaccccacgacacaggtattaagcatcgatgtgactgacagaaacatcagcctacataattttacttcattgacgtggataagcactctgtgaatttttacagcaagattctaactaactatgaatgactttgaaactacttatacttcatactcataaaaattattgtgtgttgctaatttgttcatacccactattggtgaaatatttctgttaattttgttatatgttttttgtgtgaaccctaaaggttaaaccttagccctgtgggataggcagttagggaggtgtggaaaatctatgcattaccttaatgtctctgtgtggttagtatggtagtgactgttcatcatatgacatttactgaagatgaactgggtccatgatgaagtgtgtgtatgtccacgtttgtaatcatagaatggaccccattcttttgttaaatacacaagagaaagctttctgtgacagttccaggtcttgaagctaatcagcatctcaagaaagtatccagaaagaacatctgctagttggttataggcggtgggaggaataatatacctaattggttataggtggggggagcatgataagcaaagaaaaggcaaacacaaggaaagatcagatgaaacagaagatgatagtaaaagtgatcctaagtaagaacataatgtaaaattgtcagcagcctcatggggaggaaaaaggaagagtcaactcacttgaagaagagggtcttgagaaatccttagcataaagggctactggtgagattgagatctgagcaggcaaagctcaaaagagagtttggaggttaaaaataatttatttttgcagtagtgtgctttgaaatgtgtaaatcttatttctaatgtatacaaccacatttcacataaaaatatgcaatttatatgccagataaaaataaaacaagtgaatttgc

SEQ ID NO: 60447 - DNA, 1566 bp, Homo sapiens
aatggtggcacctgggaacagggccagtgtgcttgccttccggggttttctggggaccgctgtcagctccagaccagatgccagaacgggggccagtgggatggcctcaagtgccagtgccccagcaccttctatggttccagttgtgagtttgctgtggaacaggtggatctagatgcagaagatttttgcagacatgcagggcttcaccttcaagggtgtggagatcctgtccctgaggaatggcagcatcgtggtggactacctggtcctgctggagatgcccttcagcccccagctggagagcgagtatgagcaggtgaagaccacgctgaaggaggggctccagaacgccagccaggatgcgaacagctgccaggactcccagaccctgtgttttaagcctgactccatcaaggtgaacaacaacagcaagacagagctgaccccggaagccatctgccgccgcgccgctcccacgggctatgaagagttctacttccctctggtggaggccacccggctccgctgtgtcaccaaatgcacgtcgggcgtggacaacgccatcgactgtcaccagggccagtgcgttctagagacgagcggtcccgcgtgtcgctgctactccaccgacacgcactggttctctggcccgcgctgcgaggtggccgtccactggagggcgctggtcgggggcctgacggccggcgccgcgctgctggtgctgctgctgctggcgctgggcgtccgggcggtgcgctccggatggtggggcggccagcgccgaggccggtcctgggaccaggacaggaaatggttcgagacctgggatgaggaagtcgtgggcactttttcaaactggggtttcgaggacgacggaacagacaaggatacaaatttccatgtggccttggagaacgtggacaccactatgaaggtgcacatcaagagacccgagatgacctcgtcctcagtgtgagccctgcggggccccttcaccaccccctccgccctgccccggacacaagggtctgcattgcgtccatttcaagaggtggccccaggacgcgggcagcccaggctcctgctgttcttgggcaagatgagactgttcccccaaatcccatccttctccttccaacttggctgaaacccacctggagacgcagttcacgtccaggctcttccactgtggaatcttgggcaagtcagtaacgagcctcagtttcctcacctgcaaaacgggtacagcattcctgtatgatagctcacgccgttgttgtgaaaaccacatagacttggtcaattctcggtcctactctgccctcccgtctcagccctcgtgttgccattgcctctctcggatcctccaatcctcacgtccttcacctggtctctggccctggttcttattttctctcaattccctactgcctgtttcttactttgaacctggaggcagcctgcagccccatcccatctcctgccctctcctgatctaactccctgctgcatctcttgctctcattccttagacgtcctccccttttgaccccgttccttcat

SEQ ID NO: 60448 - DNA, 8604 bp, Homo sapiens
atggggctgccactagcccgcctggcggctgtgtgcctggccctgtctttggcagggggctcggagctccagacagagggcagaacccgaaaccacggccacaacgtctgcagcacctggggcaacttccactacaagaccttcgacggggacgtcttccgcttccccggcctctgcgactacaacttcgcctccgactgccgaggctcctacaaggaatttgctgtgcacctgaagcggggtccgggccaggctgaggcccccgccggggtggagtccatcctgctgaccatcaaggatgacaccatctacctcacccgccacctggctgtgcttaacggggccgtggtcagcaccccgcactacagccccgggctgctcattgagaagagcgatgcctacaccaaagtctactcccgcgccggcctcaccctcatgtggaaccgggaggatgcactcatgctggagctggacactaagttccggaaccacacctgtggcctctgcggggactacaacggcctgcagagctattcagaattcctctctgacggcgtgctcttcagtcccctggagtttgggaacatgcagaagatcaaccagcccgatgtggtgtgtgaggatcccgaggaggaggtggcccccgcatcctgctccgagcaccgcgccgagtgtgagaggctgctgaccgccgaggccttcgcggactgtcaggacctggtgccgctggagccgtatctgcgcgcctgccagcaggaccgctgccggtgcccgggcggtgacacctgcgtctgcagcaccgtggccgagttctcccgccagtgctcccacgccggcggccggcccgggaactggaggaccgccacgctctgccccaagacctgccccgggaacctggtgtacctggagagcggctcgccctgcatggacacctgctcacacctggaggtgagcagcctgtgcgaggagcaccgcatggacggctgtttctgcccagaaggcaccgtatatgacgacatcggggacagtggctgcgttcctgtgagccagtgccactgcaggctgcacggacacctgtacacaccgggccaggagatcaccaatgactgcgagcagtgtgtctgtaacgctggccgctgggtgtgcaaagacctgccctgccccggcacctgtgccctggaaggcggctcccacatcaccaccttcgatgggaagacgtacaccttccacggggactgctactatgtcctggccaagggtgaccacaacgattcctacgctctcctgggcgagctggccccctgtggctccacagacaagcagacctgcctgaagacggtggtgctgctggctgacaagaagaagaatgtggtggtcttcaagtccgatggcagtgtactgctcaacgagctgcaggtgaacctgccccacgtgaccgcgagcttctctgtcttccgcccgtcttcctaccacatcatggtgagcatggccattggcgtccggctgcaggtgcagctggccccagtcatgcaactctttgtgacactggaccaggcctcccaggggcaggtgcagggcctctgcgggaacttcaacggcctggaaggtgacgacttcaagacggccagcgggctggtggaggccacgggggccggctttgccaacacctggaaggcacagtcaagctgccatgacaagctggactggttggacgatccctgctccctgaacatcgagagcgccaactacgccgagcactggtgctccctcctgaagaagacagagaccccctttggcaggtgccactcggctgtggaccctgctgagtattacaagaggtgcaaatatgacacgtgtaactgtcagaacaatgaggactgcctgtgcgccgccctgtcctcctacgcgcgcgcctgcaccgccaagggcgtcatgctgtggggctggcgggagcatgtctgcaacaaggatgtgggctcctgccccaactcgcaggtcttcctgtacaacctgaccacctgccagcagacctgccgctccctctccgaggccgacagccactgtctcgagggctttgcgcctgtggacggctgcggctgccctgaccacaccttcctggacgagaagggccgctgcgtacccctggccaagtgctcctgttaccaccgcggtctctacctggaggcgggggatgtggtcgtcaggcaggaagaacgatgtgtgtgccgggatgggcggctgcactgtaggcagatccggctgatcggccagagctgcacggccccaaagatccacatggactgcagcaacctgactgcactggccacctcgaagccccgagccctcagctgccagacgctggccgccggctattaccacacagagtgtgtcagtggctgtgtgtgccccgacgggctgatggatgacggccggggtggctgcgtggtggagaaggaatgcccttgcgtccataacaacgacctgtattcttccggcgccaagatcaaggtggactgcaatacctgcacctgcaagagaggacgctgggtgtgcacccaggctgtgtgccatggcacctgctccatttacgggagtggccactacatcacctttgatgggaagtactacgactttgacggacactgctcctacgtggctgttcaggactactgcggccagaactcctcactgggctcattcagcatcatcaccgagaacgtcccctgtggcactacgggcgtcacctgctccaaggccatcaagatcttcatggggaggacggagctgaagttggaagacaagcaccgtgtggtgatccagcgtgatgagggtcaccacgtggcctacaccacgcgggaggtgggccagtacctggtggtggagtccagcacgggcatcatcgtcatctgggacaagaggaccaccgtgttcatcaagctggctccctcctacaagggcaccgtgtgtggcctgtgtgggaactttgaccaccgctccaacaacgacttcaccacgcgggaccacatggtggtgagcagcgagctggacttcgggaacagctggaaggaggcccccacctgcccagatgtgagcaccaaccccgagccctgcagcctgaacccgcaccgccgctcctgggccgagaagcagtgcagcatcctcaaaagcagcgtgttcagcatctgccacagcaaggtggaccccaagcccttctacgaggcctgtgtgcacgactcgtgctcctgtgacacgggtggggactgtgagtgcttctgctctgccgtggcctcctacgcccaggagtgtaccaaagagggggcctgcgtgttctggaggacgccggacctgtgccccatattctgcgactactacaaccctccgcatgagtgtgagtggcactatgagccatgtgggaaccggagcttcgagacctgcaggaccatcaacggcatccactccaacatctccgtgtcctacctggagggctgctacccccggtgccccaaggacaggcccatctatgaggaggatctgaagaagtgtgtcactgcagacaagtgtggctgctatgtcgaggacacccactacccacctggagcatcggttcccaccgaggagacctgcaagtcctgcgtgtgtaccaactcctcccaagtcgtctgcaggccggaggaaggaaagattcttaaccagacccaggatggcgccttctgctactgggagatctgtggccccaacgggacggtggagaagcacttcaacatctgttccattacgacacgcccgtccaccctgaccaccttcaccaccatcaccctccccaccacccccaccaccttcaccactaccaccaccaccaccaccccgacctccagcacagttttatcaacaactccgaagctgtgctgcctctggtctgactggatcaatgaggaccaccccagcagtggcagcgacgacggtgaccgagaaacatttgatggggtctgcggggcccctgaggacatcgagtgcaggtcggtcaaggatccccacctcagcttggagcagctaggccagaaggtgcagtgtgatgtctctgttgggttcatttgcaagaatgaagaccagtttggaaatggaccatttggactgtgttacgactacaagatacgtgtcaattgttgctggcccatggataagtgtatcaccactcccagccctccaactaccactcccagccctccaccaaccagcacgaccacccttccaccaaccaccacccccagccctccaaccaccaccacaaccacccctccaccaaccaccacccccagccctccaataaccaccacgaccacccctccaccaaccaccactcccagccctccaataagcaccacaaccacccctccaccaaccaccactcccagccctccaaccaccactcccagccctccaaccaccactcccagccctccaacaaccaccacaaccacccctccaccaaccaccactcccagccctccaacgactacgcccatcactccaccagccagcactaccacccttccaccaaccaccactcccagccctccaacaaccaccacaaccacccctccaccaaccaccactcccatcaccaccaccaccacggtgaccccaaccccaacacccaccggcacacagaccccaacaacgacacccatcaccaccaccaccacggtgaccccaaccccaacacccaccggcacacagaccccaacatcgacacccatcaccaccaccactacggtgaccccaaccccaacacccaccggcacacagaccccaaccacgacacccatcaccaccaccactacggtgaccccaaccccaacacccactggcacacagaccccaaccccaacagccatcaccaccaccactacggtgaccccaaccccaacacccaccggcacacagaccccaaccacgacacccatcaccaccaccactacggtgacaccaaccccaacacccaccggcacacagtccccaaccccaacagccatcaccaccaccactacggtgaccccaaccccaacacccaccggcacacagaccccaacatcgacacccatcaccaccaccactacggtgaccccaaccccaacacccaccggcacacagaccccaaccccgacacccatctccaccaccactacggtgaccccaaccccaacacccaccggcacacagaccccaaccacgacacccatcaccaccaccaccacggtgaccccaaccccgacacccaccggcacacagaccccaaccacggtactcatcaccaccaccactacgatgaccccaaccccaacacccaccagcacaaagagtacaaccgtgacacccatcaccaccacaactacggtgaccgcaaccccaacacccaccggcacacagaccccaaccatgatacccatcagcaccaccactacggtgaccccaaccccaacacccaccactggaagcacggggccccccacccacacaagcacagcacccattgctgagttgaccacatccaatcctccgcctgagtcctcaacccctcagacctctcggtccacctcttcccctctcacggagtcaaccacccttctgagtaccctaccacctgccattgagatgaccagcacggccccaccctccacacccacggcacccacgaccacgagcggaggccacacactgtctccaccgcccagcaccaccacgtcccctccaggcacccccactcgcggtaccacgaccgggtcatcttcagcccccacccccagcactgtgcagacgaccaccaccagtgcctggaccccaacgccgaccccactctccacacccagcatcatcaggaccacaggcctgaggccctacccttcctctgtgcttatctgctgtgtcctgaacgacacctactacgcaccaggtgaggaggtgtacaacggcacatacggagacacctgttatttcgtcaactgctcactgagctgtacgttggagttctataactggtcctgcccatccacgccctccccaacacccacgccctccaagtcgacgcccacgccttccaagccatcgtccacgccctccaagccgacgcccggcaccaagccccccgagtgcccagactttgatcctcccagacaggagaacgagacttggtggctgtgcgactgcttcatggccacgtgcaagtacaacaacacggtggagatcgtgaaggtggagtgtgagccgccgcccatgcccacctgctccaacggcctccaacccgtgcgcgtcgaggaccccgacggctgctgctggcactgggagtgcgactgctactgcacgggctggggcgacccgcactatgtcaccttcgacggactctactacagctaccagggcaactgcacctacgtgctggtggaggagatcagcccctccgtggacaacttcggagtttacatcgacaactaccactgcgatcccaacgacaaggtgtcctgtccccgcaccctcatcgtgcgccacgagacccaggaggtgctgatcaagaccgtgcatatgatgcccatgcaggtgcaggtgcaggtgaacaggcaggcggtggcactgccctacaagaagtacgggctggaggtgtaccagtctggcatcaactacgtggtggacatccccgagctgggtgtcctcgtctcctacaatggcctgtccttctccgtcaggctgccctaccaccggtttggcaacaacaccaagggccagtgtggcacctgcaccaacaccacctccgacgactgcattctgcccagcggggagatcgtctccaactgtgaggctgcggctgaccagtggctggtgaacgacccctccaagccacactgcccccacagcagctccacgaccaagcgcccggccgtcactgtgcccgggggcggtaaaacgaccccacacaaggactgcaccccatctcccctctgccagctcatcaaggacagcctgtttgcccagtgccacgcactggtgcccccgcagcactactacgatgcctgcgtgttcgacagctgcttcatgccgggctcgagcctggagtgcgccagtctgcaggcctacgcagccctctgtgcccagcagaacatctgcctcgactggcggaaccacacgcatggggcctgcttggtggagtgcccatctcacagggagtaccaggcctgtggccctgcagaagagcccacgtgcaaatccagctcctcccagcagaacaacacagtcctggtggaaggctgcttctgtcctgagggcaccatgaactacgctcctggctttgatgtctgcgtgaagacctgcggctgtgtgggacctgacaatgtgcccagagagtttggggagcacttcgagttcgactgcaagaactgtgtctgcctggagggtggaagtggcatcatctgccaacccaagaggtgcagccagaagcccgttacccactgcgtggaagacggcacctacctcgccacggaggtcaaccctgccgacacctgctgcaacattaccgtctgcaagtgcaacaccagcctgtgcaaagagaagccctccgtgtgcccgctgggattcgaagtgaagagcaagatggtgcctggaaggtgctgtcctttctactggtgtgagtccaagggggtgtgtgttcacgggaatgctgagtaccagcccggttctccagtttattcctccaagtgccaggactgcgtgtgcacggacaaggtggacaacaacaccctgctcaacgtcatcgcctgcacccacgtgccctgcaacacctcctgcagccctggcttcgaactcatggaggcccccggggagtgctgtaagaagtgtgaacagacgcactgtatcatcaaacggcccgacaaccagcacgtcatcctgaagcccggggacttcaagagcgacccgaagaacaactgcacattcttcagctgcgtgaagatccacaaccagctcatctcgtccgtctccaacatcacctgccccaactttgatgccagcatttgcatcccgggctccatcacattcatgcccaatggatgctgcaagacctgcacccctcgcaatgagaccagggtgccctgctccaccgtccccgtcaccacggaggtttcgtacgccggctgcaccaagaccgtcctcatgaatcattgctccgggtcctgcgggacatttgtcatgtactcggccaaggcccaggccctggaccacagctgctcctgctgcaaagaggagaaaaccagccagcgtgaggtggtcctgagctgccccaatggcggctcgctgacacacacctacacccacatcgagagctgccagtgccaggacaccgtctgcgggctccccaccggcacctcccgccgggcccggcgctcccctaggcatctggggagcgggtgagcggggtgggcacagcccccttcactgccctcgacagctttacctcccccggaccctctgagcctcctaagctcggcttcctctcttcagatatttattgtctgagtctttgttcagtccttgctttccaataataaactcagggggaca

SEQ ID NO: 60449 - DNA, 1272 bp, Homo sapiens
gctttaattccaatggagggagggagaaaacaaccaacctgtgggctggaacagctggtcgtgagtgtcaggactagagaagaagacaggaaccaggatgggaagacggacatgttacattttaagctggagcttcccctgcagtccacggagcacgttctcggtgtgcagctcatcctgactttctcctatcgattacacaggatggcgaccctcgtgatgcagagcatggcgtttctccagtcctcctttcctgtcccgggatcccagttatacgtgaacggagacctgaggctgcagcagaagcagccgctgagctgtggtggcctagatgcccgatacaatgtaagggcgcttctcattgtccagctcctttgtttctgtgtgttactgttcgtcgagttctttgaagagggggataaaaaaaggaaggacagagtaaatgaacttaaattgttgcaagagagtttattcatctttgaagaaaagattattgatactgcagtaggccaccaagaacaagaggtatctgtgaccaacgggaccagcccctttgcctatgactacgacctcacccatattgttgctgcctaccaggagaggaacggtgggtcacaggtagagcccattcagccgctgctcaggactttcaagacccgggaccacccgcacccctccagcatcccgtggtccagcaggctagtgatggttaaatgccatcattatcccaccactggcttgccaggattctgggcgatggtaaagttcgcctgggtgcagtatgtcagcatcctgcttatcttcctctgggtgtttgaaagaatcaagatcttcgtgtttcagaatcaggtggtgaccaccatccctgtgacagtgatgccccagggagaagtgtctttgatttccagagctgaggcctttaactggagacctggaggggcagggcccaagggcaagggccgcattagcacaggcaatcagggagggccgctgaaggacacttggaccgtccacctgccccagcccaacattgggacactgcaccgggtccatgtgtcatccaggtgccgtggccttgggaagggtttggattccaagtcacctcgccgcaaggatgcccccgagaagcccctttcccggcctcaccgggtgtcgcttaatagtcttgggaccttaaggagcaagtcagcccctgcggaccctcccagtgaagagaaagagctggctgtgcggtggaatttggaagagacgacgtttgggagcctttgctga

SEQ ID NO: 60450 - DNA, 423 bp, Homo sapiens
cagacccagtcaggacacagcatggacatgagggtgcccgctcagcgcctggggctcctgctgctctggttcccaggtgccagatgtgccatccggatgacccagtctccattctccctgtctgcatctgtaggagacagagtcaccatcacttgctgggccagtcagggcattagcagttatttagcctggtatcagcaaaaaccagcaaaagcccctaagctcttcatctattatgcatccagtttgcaaagtggggtcccatcaaggttcagcggcagtggatctgggacggattacactctcaccatcagcagcctgcagcctgaagattttgcaacttattactgtcaacagtattatagtacccctcccacagtgttacacacccaaacaaaaacccccagggaaagagatgtgtga

SEQ ID NO: 60451 - DNA, 1272 bp, Homo sapiens; identical to SEQ ID NO: 60449

SEQ ID NO: 60452 - DNA, 418 bp, Homo sapiens
aaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggcttgagctctggctcagtctctactagttactaccccagctggtaccagcagaccccaggccaggctccacgcacgctcatctacagcacaaacactcgctcttctggggtccctgatcgcttctctggctccatccttgggaacaaagctgccctcaccatcacgggggcccaggcagatgatgaatctgattattactgtgtgctgtatatgggtagtggcatttccacagtgatttaa

SEQ ID NO: 60453 - DNA, 6196 bp, Homo sapiens
atgccaagaactggagctcaggatggagcatggatccaaaagcaggttgtttttgaaggtcaaatggcttcaacgtatgaacaggatgaagtcattgctattgatgatatatctttcagttcaggctgcttgcctgccaatgatggaattttactgtgtcaagaagcattgaatgctgagcgggagctatgccatccagatacagatctctgcagatttgatgctacagatgaagagttgagattgtgtcaggcctgtgggtttgaatttgacatgtgtgagtggacgtcagaagcatctgctggccaaatttcctggatgcgcacaaaagcgagagagatccctgcattcgaatccacacctcagcaggatcaaggaggtgatgatgaaggttattatgtatgggtaggcgctaagcatggtttcactcttaaccatttagacagcagggcttacctaaatagctctgtgtgtcattgcctgggcaagagctgtcatcttcaattctattatgcaatggaaagcagtgtcctgagagtaagactgtataataataagatgcgatcaaaagtagtgaaactcaacaacattgactttggtacccttgatttcttcactggaagagaaaagcatagactggcatctctaagagatagagtgttaataaatatgttaaatatttttcttgaaagctttttcaattttactaccaagactttagatttcctagtactttatatcatacaggaagaagaaatattttggacatacaacatatcaactcacagccaatgggtgaaagcagatgtgttaataccagaagatctgaagacatttaagattatttttgaagggactcttttgagccagagaagttttattgcccttgatcacctctgggtctatgcctgtggacagacccaatccagaaagctttgctctgcagacgaattcccttgcactagtggccagtgcatcgccaaagaatctgtctgtgactctcggcaggactgctccgatgagagtgatgaagacccagcaacttgctcaaagcatctcacctgtgactttgagtcgggtttctgcggttgggagccatttctcacagaagattcacactggaagctgatgaaaggattgaataatggagagcaccactttcctgcagctgatcacacagcaaacataaatcatggatcgtttatttatttggaggcacagcgctcccccggggtggccaagcttggaagtcctgttcttacaaaattgctcactgcctctaccccatgtcaggtgcagttttggtatcatttgtctcaacattcaaatctctcagtttttacaagaacgtctctagatggaaacttgcaaaagcagggcaaaataatcagattctccgaatctcagtggagccacgcaaaaattgatctcattgcagaagcgggagaatctactctaccttttcagttaattttggaagctactgttttgtcgtcaaatgctaccgttgctctagatgacatcagtgtgtcccaggaatgtgaaatttcctataaatcactaccaaggaccagtacacaaagcaagttttccaagtgtgactttgaagcaaacagctgtgattggtttgaagcaattagtggtgaccattttgactggatacggagctctcagagtgaactttctgctgattttgagcaccaggctccacctcgggatcatagtctcaacgcatctcaagggcattttatgttcattctgaagaaaagcagcagcttgtggcaagttgctaagcttcagagcccaactttcagccagacaggacctggatgcatactttccttctggttctataactatggcctgtcagtgggagcagctgagctgcagctacatatggaaaattctcatgactcaacagtgatttggagagtattatacaatcagggcaaacaatggttggaggcaaccattcagctagggcgcctttcgcagcccttccatttgtcactagataaagtcagtctgggcatttatgatggggtctcagctattgatgacatccgatttgaaaattgtactctccctcttcctgctgagagctgtgaagggctggatcatttctggtgtcgccacaccagggcttgcatagaaaagcttcggttatgtgatctggtggatgactgtggtgatcgtactgatgaagtcaactgtgcacctgagctgcagtgtaactttgaaactggaatctgtaactgggaacaagatgcaaaagatgactttgattggaccaggaaccagggtccaactccaacacttaacacagggccaatgaaagataacactctgggcacagctaaaggacactatctctacatagaatcttcagagccacaggcttttcaagacagtgctgccttactcagcccaatccttaatgccactgatacaaaaggctgcaccttccgcttctattaccacatgtttggaaagcgcatttataggttggcaatctaccaacgaatctggagtgactcaaggggacagctgctgtggcagatatttgggaatcaaggcaacagatggattaggaaacacctcaacatttccagcaggcagccctttcagatattggtggaggcttcagtgggagatggcttcactggagatattgcgattgatgatctgtcatttatggactgcaccctctaccctggtaatttgccagcagacctcccaactccaccagaaacgtcagttcctgtaacattacctccacacaactgcacagacaatgaatttatctgcaggtctgatggtcactgcattgaaaaaatgcagaaatgtgattttaaatatgactgccctgacaaatcagatgaagcatcctgtgttatggaagtttgcagctttgagaaaagaagcctgtgtaaatggtatcaaccaatcccagtacatttgcttcaagattcaaacacattcaggtgggggcttgggaacgggatcagcattcatcatggggaagaaaaccacaggccatcagtggatcatacacaaaataccactgatggctggtacctgtatgctgacagttctaatgggaaatttggtgacacggctgacattctcactcctatcatttcactcacgggaccaaaatgtaccttggtgttctggacacatatgaatggggccaccgttggttctctccaggtgctcatcaagaaagataacgttacttctaaattgtgggctcaaactggacagcaaggtgcacagtggaagagagcagaagtgtttttaggcattcgttcacatacacagattgtcttcagagccaaacgtggtatcagttacataggagatgtagcagtggatgatatttccttccaagattgctcccctttgcttagcccagagagaaagtgtactgatcatgaattcatgtgtgctaataagcactgcattgccaaagacaagctgtgtgattttgtgaatgattgtgctgataattcagatgagactactttcatttgccgtacctccagtgggcgctgtgatttcgaatttgatctttgttcctggaagcaggagaaagatgaggactttgactggaacctgaaagctagcagcatccctgcagcaggcacagagccagcagcagatcacactttgggaaattcatctggtcattacatctttataaagagtttgtttcctcagcagcccatgagagctgccagaatttcaagtccagttataagtaagagaagcaaaaactgcaagattatttttcattatcacatgtatggaaatggcattggggcactcaccttaatgcaggtgtcagtcacaaaccaaacgaaggttctacttaacctcactgtagaacaaggcaatttctggcggagagaagaactgtcactgtttggtgatgaagacttccaactcaaatttgaaggtagagttgggaaaggtcagcgtggagacattgcacttgatgacattgtgcttacagaaaattgtctatcactccatgattccgtgcaagaagaactggcagtgcctcttccaacaggtttctgcccacttggctatagggaatgtcataatggaaaatgctataggctggaacaaagctgtaacttcgtagataactgtggagataatactggtgaaaataagtgtggtagctcctgtacttttgaaaaaggctggtgtggctggcaaaactcccaggctgacaactttgattgggttttaggggttggctctcatcaaagcttaagacctcccaaagaccacacacttggaaatgaaaatgggcacttcatgtatctggaagctactgcagtgggccttcggggtgacaaagcacacttcaggagtaccatgtggcgagaatccagtgcagcctgcaccatgagcttctggtatttcatatctgcaaaggccacaggatccattcagattctcatcaagacagagaaaggactatcaaaagtatggcaagaaagtaagcagaaccctggtaatcattggcaaaaggctgacatcctgctaggaaagttaaggaattttgaagtcatatttcaaggtatcagaacaagggacctgggaggaggagctgcaattgatgatattgaatttaaaaactgcacaactgtgggagagatctctgagctttgtccggaaatcactgattttttgtgccgggacaagaagtgcattgcatcccaccttctttgtgactataagccagactgctctgataggtctgatgaagctcactgtgcacattatacaagcacaacaggaagctgcaattttgaaacaagttcaggaaactggaccacagcctgcagtcttactcaagactctgaggatgacttggactgggccattggcagcagaattcctgccaaagcattaattccagactctgatcacacgccaggtagtggtcagcacttcctgtacgtcaactcatctggctccaaggaaggatccgttgccagaattactacttccaaatccttcccagcaagccttggaatgtgtactgttcggttctggttctacatgattgatcccaggagtatgggaatattaaaggtgtataccattgaagaatcggggctaaacatcctggtgtggtcagtgattggaaataaaagaacgggatggacatatggctctgtgcctctctccagtaacagtccgtttaaggtggcatttgaagctgatttggatggaaatgaggacatctttattgctcttgatgacatctcttttaccccagagtgtgtgactggaggtcctgtcccagtgcagccatcaccctgtgaagctgatcagttttcttgtatctacacactccaatgtgtccctctctcagggaaatgtgatggacatgaagactgcatagatggatctgatgaaatggattgtcctctcaaccccacccctccactctgtagtaacatggagttcccgtgctctacagacgagtgtataccttccctcctgctatgcgatggagtgcccgactgccactttaatgaagatgagctcatctgctccaacaaaagctgttctaatggagctctggtgtgtgcctcctccaacagctgtatcccagcccaccagcgctgtgatggttttgccgactgcatggatttccagcttgatgagtccagctgctcagatacatggactctcctgggtattggattagcattcctgatgactcacatcacagttgcagtcttgtgttttcttgcaaacagaaaggtaccaataaggaaaaccgagggaagtggtaactgtgcctttgtcaatccagtttacgggaactggagcaacccagagaaaacagagagttctgtctattccttctcaaacccattatatggcacaacatcaggaagcctggagaccctgtcacatcatctcaaatagcagcatcgagaccaagtctgatccaacatgtgtagtttctagaaaattgaagtctccacaatctgatagaaactcatcttctacaatggtaaaaagagaaaggattgtaaatgccagtgtaattataacatttatgaatgaattttcttgcagaatatagagaatgtttatatggaatcagaatcagtaccttatcttcactgaacatctgaatattttaataaaatttctattt

SEQ ID NO: 60454 - DNA, 5244 bp, Homo sapiens
aacccagcaaaatggggatctccacagtcatccttgaaatgtgtcttttatggggacaagttctatctacaggtgggtggatcccaaggactacagactacgcttcactgattccctcggaggtgcccttggatacaactgtagcagaaggttctccatttccctcggagttgaccctggagtcaactgtagcagaaggttctccgatttccttggagtcaaccctggagtcaactgtagcagaaggttctctgattccctcagagtcaaccctggagtcaactgtagcagaaggatctgattctggtttggccctgaggctggtgaatggagatggcaggtgtcagggccgagtggagatcctataccgaggctcctggggcaccgtgtgtgatgacagctgggacaccaatgatgccaacgtggtctgtaggcagctgggttgtggctgggccatgtcagctccaggaaatgcctggtttggccagggctcaggacccattgccctggatgatgtgcgctgctcaggacacgaatcctacctgtggagctgcccccacaatggctggctctcccataactgtggccatggtgaagatgctggtgttatctgctcagctgcccagcctcagtcaacactcaggccagaaagttggcctgtcaggatatcaccacctgtacccacagaaggatctgaatccagtttggccctgaggctggtgaatggaggcgacaggtgtcgaggccgagtggaggtcctataccgaggctcctggggcaccgtgtgtgatgactactgggacaccaatgatgccaatgtggtctgcaggcagctgggctgtggctgggccatgtcagccccaggaaatgcccagtttggccagggctcaggacccattgtcctggatgatgtgcgctgctcaggacacgagtcctacctgtggagctgcccccacaatggctggctcacccacaactgtggccatagtgaagacgctggtgtcatctgctcagctccccagtcccggccgacacccagcccagatacttggccgacctcacatgcatcaacagcaggatctgaatccagtttggccctgaggctggtgaatggaggtgacaggtgtcagggccgagtggaggtcctataccgaggctcctggggcaccgtgtgtgatgatagctgggacaccagtgacgccaatgtggtctgccggcagctgggctgtggctgggccacgtcagccccaggaaatgcccggtttggccagggttcaggacccattgtcctggatgacgtgcgctgctcaggctatgagtcctacctgtggagctgcccccacaatggctggctctcccataactgtcagcacagtgaagacgctggtgtcatctgctcagctgcccactcctggtcgacgcccagtccagacacattgccgaccatcaccttgcctgcatcgacagtaggatctgaatccagtttggccctgaggctggtgaatggaggtgacaggtgtcagggccgagtggaggtcctataccaaggctcctggggcaccgtgtgcgatgacagctgggacaccaatgatgccaatgtcgtctgcaggcaactgggctgtggctgggccatgtcagccccaggaaatgcccggtttggtcagggctcaggacccattgtcctggatgatgtgcgctgctcaggacacgagtcttacctgtggagctgcccccacaatggctggctctcccacaactgtggccatagtgaagacgctggtgtcatctgctcagcttcccagtcccggccaacacctagtccaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccacgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctctcgtgcatcaacagcaggatctgaatccactttggccctgagactggtgaatggaggtgacaggtgtcgaggccgagtggaggtcctataccaaggctcctggggcaccgtgtgtgatgactactgggacaccaatgatgccaacgtggtctgcaggcagctgggctgtggctgggccatgtcagccccaggaaatgcccagtttggccagggctcaggacccattgtcctggatgatgtgcgctgctcaggacacgagtcttacctgtggagctgcccccacaatggctggctctcccacaactgtggccatcatgaagatgctggtgtcatctgctcagctgctcagtcccagtcaacgcccaggccaggatctgaatccagtttggctctgaggctggtgaatggaggtgacaggtgtcgaggccgagtggaggtcctgtatcgaggctcctggggaaccgtgtgtgatgacagctgggacaccaatgatgccaatgtggtctgcaggcagctgggctgtggctgggccatgtcggccccaggaaatgcccggtttggccagggctcaggacccattgtcctggatgatgtgcgctgctcagggaatgagtcctacctgtggagctgcccccacaaaggctggctcacccacaactgtggccatcacgaagacgctggtgtcatctgctcagccacccaaataaattctactacgacagattggtggcatccaacaactacaaccactgcaagaccctcttcaaattgtggtggcttcttattctatgccagtgggacattctccagcccatcctaccctgcatactaccccaacaatgctaagtgtgtttgggaaatagaagtgaattctggttatcgcataaacctgggcttcagtaatctgaaattggaggcacaccataactgcagttttgattatgttgaaatctttgatggatcattgaatagcagtctcctgctggggaaaatctgtaatgataccaggcaaatatttacatcttcttacaaccgaatgaccattcactttcgaagtgacatcagtttccaaaacactggctttttggcttggtataactccttcccaagcgatgccaccttgaggttggtcaatttaaattcatcctatggtctatgtgccgggcgtgtagaaatttaccatggtggcacctgggggacagtttgtgatgactcctggaccattcaggaagctgaggtggtctgcagacagctagggtgtggacgtgcagtttcagcccttggaaatgcatattttggctctggctctggccccatcaccctggacgatgtagagtgctcagggacggaatccactctctggcagtgccggaaccgaggctggttctcccacaactgtaatcatcgtgaagatgctggtgtcatctgctcaggaaaccatctatcgacacctgctccttttctcaacatcacccgtccaaacacagattattcctgcggaggcttcctatcccaaccatcaggggacttttccagcccattctatcccgggaactatccaaacaatgccaagtgtgtgtgggacattgaggtgcaaaacaactaccgtgtgactgtgatcttcagagatgtccagcttgaaggtggctgcaactatgattatattgaagttttcgatggcccctaccgcagttcccctctcattgctcgagtttgtgatggggccagaggctccttcacttcttcctccaacttcatgtccattcgcttcatcagtgaccacagcatcacaaggagagggttccgggctgagtactactccagtccctccaatgacagcaccaacctgctctgtctgccaaatcacatgcaagccagtgtgagcaggagctatctccaatccttgggcttttctgccagtgaccttgtcatttccacctggaatggatactacgagtgtcggccccagataacgccgaacctggtgatattcacaattccctactcaggctgcggcaccttcaagcaggcagacaatgacaccatcgactattccaacttcctcacagcagctgtctcaggtggcatcatcaagaggaggacagacctccgtattcacgtcagctgcagaatgcttcagaacacctgggtcgacaccatgtacattgctaatgacaccatccacgttgctaataacaccatccaggtcgaggaagtccagtatggcaattttgacgtgaacatttccttttatacttcctcatctttcttgtatcctgtgaccagccgcccttactacgtggacctgaaccaggacttgtacgttcaggctgaaatcctccattctgatgctgtactgaccttgtttgtggacacctgcgtggcatcaccatactccaatgacttcacgtctttgacttatgatctaatccggagtggatgcgtgagggatgacacctacggaccctactcctcgccatctcttcgcattgcccgcttccggttcagggccttccacttcctgaaccgcttcccctccgtgtacctgcgttgtaaaatggtggtgtgcagagcgtatgacccctcttcccgctgctaccgaggctgtgtgttgaggtcgaagagggatgtgggctcctaccaggaaaaggtggacgtcgtcctgggtcccatccagctgcagacccccccacgccgagaagaggagcctcggtaggtggtcgctctcagaccccactgtccaccggggcgcagacccctgactcggggacttgggatgttcctcttggtgtcatattccaactcagattgagccctacattgtgctgcacctggtcatacggagttgaatcagacctggttcccgcctcccccaaggctcatggtccttggaggacccgttgcagggcgaggtcaagagagttctgacctggatggcccatagacctgacgtcccagaatccatgcttctcatctgcaaaatgaaaatgtcaatacttacttcttagcactgttgagagggttacttacataaaggaattttggtgaaa

SEQ ID NO: 60455 - DNA, 597 bp, Homo sapiens
cccaggtgttttcatttggtgatcagcactgaacacagaagagtcatgatggagtttgggctgagctgggttttccttgttgctatttttaaaggtgtccagtgtgaggtgcagctggtggagtctggggaaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcagactctgtgaagggcagattcaccatctccagagacaattccaagaacacgctgtatcttcaaatgggcagcctgagagctgaggacatggctgtgtattactgtgcgagagacacagaagatgtttttgctgtggtcaaaattccagacctcaagcccttttcttggcgctcaggtgggtctcaggctgtggctgctgcagtcacgcaggagagtctggtgggactttcttcactcttcgtcactcaggaccctccactgtgttgcatggagactcatctggaaatgcaagttgccagtgggaactga

SEQ ID NO: 60456 - DNA, 393 bp, Homo sapiens
atgttaagaggaaagcctaagaatttggatgaaattctaacacattttcacacaagtttttattggcacaagggactcctgggtctgagtaatgcaacagtggaatggcatattccagacactgcccagcctggaatctacagaataagatattttggacacaatcggaagcaggacattctgaagcctgctgtcatactttcatttgaaggcacttccccggcttttgaagttgtaactatttagtgaaaagttgatagatcatttaaagaacagctttactctctacacattatataagtgatttcaaatgaatgtgaactagtgaactaccatgttgacttctataatcgtccctgtttggggacagatagtttactgctaatggggtgg

SEQ ID NO: 60457 - DNA, 2050 bp, Homo sapiens
ctggtacatgacagctgtgtctcgatggagtagactctcagaacagcgcagtttgccctccgctcacgcagagcctctccgtggcttccgcaccttgagcattaggccagttctcctcttctctctaatccatccgtcacctctcctgtcatccgtttccatgccgtgaggtccattcacagaacacatccatggctctcatgctcagtttggttctgagtctcctcaagctgggatcagggcagtggcaggtgtttgggccagacaagcctgtccaggccttggtgggggaggacgcagcattctcctgtttcctgtctcctaaaaccaatgcagaggccatggaagtgcggttcttcaggggccagttctctagcgtggtccacctctacagggacgggaaggaccagccatttatgcagatgccacagtatcaaggcaggacaaaactggtgaaggattctattgcggaggggcgcatctctctgaggctggaaaacattactgtgttggatgctggcctctatgggtgcaggattagttcccagtcttactaccagaaggccatctgggagctacaggtgtcagcactgggctcagttcctctcatttccatcacgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggagatacctttttcgagcctatatcgtggcacctggctaccaaagtactgggaatactctgctgtggcctattttttggcattgttggactgaagattttcttctccaaattccagtggaaaatccaggcggaactggactggagaagaaagcacggacaggcagaattgagagacgcccggaaacacgcagtggaggtgactctggatccagagacggctcacccgaagctctgcgtttctgatctgaaaactgtaaccgagagaaaagctccccaggaggtgcctcactctgagaagagatttaaaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagatccaaagtcccgcagcagccggccaaggtggcttccagatgaagggggactggcctgtccacatgggagtcaggtgtcatggctgccctgagctgggagggaagaaggctgacattacatttagtttgctctcactccatctggctaagtgatcttgaaataccacctctcaggtgaagaaccgtcaggaattcccatctcacaggctgtggtgtagattaagtagacaaggaatgtgaataatgcttagatcttattgatgacagagtgtatcctaatggtttgttcattatattacacttt

SEQ ID NO: 60458 - DNA, 1400 bp, Homo sapiens
aggagaagaacgccgggagcatatcctgttccatgcggcatgctcatctgagccgagaggtggaatccagggtacagataggagatacctttttcgagcctatatcgtggcacctggctaccaaagtactgggaatactctgctgtggcctattttttggcattgttggactgaagattttcttctccaaattccagtgtaagcgagagagagaagcatgggccggtgccttattcatggttccagcagggacaggatcagagatgctcccacatccagctgcttctcttcttctagtcctagcctccaggggcccaggcccaaaaaaggaaaatccaggcggaactggactggagaagaaagcacggacaggcagaattgagagacgcccggaaacacgcagtggaggtgactctggatccagagacggctcacccgaagctctgcgtttctgatctgaaaactgtaaccgagagaaaagctccccaggaggtgcctcactctgagaagagatttaaaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagatccaaagtcccgcagcagccggccaaggtggcttccagatgaagggggactggcctgtccacatgggagtcaggtgtcatggctgccctgagctgggagggaagaaggctgacattacatttagtttgctctcactccatctggctaagtgatcttgaaataccacctctcaggtgaagaaccgtcaggaattcccatctcacaggctgtggtgtagattaagtagacaaggaatgtgaataatgcttagatcttattgatgacagagtgtatcctaatggtttgttcattatattacacttt

SEQ ID NO: 60459 - DNA, 2180 bp, Homo sapiens
ctggtacatgacagctgtgtctcgatggagtagactctcagaacagcgcagtttgccctccgctcacgcagagcctctccgtggcttccgcaccttgagcattaggccagttctcctcttctctctaatccatccgtcacctctcctgtcatccgtttccatgccgtgaggtccattcacagaacacatccatggctctcatgctcagtttggttctgagtctcctcaagctgggatcagggcagtggcaggtgtttgggccagacaagcctgtccaggccttggtgggggaggacgcagcattctcctgtttcctgtctcctaaaaccaatgcagaggccatggaagtgcggttcttcaggggccagttctctagcgtggtccacctctacagggacgggaaggaccagccatttatgcagatgccacagtatcaaggcaggacaaaactggtgaaggattctattgcggaggggcgcatctctctgaggctggaaaacattactgtgttggatgctggcctctatgggtgcaggattagttcccagtcttactaccagaaggccatctgggagctacaggtgtcagcactgggctcagttcctctcatttccatcacgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggagatacctttttcgagcctatatcgtggcacctggctaccaaagtactgggaatactctgctgtggcctattttttggcattgttggactgaagattttcttctccaaattccagtgtaagcgagagagagaagcatgggccggtgccttattcatggttccagcagggacaggatcagagatgctcccacatccagctgcttctcttcttctagtcctagcctccaggggcccaggcccaaaaaaggaaaatccaggcggaactggactggagaagaaagcacggacaggcagaattgagagacgcccggaaacacgcagtggaggtgactctggatccagagacggctcacccgaagctctgcgtttctgatctgaaaactgtaaccgagagaaaagctccccaggaggtgcctcactctgagaagagatttaaaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagatccaaagtcccgcagcagccggccaaggtggcttccagatgaagggggactggcctgtccacatgggagtcaggtgtcatggctgccctgagctgggagggaagaaggctgacattacatttagtttgctctcactccatctggctaagtgatcttgaaataccacctctcaggtgaagaaccgtcaggaattcccatctcacaggctgtggtgtagattaagtagacaaggaatgtgaataatgcttagatcttattgatgacagagtgtatcctaatggtttgttcattatattacacttt

SEQ ID NO: 60460 - DNA, 3996 bp, Homo sapiens
atttttctttgagacagtgtcttgctctgtcgcccaggctggagtgcagtggctcgatctcagctcactgcaacctccgcctccaaggctcaagcgatcgttccgcctcagcctccagagtagctgggaccacagggaccacaggcgcccgccacgacgctggcattgattgattgattgattgattgagagagaggtagcctccctgtgttgcccaggctggtcttgaactgctgggctcaagcaatcctcctgccttggactcccaaaatactgggattacaggcgtgagccaccgtgcctggctaattttcttcctttcttttttttcctgcgagacggtgggcgggggtatctccctaagttgcccaggctggtcttgaactcctgggctcaagcgatcctcccgcctcagcctcccaaagggctgggattacaggcatgagccaccgcttcctgccaaaagagggctttagggcacccccagaacctgagatctccctcatctgtcatctttaaagagaaggaagtcgactcccagtcgagccatagtccatttgtcccgggcacggtgactccggggtggccaggaccaaatgtgtctccttctggcttttgcaccgcaccaactaatccgcggcaggccgcacagctgccctggccttcgcggaggactaaggcgagggcggtgtacgctgctccggagtcccaccgcgggagttgaggcagcggattccgagggcagggtggggcggaatcgggagggatgcggacccggtggaacgcactgcgcagacggcgccggcgcccgcacacagctgttgactagtcttccagctctcccctggaagtcgtccaggcgccggtctcttttttctgcctttttgtttccctccccgcgagtcggcgcgacggtgaatttccgtttccggcggtgtggaagcggacctgaggagtcgcaattgtgaacaggctcagcgatatgaggcagcatcgacaatttatggaccgcacgcattatctgcttacattcagctcttcagaaaccttgctaaggctattgctacggacatggtagccaacctgagcagaggtccagaacctccctttttcaaacaattaatagttccattaattcctagtattgtggatagagcaccaaaaggcagaactttcggggatgtcctgcagccagcaaaacctgaatacagagtgggggaagttgctgaagttatatttgtaggtgctaacccgaagaattcagtacaaaaccagacccatcagaccttcctcactgtggagaaatatgaggctacttcaacatcgtggcagatagtgtgtaatgatgcctcctgggagactcgtttttattggcacaagggactcctgggtctgagtaatgcaacagtggaatggcatattccagacactgcccagcctggaatctacagaataagatattttggacacaatcggaagcaggacattctgaagcctgctgtcatactttcatttgaaggcacttccccggcttttgaagttgtaactatttagtgaaaagttgatagatcatttaaagaacagctttactctctacacattatataagtgatttcaaatgaatgtgaactagtgaactaccatgttgacttctataatcgtccctgtttggggacagatagtttactgctaatggggtggaggggtgtgtgtgtgtgtgtgtgtgtgtgtgtgtgtgtgtgtgtgtgtgtatgtgagagagagagagagagagagaggtttgtcccatatatcttgttccagcagccatatatcttgtggtctacagcctaaagcatgatttcccttgaagtcttggggttgtttaaaggagagtcccttcaatataaaacctctgaaatattagtgagaatggctcactaatgtgaacaatgtttaaattatttatttatatatagaattactgaatattagtactgggaaaatttatagaaatcatctagtcttacccttcatcttacatataagaaaaatggtcttttcttctaatcacatttacaaaatatgatataaaccttgaccatgaatgtatgagcctaattagagaaacagaaaatcagcatgtcagttttccttcattcaaaataacatagtctttctaagcagtcattctggagttaacatgcctagttcagagccgctgtggatgctcaaatcatttctggaattgccttcaggacacaattatgagaaagtcagacttccaatattttgatcatgccttgtgtcttcctaagtgtccttatcccactggattgtgtctcttactcccaagacttattccaaatgattttttgactcttttcattaatcaaattcaccccaaaccagaaagttttgccattagcgtagatattaaaaatattactggctgggaaagcactcctcaaagcagaggttctaaattaatttatctgttcttttaccatttgctcactcactcactcatggacccattcaatcatagaatatttaagatttatatgcccagaattataatagtgcctaggccttgataattagtgaatttgtacttggggtgaatgtgtaagtgtcaaaaggtaactattatgaaggagaaaataatcgatttaatatgtaaattctggggaggcatttaaaaaatcagtaatcttcaagttatatcttgtgtatcatctgtgttggatactctaatttggggggaaagaggctccagacagtttgctaaatactattttgaaagttatttttgggcattgtaaaataccttgcttcataccccaaagaataagatatgacaatctgacatcgattgtctgaaagtactaattgcatttaaaattctttaagttaactacaacctcccagactgcaaagcaaatttccaaaccccaggtcatacttttgtatgtatgtaaaagctttagcattttagggaaaaaaatcaatctgtatttcaaaaataaactttgaggtttgaaaataataacaatattcataatggtagtattaacatctattatgtataacttaatctcaacataatttattgaattagaatgaacctggaacactttttgatgaattggtatcctagaggctgtttccttgggccttaactgctggaggattaggtaatcagggattccaagtgttgtgatcttttttctgatgacgccacagtcttcagtgtaaaagttcagaagcctaaaagaacaagtgatcctgaaagtagctgattccagacaagaaaattatattagaactcatgatatggttttttaaagtatttgttattactcagaagggttcatgaatcagtttccactacctctattccttctattgaagctttcctcaaatctacttgtgattcctgatagctcactggcaactgtaccaaggtggccactgtatcatctactgatccttctgcacctagcactcttggctccagataacgcacagaaacctattttctcaccagctgtcatttcttctagggcatgcagttctatgttcacagttcatgtgtaaaaataaaaccaaattcctggattatcaatatcagttctttacctgtgcataaaagaatatcatgaagtaattgaacttatctgttgatataaaaacacagatccaattcgtgtctgtggatgctgcaaggactggctcactggagccaaaccatgtggcggaaactcctgaaattggtggaaaaagtggaatatggcagattgggtaggtaggagaacaattttggagattttgtttctcatgttaaagtgtctgcattttatttgctgtaccctgcctactctggttttaaggattttttgacttcttcgaaaagcactgaataatctctttgccgggtctagattttttgatgagtactgtgtaaaattgtcaatattcaatggattatttaataataaattaagaattacactc

SEQ ID NO: 60461 - DNA, 3004 bp, Homo sapiens
tggaagcggacctgaggagtcgcaattgtgaacaggttcggtgctgcggctggggctcagcgatatgaggcagcatcgacaatttatggaccgcacgcattatctgcttacattcagctcttcagaaaccttgctaaggctattgctacgtattgtggatagagcaccaaaaggcagaactttcggggatgtcctgcagccagcaaaacctgaatacagagtgggggaagttgctgaagttatatttgtaggtgctaacccgaagaattcagtacaaaaccagacccatcagaccttcctcactgtggagaaatatgaggctacttcaacatcgtggcagatagtgtgtaatgatgcctcctgggagactcgtttttattggcacaagggactcctgggtctgagtaatgcaacagtggaatggcatattccagacactgcccagcctggaatctacagaataagatattttggacacaatcggaagcaggacattctgaagcctgctgtcatactttcatttgaaggcacttccccggcttttgaagttgtaactatttagtgaaaagttgatagatcatttaaagaacagctttactctctacacattatataagtgatttcaaatgaatgtgaactagtgaactaccatgttgacttctataatcgtccctgtttggggacagatagtttactgctaatggggtggaggggtgtgtgtgtgtgtgtgtgtgtgtgtgtgtgtgtgtgtgtgtgtgtatgtgagagagagagagagagagagaggtttgtcccatatatcttgttccagcagccatatatcttgtggtctacagcctaaagcatgatttcccttgaagtcttggggttgtttaaaggagagtcccttcaatataaaacctctgaaatattagtgagaatggctcactaatgtgaacaatgtttaaattatttatttatatatagaattactgaatattagtactgggaaaatttatagaaatcatctagtcttacccttcatcttacatataagaaaaatggtcttttcttctaatcacatttacaaaatatgatataaaccttgaccatgaatgtatgagcctaattagagaaacagaaaatcagcatgtcagttttccttcattcaaaataacatagtctttctaagcagtcattctggagttaacatgcctagttcagagccgctgtggatgctcaaatcatttctggaattgccttcaggacacaattatgagaaagtcagacttccaatattttgatcatgccttgtgtcttcctaagtgtccttatcccactggattgtgtctcttactcccaagacttattccaaatgattttttgactcttttcattaatcaaattcaccccaaaccagaaagttttgccattagcgtagatattaaaaatattactggctgggaaagcactcctcaaagcagaggttctaaattaatttatctgttcttttaccatttgctcactcactcactcatggacccattcaatcatagaatatttaagatttatatgcccagaattataatagtgcctaggccttgataattagtgaatttgtacttggggtgaatgtgtaagtgtcaaaaggtaactattatgaaggagaaaataatcgatttaatatgtaaattctggggaggcatttaaaaaatcagtaatcttcaagttatatcttgtgtatcatctgtgttggatactctaatttggggggaaagaggctccagacagtttgctaaatactattttgaaagttatttttgggcattgtaaaataccttgcttcataccccaaagaataagatatgacaatctgacatcgattgtctgaaagtactaattgcatttaaaattctttaagttaactacaacctcccagactgcaaagcaaatttccaaaccccaggtcatacttttgtatgtatgtaaaagctttagcattttagggaaaaaaatcaatctgtatttcaaaaataaactttgaggtttgaaaataataacaatattcataatggtagtattaacatctattatgtataacttaatctcaacataatttattgaattagaatgaacctggaacactttttgatgaattggtatcctagaggctgtttccttgggccttaactgctggaggattaggtaatcagggattccaagtgttgtgatcttttttctgatgacgccacagtcttcagtgtaaaagttcagaagcctaaaagaacaagtgatcctgaaagtagctgattccagacaagaaaattatattagaactcatgatatggttttttaaagtatttgttattactcagaagggttcatgaatcagtttccactacctctattccttctattgaagctttcctcaaatctacttgtgattcctgatagctcactggcaactgtaccaaggtggccactgtatcatctactgatccttctgcacctagcactcttggctccagataacgcacagaaacctattttctcaccagctgtcatttcttctagggcatgcagttctatgttcacagttcatgtgtaaaaataaaaccaaattcctggattatcaatatcagttctttacctgtgcataaaagaatatcatgaagtaattgaacttatctgttgatataaaaacacagatccaattcgtgtctgtggatgctgcaaggactggctcactggagccaaaccatgtggcggaaactcctgaaattggtggaaaaagtggaatatggcagattgggtaggtaggagaacaattttggagattttgtttctcatgttaaagtgtctgcattttatttgctgtaccctgcctactctggttttaaggattttttgacttcttcgaaaagcactgaataatctctttgccgggtctagattttttgatgagtactgtgtaaaattgtcaatattcaatggattatttaataataaattaagaattacactc

SEQ ID NO: 60462 - DNA, 3066 bp, Homo sapiens
tgaggagtcgcaattgtgaacaggttcggtgctgcggctggggctcagcgatatgaggcagcatcgacaatttatggaccgcacgcattatctgcttacattcagctcttcagaaaccttgctaaggctattgctacggacatggtagccaacctgagcagaggtccagaacctccctttttcaaacaattaatagttccattaattcctagtattgtggatagagcaccaaaaggcagaactttcggggatgtcctgcagccagcaaaacctgaatacagagtgggggaagttgctgaagttatatttgtaggtgctaacccgaagaattcagtacaaaaccagacccatcagaccttcctcactgtggagaaatatgaggctacttcaacatcgtggcagatagtgtgtaatgatgcctcctgggagactcgtttttattggcacaagggactcctgggtctgagtaatgcaacagtggaatggcatattccagacactgcccagcctggaatctacagaataagatattttggacacaatcggaagcaggacattctgaagcctgctgtcatactttcatttgaaggcacttccccggcttttgaagttgtaactatttagtgaaaagttgatagatcatttaaagaacagctttactctctacacattatataagtgatttcaaatgaatgtgaactagtgaactaccatgttgacttctataatcgtccctgtttggggacagatagtttactgctaatggggtggaggggtgtgtgtgtgtgtgtgtgtgtgtgtgtgtgtgtgtgtgtgtgtgtatgtgagagagagagagagagagagaggtttgtcccatatatcttgttccagcagccatatatcttgtggtctacagcctaaagcatgatttcccttgaagtcttggggttgtttaaaggagagtcccttcaatataaaacctctgaaatattagtgagaatggctcactaatgtgaacaatgtttaaattatttatttatatatagaattactgaatattagtactgggaaaatttatagaaatcatctagtcttacccttcatcttacatataagaaaaatggtcttttcttctaatcacatttacaaaatatgatataaaccttgaccatgaatgtatgagcctaattagagaaacagaaaatcagcatgtcagttttccttcattcaaaataacatagtctttctaagcagtcattctggagttaacatgcctagttcagagccgctgtggatgctcaaatcatttctggaattgccttcaggacacaattatgagaaagtcagacttccaatattttgatcatgccttgtgtcttcctaagtgtccttatcccactggattgtgtctcttactcccaagacttattccaaatgattttttgactcttttcattaatcaaattcaccccaaaccagaaagttttgccattagcgtagatattaaaaatattactggctgggaaagcactcctcaaagcagaggttctaaattaatttatctgttcttttaccatttgctcactcactcactcatggacccattcaatcatagaatatttaagatttatatgcccagaattataatagtgcctaggccttgataattagtgaatttgtacttggggtgaatgtgtaagtgtcaaaaggtaactattatgaaggagaaaataatcgatttaatatgtaaattctggggaggcatttaaaaaatcagtaatcttcaagttatatcttgtgtatcatctgtgttggatactctaatttggggggaaagaggctccagacagtttgctaaatactattttgaaagttatttttgggcattgtaaaataccttgcttcataccccaaagaataagatatgacaatctgacatcgattgtctgaaagtactaattgcatttaaaattctttaagttaactacaacctcccagactgcaaagcaaatttccaaaccccaggtcatacttttgtatgtatgtaaaagctttagcattttagggaaaaaaatcaatctgtatttcaaaaataaactttgaggtttgaaaataataacaatattcataatggtagtattaacatctattatgtataacttaatctcaacataatttattgaattagaatgaacctggaacactttttgatgaattggtatcctagaggctgtttccttgggccttaactgctggaggattaggtaatcagggattccaagtgttgtgatcttttttctgatgacgccacagtcttcagtgtaaaagttcagaagcctaaaagaacaagtgatcctgaaagtagctgattccagacaagaaaattatattagaactcatgatatggttttttaaagtatttgttattactcagaagggttcatgaatcagtttccactacctctattccttctattgaagctttcctcaaatctacttgtgattcctgatagctcactggcaactgtaccaaggtggccactgtatcatctactgatccttctgcacctagcactcttggctccagataacgcacagaaacctattttctcaccagctgtcatttcttctagggcatgcagttctatgttcacagttcatgtgtaaaaataaaaccaaattcctggattatcaatatcagttctttacctgtgcataaaagaatatcatgaagtaattgaacttatctgttgatataaaaacacagatccaattcgtgtctgtggatgctgcaaggactggctcactggagccaaaccatgtggcggaaactcctgaaattggtggaaaaagtggaatatggcagattgggtaggtaggagaacaattttggagattttgtttctcatgttaaagtgtctgcattttatttgctgtaccctgcctactctggttttaaggattttttgacttcttcgaaaagcactgaataatctctttgccgggtctagattttttgatgagtactgtgtaaaattgtcaatattcaatggattatttaataataaattaagaattacactc

SEQ ID NO: 60463 - DNA, 4292 bp, Homo sapiens
atggactctgagaaatcttctgagtggcggagtgatgtcctgaacagactgcagagtaaatatggctccctgtacagaagagataatgtcatcctgagtggcactcacactcattcaggtcctgcaggatatttccagtataccgtgtttgtaattgccagtgaaggatttagcaatcaaacttttcagcacatggtcactggtatcttgaagagcattgacatagcacacacaaatatgaaaccaggcaaaatcttcatcaataaaggaaatgtggatggtgtgcagatcaacagaagtccgtattcttaccttcaaaatccgcagtcagagagagcaaggtattcttcaaatacagacaaggaaatgatagttttgaaaatggtagatttgaatggagatgacttgggccttatcagctggtttgccatccacccggtcagcatgaacaacagtaaccatcttgtaaacagtgacaatgtgggctatgcatcttacctgcttgagcaagagaagaacaaaggatatctacctggacaggggccatttgtagcagccttttcttcatcaaacctaggagatgtgtcccccaacattcttggaccacgttgcatcaacacaggagagtcctgtgataacgccaatagcacttgtcccattggtgggcctagcatgtgcattgctaagggacctggacaggatatgtttgacagcacacaaattataggacgggccatgtatcagagagcaaaggaactctatgcctctgcctcccaggaggtaacaggaccactggcttcagcacaccagtgggtggatatgacagatgtgactgtctggctcaattccacacatgcatcaaaaacatgtaaaccagcattgggctacagttttgcggctggcactattgatggagttggaggcctcaattttacacaggggaaaacagaaggggatccattttgggacaccattcgggaccagatcctgggaaagccatctgaagaaattaaagaatgtcataaaccaaagcccatccttcttcacaccggagaactatcaaaacctcacccctggcatccagacattgttgatgttcagattattacccttgggtccttggccataactgccatccccggggagtttacgaccatgtctggacgaagacttcgagaggcagttcaagcagaatttgcatctcatgggatgcagaacatgactgttgttatttcaggtctatgcaacgtctatacacattacattaccacttatgaagaataccaggctcagcgatatgaggcagcatcgacaatttatggaccgcacacattatctgcttacattcagctcttcagaaaccttgctaaggctattgctacggacacggtagccaacctgagcagaggtccagaacctccctttttcaaacaattaatagttccattaattcctagtattgtggatagagcaccaaaaggcagaactttcggggatgtcctgcagccagcaaaacctgaatacagagtgggggaagttgctgaagttatatttgtaggtgctaacccgaagaattcagtacaaaaccagaaccatcagaccttcctcactgtggagaaatatgaggctacttcaacatcgtggcagatagtgtgtaatgatgcctcctgggagactcgtttttattggcacaagggactcctgggtctgagtaatgcaacagtggaatggcatattccagacactgcccagcctggaatctacagaataagatattttggacacaatcggaagcaggacattctgaagcctgctgtcatactttcatttgaaggcacttccccggcttttgaagttgtaactatttagtgaaaagttgatagatcatttaaagaacagctttactctctacacattatataagtgatttcaaatgaatgtgaactagtgaactaccatgttgacttctataatcgtccctgtttggggacagatagtttactgctaatggggtggaggggtgtgtgtgtgtgtgtgtgtgtgtgtgtagagagagagagagagagagagagaggtttgtcccgtatatcttgctccagcagccatatatcttgtggtctacagcctaaagcatgatttcccttgaagtcttggggttgtttaaaggagagtcccttcaatataaaacctctgaaatattagtgagaatggctcactaatgtgaacaatgtttaaattatttatttatatatagaattactgaatattagtactgggaaaatttatagaaatcatctagtcttacccttcatcttacatataagaaaaatggtcttttcttctaatcacatttacaaaatatgatataaaccttgaccatgaatgtatgagcctaattagagaaacagaaaatcagcatgtcagttttccttcattcaaaataacatagtctttctaagcagtcattctggagttaacatgcctagttcagagccgctgtggatgctcaaatcatttctggaattgccttcaggacacaattatgagaaagtcagacttccaatattttgatcatgccttgtgttttcctaagtgtccttatcccactggattgtgtctcttactcccaagacttattccaaatgattttttgagtcttttcattaatcaaattcaccccaaaccagaaagttttgccattagcgtagatattaaaaatattactggctgggaaagcactcctcaaagcagaggttctaaattaatttatctgttcttttaccatttgctcactcactcactcatggacccattcaatcatagaatatttaagatttatatgcccagaattataatagtgcctaggccttgataattagtgaatttgtacttggggtgaatgtgtaagtgtcaaaaggtaactattatgaaggagaaaataatcgatttaatatgtaaattctggggaggcatttaaaaaatcagtaatcttcaagttatatcttgtgtatcatctgtgttggatactctaatttggggggaaagaggctccagacagtttgctaaatactattttgaaagttatttttgggcattgtaaaataccttgcttcataccccaaagaataagatatgacagtctgacatcgattgtctgaaagtactaattgcatttaaaattctttaagttaactacaagctcccagactgcaaagcaaatttccaaaccccaggtcatacttttgtatgtatgtaaaagctttagcattttagggaaaaaaatcaatctgtattttaaaaataaactttgaggtttgaaaataataacaatattcataatggtagtattaacatctattatgtataacttaatctcaacataatttattgaattagaatgaacctggaacactttttgatgaattggtatcctagaggctgtttccttgggcattaactgctggaggattaggtaatcagggattccaagtgttgtgatcttttttctaatgacgccacagtcttcagtgtaaaagttcagaagcctaaaagaacaagtgatcctgaaagtagctgattccagacaagaaaattatattagaactcatgatatggttttttaaagtatttgttattactcagaagggttcatgaatcagtttccactacctctattccttctattgaagctttcctcaaatctacttgtgattcctgatagctcactggcaactgtaccaaggtggccactgtatcatctactgatccttctgcacctagcactcttggctccagataacgcacagaaacctattttctcaccagctgtcatttcttctagggcatgcagttctatgttcgcagttcatgtgtaaaaacaaaaccaaattcctggattatcaatatcagttctttacctgtgcataaaagaatatcatgaagtaattgaacttatctgttgatataaaaacacagatccaattcatgtctgtggatgctgcagggactggctcactggagccaaaccatgtggcagaaactcctgaaattggtggaaaaagtggaatatggcagattgggtaggtaggagaacaattttggagattttgtttctcatgttaaaatgtctgcattttatttgctgtaccctgcctactctggttttaaggattttttgacttctttgaaaagcactgaataatctcttttccaggtctagattttttgatgagtactgtgtaaaattgtcaatattcaatggattatttaataataaattaagaattacactc

SEQ ID NO: 60464 - DNA, 3495 bp, Homo sapiens
atggcaaatgcgatgggccatcactccttgctgacattacgtcatgcttttgccggcaggctgagcttggaagcagacccttcccaagacgagcctccagaggagaacccagccctggccaacactttgatcgcagccttgaagaggactcagctaagccctgtccagattcctggcccacagaaacttgggagggcagaaggcatcaatcctcagggccacaccaggagcctccgatgcaccctggaagtccagcagcgcagggccccttctgccgggggccttgagagagagaagcctagagaaatacaggtctgcatcagtgtgacagcaggtacagggaaagccacagaagggacggggctcaatgtctgctgctgcgtcgcctccctcatcactcccgctccatttgtgttggccagggggctcttacctctagcccaggctcctctctggttcccagcttcaaagagggagtcccaggttcttggcagcttgcttttcctcaggatggcttctggaaggctcattaagttcgtggtttttgagctcctagagtttgccgctttctccatccccacactcgtgatcacagaacagtttgccaccgcctaccaaggaacaagggctagatctgacaacacacactactggctgatcatctcctgttctattgcctatgttgcgttagtgactctactgatctgggttcctgtaaaagttatcctgcacaagaaacgttatatttacagaaaaattaaaggatggagacctgttctgatgatgtgtgtggtcctcaccacactgccctgcctcaccttttccatagcagtgactgaggttcaaaagagcattaatgggtccgctgatgtcttacctgatatgttacctgacctgcccgtatctctggttctgttatccctgatcatggttgatattattgaaaaactcaggatatatcctcttagagggagtcaaaagagtagtgaaaatggacacatccattcaacctctttgcaacacataaaaactgtgacggagcaagtgaggcaaagtccagaaaacgctgcatctccccaggcaaccaacagcacccaggtgtcgcagccatcaggagccatgacacggagccaggagtctgtgttcatgggaccccaggagccctcctgtgactccggaatcctgagaatgatgtcccggcgagatgtccgggcagagttattcttatggagctttctcctgtggtctgacacgatagaaatggatttttctcacactgtaaaagaagatttactcacagttgttaaaagcttgccttccagctttctaatttgaggtaggttctataacctctgtgggtccccgtttccacatgtaaaagatgaacataatactagtactacattaatagggttaggagggttaaagggtaaagagtcctttgagcacattttctggcaaaccataataacttgataaatgctaagcattggaacgggtaccaagtctccaagaaacaagtatctcaatgcagttttagaaatttcctgttttattcttttctgtggccctgctcaccctctgggaataatcatttcaactttgcatttgtgaaaaataatacatacaatcttaaggttacttcagactatactttttcatcgaggagtattgtattcaaaagtgatcgatctgctgaatatataaattaaaatggacacaagccttcattcatcagacatttgagtgtctgtcctctgagttcccatagaatctgaattacaccactttattcacacttacattatgtgtttacttttctgagtgtcctattaatctttattccttaaaggaaagcctgagggcatcttgtttaacaatgcatctctctcttcatcaatcaacgctgcaggtgcttacaagacttataacttaaaaaaattataatacaaggctcagcgcagtgcctcaagtgccaacagtttcggaggccttggcaggcggatcacttgaggccaagagttcgagactagcctggccaacatggtgaaacaccgtctgtactaaaaatacaaaaattagctgggtgtggtggcacgcgcctgtagtctcagctacttgggaggctgaggcaggagaatcacttgaacctgggaggcagaggttgcaatgagctgagattgcgccattgcacaccagcctgggtgacaagagtctcaaaaaaaaaattataatacaagtaattactttcgaattctgccatgggtatctttttattattaagaaaagcctgtcatcaagggattcatttatgatattcctaaatatgaaaatattttgtgtaagtatatatttatctccatattagaacttagcaacagtgctcagataaactcaaaagtattacttgagtttagaatgcattttgtatctaatattttaatatgaatgtgcctgatattttcggaagtcacaacactatacaaataatgaaggcatgtacagaagattatgtgtaggaggaaaattgagtagctaatttaatttcatttaatattttacttagagtgtatacatgtttatagactgcaagtctatgggatttaatagatattacagcaaattacactgcgaaaacattgatagttctacactgtaattaaatgttatatatattattaaaattattaggttggtgcaaaagtaattgaggtttttgccattgaaagtggtggtgcatgcctgtaatcccagctactcgggaggctgaatcagaattgcttgaacccggagggcagaggttgcagtgagctgagatctcgccactatgctccagcctgggcaacagattgagactctgtctcaaaaaaaaaaaaaagtcaagtacagttagttaaaggaatgtgcatttaaaaattaatctatgattaggctattaatatatagtctaataattttattgcattataattataaagtagttttataattttataaaattttattgatgctgtaatttttataaaattttatttattttataattttacaaaaaattctaatacctgtaatacactttttagtgccttttctttctaaaagttaatgtttgaaattacaatgtgtaaatgttatctcgtcttgtttttcttattagggccccatttcactgaatgacaattgcaatgaggcataggaaagaaaagggaaatgaaattgcttgctgaagtcctactatgttctgggcactatgctgtttgcctaatacataattgccttgtgctgtgtaccttggagcagggccttacatagtgaatatatcaatagttgttcacaaaaagagcaatataccacttagaagctacaaaacttaaaaatggctacttatactccatagaagatatagtaaataatagaagaaaaaaatgaaatggctaaagacattttgttttacaatggggctgtttttacatgttaattaaaattctatgttta

SEQ ID NO: 60465 - DNA, 1922 bp, Homo sapiens
tggacctggtataaaacatctggaagtttccagggggctgctttgcatctgaaactgtcagccccagaatgttgacagtcgctctcctagcccttctctgtgcctcagcctctggcaatgccattcaggccaggtcttcctcctatagtggagagtatggaggtggtggtggaaagcgattctctcattctggcaaccagttggacggccccatcaccgccctccgggtccgagtcaacacatactacatcgtaggtcttcaggtgcgctatggcaaggtgtggagcgactatgtgggtggtcgcaacggagacctggaggagatctttctgcaccctggggaatcagtgatccaggtttctgggaagtacaagtggtacctgaagaagctgttatttgtgacagacaagggccgctatctgtcttttgggaaagacagtggcacaagtttcaatgccgtccccttgcaccccaacaccgtgctccgcttcatcagtggccggtctggttctctcatcgatgccattggcctgcactgggatgtttaccccagtagctgcagcagatgctgagcctcctctccttggcaggggcactgtgatgaggagtaagaactcccttatcactaacccccatccaaatggctcaataaaaaaaatatggttaaggctagtctgtgtgggggcatctgtggctgggatatctgcctcctgacttagccggggacgtgcaaatctcacttctggctggctttggacatctgtctggaagatgggaagatgagggagaggtatgtaagaatcctgggctttgtgctataatttatcaagaggagatgagattctggcttgcatcaacgctcttcaaggacagctccttggaacattgatccaaactggagtcatgggtctgagggcaaggcctagttgtggcttacaccaaaaccccagatgtcccactctccagctctcctcacccctggtcctccccttgagaaagtggtgaactcacttgctgtgtgtgggtggccaggaccattagcctttgttctttcccagaacccacctgactcctgaaacttagctgaagtctgtgcccgaggaccctgccctgttaccaggcccagttcctcctcacctctacccatgagccccggtgtcctgctaagccctctcagatctgggattcctccttcctcaggaagccaccaccttctcagcagtggaaaccctgcccacactatgctcttaggctttagccatcagaaggttacagtggactgcgggaggctgacactaggctgaactcattaaggaatgaatgggaggtgagaagacacaggcagcaagaatcgagtgtttcaagaagtttggctgtggtttgccagaaataggcaagtcagttttcgggggtgtaaggaaaaagggttttgtgtctttttaaaatcctagacaggagagtcacaagcatgttcacatgataaagaggaagaaagagaaagaggctggagattctgaaaagagatcactggtgaggtctcaaaagagatagaagaggatggttatgtagttggggaaagaaattttaagaagggaagaaaattaaaatgagtgaaggtatacgttagttttgtaaaagttatcaatatctggctgggcacagtgctcacacctgtaatcccagcactttgggaggccaaggcaggcagatcatttgaggtcaggagttggagacaagcctccaacatggtaaaaccctgtctctactaaaaatacaaaaattagccaggtgtggtggcagtcacctgtaatcccagctacttgggaggctgaggcatgagaatcacttgaatgctggaggcagaggttacaatgagttgagacagcacaactgcaccccagcctggatgacagagtgagact

SEQ ID NO: 60466 - DNA, 1842 bp, Homo sapiens
gggctggaagtcggtcttcggacagagcccgtcctgcccagaagcccaggcgagccagcagcaggggtgcagggaccgagtggcccagccccctgggcagggtgtcagggccagagcccagaggacggcggttcaggcttcagtcccagccggcgaaccagagctgggcagagcggccagcaagcggcagccagggtgccctgggcactcgacccccagatgcccctgctggaaccgtaaaggggaggcaccctgaggccagagggagcatggccccggggactgagcatccggctcagagcggcttggcagaggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgagaccgctggccggacccccaagctagcccgccaggcctccatagagctgcccagcatggctgtggccagtaccaagagtcggtgggagacgggtgaggtacaggctcagtctgcggccaagactccgtcctgcaaggatattgtggctggagacatgagcaagaaaagcctctgggagcagaagggaggctccaagacctcatcaacaattaagagcaccccatctgggaagaggtataagtttgtggccaccgggcatgggaagtatgagaaggtgcttgtggaagggggcccggctccctaggcgtcccatctcgcttcctgggtctgcaggtccagccggctggcaccctccatgtacccaggggagattccagccagacacccgccccccggccctggctaagaagttgcttcctgttgccagcatgacctaccctcgcctctttgatgccatccgctgccacctccttttgctcctggaccctttagcctctctgcccttccactctctgaccaccgcccccgccctccccacccagctccgcttcttgttacttgggggaggaaagaaactcctgatcattggccaaagggacttacccctggagaggccaagtgccttctaggaagttaggaggttgaggcacagcctgtgcagagagggtgggtcacccccccagatccaaggagaaactgcaggtcaagggctgataacggccatgcaggatgcttgatgctgcgtcccccgctgcttgccgccccccaccccgccattttgtataataaagctccctgtgtattctcaaaaaaaaaaaaaaaaaaaaaaaaaaaaaaaaaaaaaaaaaaaaaaaaaaaaaaaaaa

SEQ ID NO: 60467 - DNA, 2072 bp, Homo sapiens
acggcaagagctctgccagggcagtcccagctggcccaggcgccgcagcgctcccgagggccgtcgagcaaaggcgggaggcgcagccgggctgtcggtggacctgtaggtatcagggctccttggtcccctcctgcgggaagcaggcaccgagtggggctgcatgtagacgcatgcgagggtgagagctgcggcggaggacgctgatcgcggagtgcaggcgagggccccagaaaggtcccgcaggtcgcctcgctcgtggcacgggctcggcagcgttgtggttagtgacacggaggaagacagaaagccatatgcacagcacgcagaacaggaggaggggggaagaaagagcaggcacggggcaggcagagccgcagccacgccgccgggatgcagcaggcagggccacccacgagcagggcggggccctaacctccgacccaggctggtcgccgcagatgggggcagagatgtgaaacagctgcagagcgggacaagggtgctgccggcacagggctgaccacagagcacatcaaaagaggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgagaccgctggccggacccccaagctagcccgccaggcctccatagagctgcccagcatggctgtggccagtaccaagagtcggtgggagacgggtgaggtacaggctcagtctgcggccaagactccgtcctgcaaggatattgtggctggagacatgagcaagaaaagcctctgggagcagaagggaggctccaagacctcatcaacaattaagagcaccccatctgggaagaggtataagtttgtggccaccgggcatgggaagtatgagaaggtgcttgtggaagggggcccggctccctaggcgtcccatctcgcttcctgggtctgcaggtccagccggctggcaccctccatgtacccaggggagattccagccagacacccgccccccggccctggctaagaagttgcttcctgttgccagcatgacctaccctcgcctctttgatgccatccgctgccacctccttttgctcctggaccctttagcctctctgcccttccactctctgaccaccgcccccgccctccccacccagctccgcttcttgttacttgggggaggaaagaaactcctgatcattggccaaagggacttacccctggagaggccaagtgccttctaggaagttaggaggttgaggcacagcctgtgcagagagggtgggtcacccccccagatccaaggagaaactgcaggtcaagggctgataacggccatgcaggatgcttgatgctgcgtcccccgctgcttgccgccccccaccccgccattttgtataataaagctccctgtgtattctcaaaaaaaaaaaaaaaaaaaaaaaaaaaaaaaaaaaaaaaaaaaaaaaaaaaaaaaaaa

SEQ ID NO: 60468 - DNA, 1578 bp, Homo sapiens
gagggccgtcgagcaaaggcgggaggcgcagccgggctgtcggtggacctgcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgagaccgctggccggacccccaagctagcccgccaggcctccatagagctgcccagcatggctgtggccagtaccaagagtcggtgggagacgggtgaggtacaggctcagtctgcggccaagactccgtcctgcaaggatattgtggctggagacatgagcaagaaaagcctctgggagcagaagggaggctccaagacctcatcaacaattaagagcaccccatctgggaagaggtataagtttgtggccaccgggcatgggaagtatgagaaggtgcttgtggaagggggcccggctccctaggcgtcccatctcgcttcctgggtctgcaggtccagccggctggcaccctccatgtacccaggggagattccagccagacacccgccccccggccctggctaagaagttgcttcctgttgccagcatgacctaccctcgcctctttgatgccatccgctgccacctccttttgctcctggaccctttagcctctctgcccttccactctctgaccaccgcccccgccctccccacccagctccgcttcttgttacttgggggaggaaagaaactcctgatcattggccaaagggacttacccctggagaggccaagtgccttctaggaagttaggaggttgaggcacagcctgtgcagagagggtgggtcacccccccagatccaaggagaaactgcaggtcaagggctgataacggccatgcaggatgcttgatgctgcgtcccccgctgcttgccgccccccaccccgccattttgtataataaagctccctgtgtattctcaaaaaaaaaaaaaaaaaaaaaaaaaaaaaaaaaaaaaaaaaaaaaaaaaaaaaaaaaa

SEQ ID NO: 60469 - DNA, 1756 bp, Homo sapiens
acaccctgacccaagccgagacaggttccaaacctcaacctgcagccggaagggggaagtgaaactcggctgggggtgggggctcagaagccgccccagaaagcactgaaagccacagcacgtacacccactccagggatctgccagcaccctgtggggcccagactacaggctgatggcggaggcttcgagtgacccgggtgccgaggagcgggaagagttgctggggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgagaccgctggccggacccccaagctagcccgccaggcctccatagagctgcccagcatggctgtggccagtaccaagagtcggtgggagacgggtgaggtacaggctcagtctgcggccaagactccgtcctgcaaggatattgtggctggagacatgagcaagaaaagcctctgggagcagaagggaggctccaagacctcatcaacaattaagagcaccccatctgggaagaggtataagtttgtggccaccgggcatgggaagtatgagaaggtgcttgtggaagggggcccggctccctaggcgtcccatctcgcttcctgggtctgcaggtccagccggctggcaccctccatgtacccaggggagattccagccagacacccgccccccggccctggctaagaagttgcttcctgttgccagcatgacctaccctcgcctctttgatgccatccgctgccacctccttttgctcctggaccctttagcctctctgcccttccactctctgaccaccgcccccgccctccccacccagctccgcttcttgttacttgggggaggaaagaaactcctgatcattggccaaagggacttacccctggagaggccaagtgccttctaggaagttaggaggttgaggcacagcctgtgcagagagggtgggtcacccccccagatccaaggagaaactgcaggtcaagggctgataacggccatgcaggatgcttgatgctgcgtcccccgctgcttgccgccccccaccccgccattttgtataataaagctccctgtgtattctcaaaaaaaaaaaaaaaaaaaaaaaaaaaaaaaaaaaaaaaaaaaaaaaaaaaaaaaaaa

SEQ ID NO: 60470 - DNA, 2618 bp, Homo sapiens
agatgcaacgcaagcaacgacttcgtcacactaaaacggattttgtgagggccaaaagtataaattacgaagcagaaatgattatcaaacaacttccagcggtttgcacctaaagaaacacaaggagaacccactacaaacaaacaaacccagtccaaacaacgcctccagtaggaaaagaggaaaactgcgataacacgaccccccgagaagagacgagaccaacacgctgagactgtggggcgtcagcaaacctccaagtgcacggcggactgagttgtacttcgcagctctctggacattaattacctcctgcaccttccatttgggggagggtgaggaagaaggcactcacctacactgagcgaagaagtcctatcagcgtggaagagaagtttaagaatgaaccactgaatgtttcgcttttatttttaaatttactttggcacttaaaaaacctcatttccagatttctggacaatctcggctgcagacatctaagcctaaccttttggtatcctgagttttttccctctccttctccttcctcacgcccaccccgcttctctcgcacacggtcatctttacatatcaagagaaagcaaaaaggttccaagaggtacttttctttttagaaaatcaccttttctcccctaattcttctgcagaagaaaagaggtttcgaaagagggaaaaggaaaaaacaagccggctacggtatcagccggtcagcccaggtggaaaacgagagtgaaagtagggcttaacggggagcgcaccgcctctttcgaaagccgctgggccaccaccagtgcgtgagccttggatccctcaacgtattgcgagacgccggtgtatagcccggacctgtgccccaacatgatcgccgctcaggccaagctggtttaccagctcaataagtactacactgagcgctgtcaggcgcgcaaggcggccatcgccaaaaccatccgagaggtctgtaaggtggtctcggacgtgctcaaggaagtggaggtgcaggagcctcgcttcatcagctccttgagcgagatcgatgcccgctacgaggggctcgaggtcatttcgcccaccgaatttgaggtggtgctctacctaaaccagatgggcgtcttcaacttcgtggacgacggctcgctgcccggctgcgcagtgctcaaactgagcgatgggcggaagcggagcatgtctctctgggtcgagttcatcacggcgtcgggctatctctcagcgcgtaagatccgctcgcgtttccagacgctggtggcccaggcggtggacaagtgcagctatcgggatgtggtcaagatgatcgcggacaccagcgaggtcaagttgcgcatcagggagcgctatgtggtgcaaatcactccggcgttcaagtgcaccgggatctggcctcgcagcgcggcacagtggcctatgccccacatcccttggcccggccccaatcgggtggccgaggtcaaggccgaagggttcaacttgctctcgaaggagtgctactcgctgaccggcaagcagagctcggcagagagcgacgcctgggtgctacagttcggggaggcggagaaccgcctgctgatgggcggctgccgaaacaagtgcctctcagtgctgaagactctgcgggaccgccacctggagctacccggccagccgctcaacaactaccacatgaagacgctgctgctgtacgagtgcgagaaacacccacgagaaacggactgggacgagtcgtgcctgggcgaccggctcaacggcatcctgctgcagctcatctcctgcctgcagtgccgccgctgccctcactactttctgcccaacctcgacctctttcagggcaagccccattcggccctggagagcgctgccaagcagacctggaggttggccagggaaattctcaccaatcccaaaagcctggacaaactatagggtgctggggactgcttgaaaagcgacacaaacgggcgtgctctctcagacacacaactcagctataaacagcagaaactctggacacaaacttttatgtaagtcacctgaaataggaatccggcagaagaccttcattaattaagaagcaaacaaaaagagagcaacccaaccaaaacaaatcacattcttgcacaaaagtgatcgttttcttccaaacaatgtgaatttaaaaggtcacacaaaagaagcaatcgggctccgccaccacaaaatgaaacccaaggtacattttcaaatcaatgtatagtagttccccccccttttccttctttccccctatcctttttctctccaccccatcccccccccatttcgttttgcttttggttgcctgaatgttgtcaccaagtgaaaaaattatttaactatatgtaaaatttctcttttaaaaaaaagttttactgatgttaaacgttctcagtgccaatgtcagactgtgctcctccctctcctgaacctctaccctcaccctgagctgtcttgttgaaaacagtaataaaaacattactttacattgtaaaaaaaaaaaaaaaaaaaaaaaaaaaaaaaaaaaaaaaaaaaaaaaaaaaaaaaaaaaaaaaaaaaaaaaaaaaaaa

SEQ ID NO: 60471 - DNA, 2575 bp, Homo sapiens
aaagattccttagctggaaaggtctaggaggagactcccgctctgctccctcctgcaccagcgctgtgccccccgccggccaggcagagccatccgatgccgctgggccgcccactgaggatctgctggctgcagcgagtggaaggacctgctcggctggaacgttttttttttttttccctcccaggcgacgtccgatgggtgtgtcgggcaggaggtgatatttgacaggctgcgcgcgggcgagctgccgcggagcacccggcaggggctgacagcatggcctcgcccgacccgcccgccaccagctacgccccgtccgacgtgccctcgggggtcgcgctgttcctcaccatccctttcgccttcttcctgcccgagctgatatttgggttcttggtctggaccatggtagccgccacccacatagtataccccttgctgcaaggatgggtgatgtatgtctcgctcacctcgtttctcatctccttgatgttcctgttgtcttacttgtttggattttacaaaagatttgaatcctggagagttctggacagcctgtaccacgggaccactggcatcctgtacatgagcgctgccgtcctacaagtacatgccacgattgtttctgagaaactgctggacccaagaatttactacattaattcggcagcctcgttcttcgccttcatcgccacgctgctctacattctccatgccttcagcatctattaccactgatgcacaggcgccaggccaagggggaaatgctctttgaaagctccaattattggtccccaaaagcagcttccaacgtttgccatctggatgacaaacggaagatccactaaaacgtccacgggattaacagaacgtccttgcagactgagcgatgacaccacactttgtttggacatttaaattcactctgctgaataggaggaagcttttctttttcctgggaaaacaactgtctcttggaattatctgaccatgaacttgctcttctagacaactcacatcaaagccctcactccactaatggagaatcctagccccactaatgccaagtctgtttggggattttgcctcagctatgggcttccctagagtaggtctaggggaatactcagtctgatcttttttttgtttgttttattttgttttttttgagacggagtctcgctcttcctccaaggctggagtgcagtgacgcgatctccactcactgcaggctccgcctcccgggttcccgccattctcctgcctcagcctcccgagtagccgggactacaggcgcccaccaccatgcccggctaatttagttgtatttttagtagagatggggtttcaccgtattagccaggatggtctcgatctcctgacctcgtgatccgcccgcctcggcctcccaaagtgctgggattacaggcgtgagccaccgcgcccggcctgattctcttaaaattgaagaggtgctgccaaggccttcagatctaacgcagatgcatagaccttgttcctggtacttgttcagcctgtgctggggagccgtggtcccgagttccctgggaggctgacagggtcaagccaccctgcccaccaccctcccacttcccctcccctttcctctccagcattaggattcaagggaaatctgcatgaagccaattttgagggtagacgtgtggggaaaataaatcattatacagtaagacctggggcttgaggggtggggaatggggagggaagggcatagcctgctcctccatgagtctgacatctcggaaactgagcagctgccggacgcctgggtcaggaatccaagaccccacctcttaaggactggttcctcagaaagcaccctcagggaaaaaggtgaaaacattacatccgtggattctcctgccacaaccgcattggaagaaaaggctgccgcaacatctcagcgaggagtgaaggacccatgtcccaggaaccgcgctgcgccacctgcactcacccccctcacattctcttaagcacccggtggccctccgaggcctggcggaatggtggtgcccacggggttgggcaagggctcaccaggacctcaacgggcaaagttgtgcacactaaaatatcaaatcaaggtgcttggttttaaagtaaatgtttttctaaagaaagctgtgctcttctgttgacccagacgaatagggcacagccctgtaactgcacgtgccttctgtcattgggaatgaaataaattattacgagaaagggacttgtcctaactggtttgaggccttacagttttgtatctacatttttcccctcctggggtttgcggggacagggacagaactacaggagtcatgggaaagaaaattctggcttcactactgctcactgctcactttctgatcactctgatactttttttttttttttttttttgcaacctgataccttgaaaagcttctatgtgtctctccttttgttgcctggcagctgtctaggatgatcactgattactatttactaagtagccacatgcaaataaaagttgtttggtaaaaaggaaaaaaaaaaa

SEQ ID NO: 60472 - DNA, 2326 bp, Homo sapiens
caaccctgaatgtcatagttagctactttcaactggaagctacaacatggatttatggaatctgtcttggtttctgttcttggatgctcttctcgtgatttctggcttggcaactccagaaaactttgatgtagatggcggaatggaccaggacatatttgatatcaatgaaggtttgggactggatctttttgagggtgacatcagacttgatagggcacaaattagaaattccatcattggagaaaagtatagatggcctcataccattccatatgttctagaagatagcttggaaatgaatgctaagggagttatcctcaatgcatttgaacgttatcgccttaaaacatgtattgactttaagccttgggctggagaaacaaactatatatcagtgttcaagggcagtggctgctggtcttcagtaggaaataggcgggttgggaagcaagaactttccatcggggcaaactgtgaccgaatagcaacagttcaacacgagttcctccacgctctgggattctggcatgagcagtcgcgttctgaccgggatgactatgtcaggataatgtgggacagaattctgtcaggcagagagcacaattttaacacctatagtgacgatatatcagattccctgaatgttccctatgattacacttcagtaatgcactacagtaaaactgcattccaaaatggaacagagccgacaattgtcacaagaatctcagactttgaggatgtgatcggccaacgaatggatttcagtgactctgatctcctaaagttgaatcaactgtataactgctcctcttccttgagttttatggactcatgcagttttgaactggaaaatgtgtgtggcatgatccaaagttcaggagataatgctgactggcaacgggtttcacaggttcccagggggccagagagtgatcactccaacatgggccagtgccaaggttctggtttcttcatgcatttcgatagcagctctgtaaatgtgggggccacagcagtgctggaaagtagaacgctgtaccctaaaagaggatttcagtgcctgcaattttacttatataacagtggcagtgaaagtgatcaactgaacatctatatcagggagtattctgcagacaatgtggatggcaatttaacccttgtggaagaaataaaagaaatacccactgggagctggcaactttatcatgtaacattgaaagtgaccaagaagtttagagtggtgtttgaaggacgcaaaggctctggtgcatcactgggtggtctgtctattgatgacatcaatctttcggaaacacggtgccctcatcatatctggcatataaggaatttcacacagttcattggcagcccaaatggaactctgtatagccctccattttactcttctaaaggttatgcctttcagatttacttaaatctagcccatgtgactaatgcagggatatatttccacttgatctctggagccaatgatgatcaattacagtggccatgtccttggcaacaagccacaatgacacttttggatcaaaatcctgacattcgacagcgtatgtccaatcagcggagtataactacagacccatttatgaccaccgataatggaaactatttctgggacaggccttctaaagtgggaacagtggctttgttctctaatggaactcagtttagaagaggtgggggctatggaaccagtgcctttataacccacgaaaggctgaaaagcagagattttataaaaggagatgatgtttatatcctactgacagtggaagacatatctcacctcaactctacacaaatccagctaacaccagcccctagtgttcaagacctctgctcaaaaaccacctgtaaaaatgacggtgtctgcactgttcgagatggcaaagctgagtgcaggtgccagtcaggggaagactggtggtacatgggagaaaggtgtgaaaagagaggctccacccgagacaccatagtcattgctgtttcatctactgttgctgtgtttgccttgatgctgatcatcacccttgtcagtgtctattgcaccaggaagaaatatcgtgaaaggatgagctcaaatcgaccaaatttgactctgcaaaatcatgctttttgaagattaactcgacaatatggccagctaatgaaattaaaaaggattcttcatcatggatttcgcctaagtgatattacagccacctcattcttctaaaagtggatatttttctgtaaatagctggaaatattataaatcactattttggtcaaagtcaaaaaaaaaaaaaaaaaaaaa

SEQ ID NO: 60473 - DNA, 1501 bp, Homo sapiens
cccaagcaggtcggcggcggcggcaggagagcggccgggcgtcagctcctcgacccccgtgtcgggctagtccagcgaggcggacgggcggcgtgggcccatggccaggcccggcatggagcggtggcgcgaccggctggcgctggtgacgggggcctcggggggcatcggcgcggccgtggcccgggccctggtccagcagggactgaaggtggtgggctgcgcccgcactgtgggcaacatcgaggagctggctgctgaatgtaagagtgcaggctaccccgggactttgatcccctacagatgtgacctatcaaatgaagaggacatcctctccatgttctcagctatccgttctcagcacagcggtgtagacatctgcatcaacaatgctggcttggcccggcctgacaccctgctctcaggcagcaccagtggttggaaggacatgttcaatgtgaacgtgctggccctcagcatctgcacacgggaagcctaccagtccatgaaggagcggaatgtggacgatgggcacatcattaacatcaatagcatgtctggccaccgagtgttacccctgtctgtgacccacttctatagtgccaccaagtatgccgtcactgcgctgacagagggactgaggcaagagcttcgggaggcccagacccacatccgagccacgtgcatctctccaggtgtggtggagacacaattcgccttcaaactccacgacaaggaccctgagaaggcagctgccacctatgagcaaatgaagtgtctcaaacccgaggatgtggccgaggctgttatctacgtcctcagcacccccgcacacatccagattggagacatccagatgaggcccacggagcaggtgacctagtgactgtgggagctcctccttccctccccacccttcatggcttgcctcctgcctctggattttaggtgttgatttctggatcacgggataccacttcctgtccacaccccgaccaggggctagaaaatttgtttgagatttttatatcatcttgtcaaattgcttcagttgtaaatgtgaaaaatgggctggggaaaggaggtggtgtccctaattgttttacttgttaacttgttcttgtgcccctgggcacttggcctttgtctgctctcagtgtcttccctttgacatgggaaaggagttgtggccaaaatccccatcttcttgcacctcaacgtctgtggctcagggctggggtggcagagggaggccttcaccttatatctgtgttgttatccagggctccagacttcctcctctgcctgccccactgcaccctctcccccttatctatctccttctcggctccccagcccagtcttggcttcttgtcccctcctggggtcatccctccactctgactctgactatggcagcagaacaccagggcctggcccagtggatttcatggtgatcattaaaaaagaaaaatcgcaaccaaaaaaaaaaaaaaaaaaa

SEQ ID NO: 60474 - DNA, 571 bp, Homo sapiens
tcagccggacaccagaagacaagcagagagactcctccagacccactcagaccacgtgcacgccctccaagatggtatcccgtaaggctgtggctgctctgctggtggtgcatgtagctgccatgctggcctcccagacggaagccttcgtccccatcttcacctatggcgaactccagaggatgcaggaaaaggaacggaataaagggcaaaagaaatccctgagtgtatggcagaggtctggggaggaaggtcctgtagaccctgcggagcccatcagggaagaagaaaacgaaatgatcaagctgactgctcctctggaaattggaatgaggatgaactccagacagctggaaaagtacccggccaccctggaagggctgctgagtgagatgcttccccagcatgcagccaagtgatggccacgctggggagaaggtggacagatttgggaggcccctcctgcccaagtgaggccctgggaatttacagagcctgccagctgggcttggaaggaaaacacctttccaaagcaaattcccctccagcaaataaagcatgaaatatacag

SEQ ID NO: 60475 - DNA, 3646 bp, Homo sapiens
cctgaagggaggatgggctaaggcaggcacacagtggcggagaagatgccctcctgggccctcttcatggtcacctcctgcctcctcctggcccctcaaaacctggcccaagtcagcagccaagatgtctccttgctggcatcagactcagagcccctgaagtgtttctcccgaacatttgaggacctcacttgcttctgggatgaggaagaggcagcgcccagtgggacataccagctgctgtatgcctacccgcgggagaagccccgtgcttgccccctgagttcccagagcatgccccactttggaacccgatacgtgtgccagtttccagaccaggaggaagtgcgtctcttctttccgctgcacctctgggtgaagaatgtgttcctaaaccagactcggactcagcgagtcctctttgtggacagtgtaggcctgccggctccccccagtatcatcaaggccatgggtgggagccagccaggggaacttcagatcagctgggaggagccagctccagaaatcagtgatttcctgaggtacgaactccgctatggccccagagatcccaagaactccactggtcccacggtcatacagctgattgccacagaaacctgctgccctgctctgcagaggcctcactcagcctctgctctggaccagtctccatgtgctcagcccacaatgccctggcaagatggaccaaagcagacctccccaagtagagaagcttcagctctgacagcagagggtggaagctgcctcatctcaggactccagcctggcaactcctactggctgcagctgcgcagcgaacctgatgggatctccctcggtggctcctggggatcctggtccctccctgtgactgtggacctgcctggagatgcagtggcacttggactgcaatgctttaccttggacctgaagaatgttacctgtcaatggcagcaacaggaccatgctagctcccaaggcttcttctaccacagcagggcacggtgctgccccagagacaggtaccccatctgggagaactgcgaagaggaagagaaaacaaatccaggactacagaccccacagttctctcgctgccacttcaagtcacgaaatgacagcattattcacatccttgtggaggtgaccacagccccgggtactgttcacagctacctgggctcccctttctggatccaccaggctgtgcgcctccccaccccaaacttgcactggagggagatctccagtgggcatctggaattggagtggcagcacccatcgtcctgggcagcccaagagacctgttatcaactccgatacacaggagaaggccatcaggactggaaggtgctggagccgcctctcggggcccgaggagggaccctggagctgcgcccgcgatctcgctaccgtttacagctgcgcgccaggctcaacggccccacctaccaaggtccctggagctcgtggtcggacccaactagggtggagaccgccaccgagaccgcctggatctccttggtgaccgctctgcatctagtgctgggcctcagcgccgtcctgggcctgctgctgctgaggtggcagtttcctgcacactacaggagactgaggcatgccctgtggccctcacttccagacctgcaccgggtcctaggccagtaccttagggacactgcagccctgagcccgcccaaggccacagtctcagatacctgtgaagaagtggaacccagcctccttgaaatcctccccaagtcctcagagaggactcctttgcccctgtgttcctcccaggcccagatggactaccgaagattgcagccttcttgcctggggaccatgcccctgtctgtgtgcccacccatggctgagtcagggtcctgctgtaccacccacattgccaaccattcctacctaccactaagctattggcagcagccttgaggacaggctcctcactcccagttccctggacagagctaaactctcgagacttctctgtgaacttccctaccctacccccacaacacaagcaccccagacctcacctccatccccctctgtctgccctcacaattaggcttcattgcactgatcttactctactgctgctgacataaaaccaggaccctttctccacaggcaggctcatttcactaagctcctcctttacttcctctctcctctttgatgtcaaacgccttgaaaacaagcctccacttccccacacttcccatttactcttgagactacttcaattagttcccctactacactttgctagtgaactgcccaggcaaagtgcacctcaaatcttctaattccaagatccaataggatctcgttaatcatcagttcctttgatctcgctgtaagatttgtcaaggctgactactcacttctcctttaaattctttcctaccttggtcctgcctctttgagtatattagtaggttttttttatttgtttgagacagggtctcactctgtcacccaggctgcagtgcaatggcgcgatctcagctcactgcaacctccacctccgggttcaagcgattcttgtgcctcggcctccctagtagctgggattacaggcgcacaccaccacacacagctaatttttttttttttttttttttttttttttttttttagacggagccttgcctgttgccagactggagtgcagtggcacgatctcggctcactgcaacctctgcctcccgggttcaagccattctgcctcagcctcccaagtagctgggagtacagcgtctgccaccatgcctaatttttttctatttttaggagagaccggttttcaccacgttggccaggatggtctcgatatctgatctcgtgatccgcctgcctctgcctcccaaagtgctgggattacaggtgtgacccactgcgcacagccccagctaattttcatatttttagtagagacagggttttgccatgttgcccaggctggtcttgaactcctaacctcgggtgatccacccaccttggcctcccaaagtgttaggattacaggcatgagccactgcgcccggctgagtgtactagtagttaagagaataaactagatctagaatcagagctggattcaattcctgtccttcacatttactagctgtgcaaccttgggcacataacttaatgtctttgagccttagttttttcatctgtaaaacagggataataacagcaccccatagagttgtgacgaggattgagataatctaagtaaagcacagtccctaggacatagtaaatgattcatatatccgaactactgttataattattccttcttactctcctcttctagcatttcttccaattattacagtccttcaagattccatttcttaacagtctccaatcccatctattctctgcctttactatatgttgaccattccaaagttcttatctctagctcagacatctactacagcactgtgatgctttatgcaactaactgtttacatatctgtcccctgctactagattgtgagctccttgagggaaaggaacatgatttatttgtccttttcccccagcacctagagtagtgcttggtgcatgatagtaggccttcaataaattttttctaaatgaatga

SEQ ID NO: 60476 - DNA, 2287 bp, Homo sapiens
ctctctggggagctccggcagcgcaagagggcaaagcacagctggaagctcagagctgcagtcccaggtcctgggccagggcccccatccagcatcaatgaaagcagaagccacagttattcccagccgttgtgctagggggctcccatcatggcaagtcctcagcccagtccagccctggcagacaagtgcaccccagaacacgacccagcccaagctcctggctccacaccagcacgataagtcccagaagaagagcagccttcttaaggagctgggggccttccacatcaccatcgctctgctgcacctggtctttgggggctacctggcctctatagtcaagaaccttcacctggtggtgctgaagtcttggtatccattctggggggctgcctcttttctcatttcagggatcttggcgataacaatgaagaccttttctaaaacttacctgaagatgttgtgcctgatgacaaacctcatcagcctcttttgcgtgctgtctggcctcttcgtcatctccaaggatctctttctggagagcccatttgagtccccgatctggagaatgtaccccaactccacggtccacatccagaggctggagctggccttgctctgcttcactgtcctagagctcttcctgccagtgcccacagctgtcacagcctggagaggggactgcccatctgcaaagaatgatgatgcatgccttgttccgaatacaccattgcatctcaaaggcctgccggtggagcccccgccatcctaccagagtgtgattcaaggcgacgcacaacacaagcaacatcagaggctcagagaagttaagcaagttgccccggacacatggatagtcactgacggagctgcgatctgggcccagactgcaaactgaagagccactgcctgacaatgcccaaacttggttggagcatagcccctgctctcccaaagttgcactttcactgggaagatgagatttgcacatacaaaaggctagagcgatggtctatacagcaaagtcagccctcacagctcaaccctgtcctctcagataagccatttcttacatagttgatggctcgatatctgtggtagcccagattgttttgttttgtttcgctttgttttgttttcttttgttttgttgagatggagtctcgctctgttgcccagcccagagtacagtggcactatctcagctcactgcaacctccgcctccctgattcaagtgattctcctgtctcagcctcccaagtagctgggactataggcacacgccaccacgcccagctaatttttatatttttagtagagacaggattgcaccatattggtcagcctggtctcaaactcctgacctcaggtgatccgcctgcctcagcctcccaaagtgctgggattacaggcgtgagccactgtgcccagcccaggttttgaagttgtccgagatagcagtctgctctctactgccttataaaatccctgtgtgaagggatgctctcagtatcatttgcccttgcacagaatatccctggggtttgaggttctttgaattctccctctttgtcatctctttcgctgccacttctggctgtggtcactagcttggccatagcacctctcttctccacttctgatctgctgcttctaaccttctatagattgcagctggctttaaaatagattgtaaagtgtaaggcattcggttctgagacagcggcagagagagccatgcaaatgtttaggacaacccagtctttcttttttttttttttttttttttgagacggagtctcactctgtcacccaggctggagtgcagtggtgcaatctcggctcactgcaacctctgcctcccgagttcaagcaattctcctgcctcagcctcccgagtagctgggattacaggcgaccaccaccacgcctggctactttttgtatttttagtagagacagggtttcaccacgttagccatgatggtctcaaacttctgacctcataatccgcccaccttggcctcccaaagtgctaggattacaggcatgagccaccacccctggctgaaacccaatctttcaaaacatgaaagggggtgatggagaaaaccttagcttggttgtctaaagacatgggtgcaaactctaggctagctctgccaatcacttactgtgcgggtttgactcagtcccttcccctcattaggtcccagtttctccatttgtaaaacaagcaattgtgctacattgatggtttacatcaataaagtttgaaacggc

SEQ ID NO: 60477 - DNA, 1369 bp, Homo sapiens
aaacaggaaataaatacgaatgaaactgagctctaagcagcatgtaacctggcctgcatccaggaaatagaggacttcggatccttctaaccctaccacccaactggccccagtacattcattctctcaggaaaaaaaacaaggtccccacagcaaagaaaaggaataggatcaagagatacgtggctgctggcagagcaagcatgaattcgatgacttcagcagttccggtggccaattctgtgttggtggtggcaccccacaatggttatcctgtgaccccaggaattatgtctcacgtgcccctgtatccaaacagccagccgcaagtccacctagttcctgggaacccacctagtttggtgtcgaatgtgaatgggcagcctgtgcagaaagctctgaaagaaggcaaaaccttgggggccatccagatcatcattggcctggctcacatcggcctcggctccatcatggcgacggttctcgtaggggaatacctgtctatttcattctacggaggctttcccttctggggaggcttgtggtttatcatttcaggatctctctccgtggcagcagaaaatcagccatattcttattgcctgctgtctggcagtttgggcttgaacatcgtcagtgcaatctgctctgcagttggagtcatactcttcatcacagatctaagtattccccacccatatgcctaccccgactattatccttacgcctggggtgtgaaccctggaatggcgatttctggcgtgctgctggtcttctgcctcctggagtttggcatcgcatgcgcatcttcccactttggctgccagttggtctgctgtcaatcaagcaatgtgagtgtcatctatccaaacatctatgcagcaaacccagtgatcaccccagaaccggtgacctcaccaccaagttattccagtgagatccaagcaaataagtaaggctacagattctggaagcatctttcactgggaccaaaagaagtcctcctccctttctgggcttccataacccaggtcgttcctgttctgacagctgaggaaacgtctctcccactgtttgtactctcaccttcattcttcaattcagtctaggaaaccatgctgtttctctatcaagaagaagacagagattttaaacagatgttaaccaagagggactccctagggcacatgcatcagcacatatgtgggcatccagcctctggggccttggcacacacacattcgtgtgctctgctgcatgtgagcttgtgggttagaggaacaaatatctagacattcaatcttcactctttcaattgtgcattcatttaataaatagatactgagcattcaaaaaaaaaaaaaaaaaa

SEQ ID NO: 60478 - DNA, 3392 bp, Homo sapiens
actccctcactggctgccattgaaagagtccacttctcagtgactcctagctgggcactggatgcagttgaggattgctggtcaatatgattcttcttgctgtgctttttctctgcttcatttcctcatattcagcttctgttaaaggtcacacaactggtctctcattaaataatgaccggctgtacaagctcacgtactccactgaagttcttcttgatcggggcaaaggaaaactgcaagacagcgtgggctaccgcatttcctccaacgtggatgtggccttactatggaggaatcctgatggtgatgatgaccagttgatccaaataacgatgaaggatgtaaatgttgaaaatgtgaatcagcagagaggagagaagagcatcttcaaaggaaaaagcccatctaaaataatgggaaaggaaaacttggaagctctgcaaagacctacgctccttcatctaatccatggaaaggtcaaagagttctactcatatcaaaatgaggcagtggccatagaaaatatcaagagaggtctggctagcctatttcagacacagttaagctctggaaccaccaatgaggtagatatctctggaaattgtaaagtgacctaccaggctcatcaagacaaagtgatcaaaattaaggccttggattcatgcaaaatagcgaggtctggatttacgaccccaaatcaggtcttgggtgtcagttcaaaagctacatctgtcaccacctataagatagaagacagctttgttatagctgtgcttgctgaagaaacacacaattttggactgaatttcctacaaaccattaaggggaaaatagtatcgaagcagaaattagagctgaagacaaccgaagcaggcccaagattgatgtctggaaagcaggctgcagccataatcaaagcagttgattcaaagtacacggccattcccattgtggggcaggtcttccagagccactgtaaaggatgtccttctctctcggagctctggcggtccaccaggaaatacctgcagcctgacaacctttccaaggctgaggctgtcagaaacttcctggccttcattcagcacctcaggactgcgaagaaagaagagatccttcaaatactaaagatggaaaataaggaagtattacctcagctggtggatgctgtcacctctgctcagacctcagactcattagaagccattttggactttttggatttcaaaagtgacagcagcattatcctccaggagaggtttctctatgcctgtggatttgcttctcatcccaatgaagaactcctgagagccctcattagtaagttcaaaggttctattggtagcagtgacatcagagaaactgttatgatcatcactgggacacttgtcagaaagttgtgtcagaatgaaggctgcaaactcaaagcagtagtggaagctaagaagttaatcctgggaggacttgaaaaagcagagaaaaaagaggacaccaggatgtatctgctggctttgaagaatgccctgcttccagaaggcatcccaagtcttctgaagtatgcagaagcaggagaagggcccatcagccacctggctaccactgctctccagagatatgatctccctttcataactgatgaggtgaagaagaccttaaacagaatataccaccaaaaccgtaaagttcatgaaaagactgtgcgcactgctgcagctgctatcattttaaataacaatccatcctacatggacgtcaagaacatcctgctgtctattggggagcttccccaagaaatgaataaatacatgctcgccattgttcaagacatcctacgtttggaaatgcctgcaagcaaaattgtccgtcgagttctgaaggaaatggtcgctcacaattatgaccgtttctccaggagtggatcttcttctgcctacactggctacatagaacgtagtccccgttcggcatctacttacagcctagacattctctactcgggttctggcattctaaggagaagtaacctgaacatctttcagtacattgggaaggctggtcttcacggtagccaggtggttattgaagcccaaggactggaagccttaatcgcagccacccctgacgagggggaggagaaccttgactcctatgctggtatgtcagccatcctctttgatgttcagctcagacctgtcacctttttcaacggatacagtgatttgatgtccaaaatgctgtcagcatctggcgaccctatcagtgtggtgaaaggacttattctgctaatagatcattctcaggaacttcagttacaatctggactaaaagccaatatagaggtccagggtggtctagctattgatatttcaggtgcaatggagtttagcttgtggtatcgtgagtctaaaacccgagtgaaaaatagggtgactgtggtaataaccactgacatcacagtggactcctcttttgtgaaagctggcctggaaaccagtacagaaacagaagcaggcttggagtttatctccacagtgcagttttctcagtacccattcttagtttgcatgcagatggacaaggatgaagctccattcaggcaatttgagaaaaagtacgaaaggctgtccacaggcagaggttatgtctctcagaaaagaaaagaaagcgtattagcaggatgtgaattcccgctccatcaagagaactcagagatgtgcaaagtggtgtttgcccctcagccggatagtacttccagcggatggttttgaaactgacctgtgatattttacttgaatttgtctccccgaaagggacacaatgtggcatgactaagtacttgctctctgagagcacagcgtttacatatttacctgtatttaagatttttgtaaaaagctacaaaaaactgcagtttgatcaaatttgggtatatgcagtatgctacccacagcgtcattttgaatcatcatgtgacgctttcaacaacgttcttagtttacttatacctctctcaaatctcatttggtacagtcagaatagttattctctaagaggaaactagtgtttgttaaaaacaaaaataaaaacaaaaccacacaaggagaacccaattttgtttcaacaatttttgatcaatgtatatgaagctcttgataggacttccttaagcatgacgggaaaaccaaacacgttccctaatcaggaaaaaaaaaaaaaaaaaaaagtaagacacaaacaaaccatttttttctctttttttggagttgggggcccagggagaagggacaaggcttttaaaagacttgttagccaacttcaagaattaatatttatgtctctgttattgttagttttaagccttaaggtagaaggcacatagaaataacatc

SEQ ID NO: 60479 - DNA, 15720 bp, Homo sapiens
caacccacaccgcccctgccagccaccatggggctgccactagcccgcctggcggctgtgtgcctggccctgtctttggcagggggctcggagctccagacagagggcagaacccgataccacggccgcaacgtctgcagcacctggggcaacttccactacaagaccttcgacggggacgtcttccgcttccccggcctctgcgactacaacttcgcctccgactgccgaggctcctacaaggaatttgctgtgcacctgaagcggggtccgggccaggctgaggcccccgccggggtggagtccatcctgctgaccatcaaggatgacaccatctacctcacccgccacctggctgtgcttaacggggccgtggtcagcaccccgcactacagccccgggctgctcattgagaagagcgatgcctacaccaaagtctactcccgcgccggcctcaccctcatgtggaaccgggaggatgcactcatgctggagctggacactaagttccggaaccacacctgtggcctctgcggggactacaacggcctgcagagctattcagaattcctctctgacggcgtgctcttcagtcccctggagtttgggaacatgcagaagatcaaccagcccgatgtggtgtgtgaggatcccgaggaggaggtggcccccgcatcctgctccgagcaccgcgccgagtgtgagaggctgctgaccgccgaggccttcgcggactgtcaggacctggtgccgctggagccgtatctgcgcgcctgccagcaggaccgctgccggtgcccgggcggtgacacctgcgtctgcagcaccgtggccgagttctcccgccagtgctcccacgccggcggccggcccgggaactggaggaccgccacgctctgccccaagacctgccccgggaacctggtgtacctggagagcggctcgccctgcatggacacctgctcacacctggaggtgagcagcctgtgcgaggagcaccgcatggacggctgtttctgcccagaaggcaccgtatatgacgacatcggggacagtggctgcgttcctgtgagccagtgccactgcaggctgcacggacacctgtacacaccgggccaggagatcaccaatgactgcgagcagtgtgtctgtaacgctggccgctgggtgtgcaaagacctgccctgccccggcacctgtgccctggaaggcggctcccacatcaccaccttcgatgggaagacgtacaccttccacggggactgctactatgtcctggccaagggtgaccacaacgattcctacgctctcctgggcgagctggccccctgtggctccacagacaagcagacctgcctgaagacggtggtgctgctggctgacaagaagaagaatgcggtggtcttcaagtccgatggcagtgtactgctcaaccagctgcaggtgaacctgccccacgtgaccgcgagcttctctgtcttccgcccgtcttcctaccacatcatggtgagcatggccattggcgtccggctgcaggtgcagctggccccagtcatgcaactctttgtgacactggaccaggcctcccaggggcaggtgcagggcctctgcgggaacttcaacggcctggaaggtgacgacttcaagacggccagcgggctggtggaggccacgggggccggctttgccaacacctggaaggcacagtcaacctgccatgacaagctggactggttggacgatccctgctccctgaacatcgagagcgccaactacgccgagcactggtgctccctcctgaagaagacagagaccccctttggcaggtgccactcggctgtggaccctgctgagtattacaagaggtgcaaatatgacacgtgtaactgtcagaacaatgaggactgcctgtgcgccgccctgtcctcctacgcgcgcgcctgcaccgccaagggcgtcatgctgtggggctggcgggagcatgtctgcaacaaggatgtgggctcctgccccaactcgcaggtcttcctgtacaacctgaccacctgccagcagacctgccgctccctctccgaggccgacagccactgtctcgagggctttgcgcctgtggacggctgcggctgccctgaccacaccttcctggacgagaagggccgctgcgtacccctggccaagtgctcctgttaccaccgcggtctctacctggaggcgggggatgtggtcgtcaggcaggaagaacgatgtgtgtgccgggatgggcggctgcactgtaggcagatccggctgatcggccagagctgcacggccccaaagatccacatggactgcagcaacctgactgcactggccacctcgaagccccgagccctcagctgccagacgctggccgccggctattaccacacagagtgtgtcagtggctgtgtgtgccccgacgggctgatggatgacggccggggtggctgcgtggtggagaaggaatgcccttgcgtccataacaacgacctgtattcttccggcgccaagatcaaggtggactgcaatacctgcacctgcaagagaggacgctgggtgtgcacccaggctgtgtgccatggcacctgctccatttacgggagtggccactacatcacctttgatgggaagtactacgactttgacggacactgctcctacgtggctgttcaggactactgcggccagaactcctcactgggctcattcagcatcatcaccgagaacgtcccctgtggcactacgggcgtcacctgctccaaggccatcaagatcttcatggggaggacggagctgaagttggaagacaagcaccgtgtggtgatccagcgtgatgagggtcaccacgtggcctacaccacgcgggaggtgggccagtacctggtggtggagtccagcacgggcatcatcgtcatctgggacaagaggaccaccgtgttcatcaagctggctccctcctacaagggcaccgtgtgtggcctgtgtgggaactttgaccaccgctccaacaacgacttcaccacgcgggaccacatggtggtgagcagcgagctggacttcgggaacagctggaaggaggcccccacctgcccagatgtgagcaccaaccccgagccctgcagcctgaacccgcaccgccgctcctgggccgagaagcagtgcagcatcctcaaaagcagcgtgttcagcatctgccacagcaaggtggaccccaagcccttctacgaggcctgtgtgcacgactcgtgctcctgtgacacgggtggggactgtgagtgcttctgctctgccgtggcctcctacgcccaggagtgtaccaaagagggggcctgcgtgttctggaggacgccggacctgtgccccatattctgcgactactacaaccctccgcatgagtgtgagtggcactatgagccatgtgggaaccggagcttcgagacctgcaggaccatcaacggcatccactccaacatctccgtgtcctacctggagggctgctacccccggtgccccaaggacaggcccatctatgaggaggatctgaagaagtgtgtcactgcagacaagtgtggctgctatgtcgaggacacccactacccacctggagcatcggttcccaccgaggagacctgcaagtcctgcgtgtgtaccaactcctcccaagtcgtctgcaggccggaggaaggaaagattcttaaccagacccaggatggcgccttctgctactgggagatctgtggccccaacgggacggtggagaagcacttcaacatctgttccattacgacacgcccgtccaccctgaccaccttcaccaccatcaccctccccaccacccccacctccttcaccactaccaccaccaccaccaccccgacctccagcacagttttatcaacaactccgaagctgtgctgcctctggtctgactggatcaatgaggaccaccccagcagtggcagcgacgacggtgaccgagaaccatttgatggggtctgcggggcccctgaggacatcgagtgcaggtcggtcaaggatccccacctcagcttggagcagcatggccagaaggtgcagtgtgatgtctctgttgggttcatttgcaagaatgaagaccagtttggaaatggaccatttggactgtgttacgactacaagatacgtgtcaattgttgctggcccatggataagtgtatcaccactcccagccctccaactaccactcccagccctccaccaaccacgacgaccacccttccaccaaccaccacccccagccctccaaccaccaccacaaccacccctccaccaaccaccacccccagccctccaataaccaccacgaccacccctctaccaaccaccactcccagccctccaataagcaccacaaccacccctccaccaaccaccactcccagccctccaaccaccactcccagccctccaaccaccactcccagccctccaacaaccaccacaaccacccctccaccaaccaccactcccagccctccaatgactacgcccatcactccaccagccagcactaccacccttccaccaaccaccactcccagccctccaacaaccaccacaaccacccctccaccaaccaccactcccagtcctccaacgactacgcccatcactccaccaaccagcactactacccttccaccaaccaccactcccagccctccaccaaccaccacaaccacccctccaccaaccaccactcccagccctccaacaaccaccactcccagtcctccaacaatcaccacaaccacccctccaccaaccaccactcccagccctccaacaacgaccacaaccacccctccaccaaccaccactcccagccctccaacgactacacccatcactccaccaaccagcactaccacccttccaccaaccaccactcccagccctccaccaaccaccacaaccacccctccaccaaccaccactcccagccctccaacaaccaccactcccagccctccaataaccaccacaaccacccctccaccaaccaccactcccagctctccaataaccaccactcccagccctccaacaaccaccatgaccaccccttcaccaaccaccacccccagctctccaataaccaccacaaccaccccttcctcaactaccactcccagccctccaccaaccaccatgaccaccccttcaccaaccaccactcccagccctccaacaaccaccatgaccacccttccaccaaccaccacttccagccctctaacaactactcctctacctccatcaataactcctcctacattttcaccattctcaacgacaacccctactaccccatgcgtgcctctctgcaattggactggctggctggattctggaaaacccaactttcacaaaccaggtggagacacagaattgattggagacgtctgtggaccaggctgggcagctaacatctcttgcagagccaccatgtatcctgatgttcccattggacagcttggacaaacagtggtgtgtgatgtctctgtggggctgatatgcaaaaatgaagaccaaaagccaggtggggtcatccctatggccttctgcctcaactacgagatcaacgttcagtgctgtgagtgtgtcacccaacccaccaccatgacaaccaccaccacagagaacccaactccgccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccgggccccccacccacacaagcacagcaccgattgctgagttgaccacatccaatcctccgcctgagtcctcaacccctcagacctctcggtccacctcttcccctctcacggagtcaaccacccttctgagtaccctaccacctgccattgagatgaccagcacggccccaccctccacacccacggcacccacgaccacgagcggaggccacacactgtctccaccgcccagcaccaccacgtcccctccaggcacccccactcgcggtaccacgaccgggtcatcttcagcccccacccccagcactgtgcagacgaccaccaccagtgcctggaccccaacgccgaccccactctccacacccagcatcatcaggaccacaggcctgaggccctacccttcctctgtgcttatctgctgtgtcctgaacgacacctactacgcaccaggtgaggaggtgtacaacggcacatacggagacacctgttatttcgtcaactgctcactgagctgtacgttggagttctataactggtcctgcccatccacgccctccccaacacccacgccctccaagtcgacgcccacgccttccaagccatcgtccacgccctccaagccgacgcccggcaccaagccccccgagtgcccagactttgatcctcccagacaggagaacgagacttggtggctgtgcgactgcttcatggccacgtgcaagtacaacaacacggtggagatcgtgaaggtggagtgtgagccgccgcccatgcccacctgctccaacggcctccaacccgtgcgcgtcgaggaccccgacggctgctgctggcactgggagtgcgactgctactgcacgggctggggcgacccgcactatgtcaccttcgacggactctactacagctaccagggcaactgcacctacgtgctggtggaggagatcagcccctccgtggacaacttcggagtttacatcgacaactaccactgcgatcccaacgacaaggtgtcctgtccccgcaccctcatcgtgcgccacgagacccaggaggtgctgatcaagaccgtgcatatgatgcccatgcaggtgcaggtgcaggtgaacaggcaggcggtggcactgccctacaagaagtacgggctggaggtgtaccagtctggcatcaactacgtggtggacatccccgagctgggtgtcctcgtctcctacaatggcctgtccttctccgtcaggctgccctaccaccggtttggcaacaacaccaagggccagtgtggcacctgcaccaacaccacctccgacgactgcattctgcccagcggggagatcgtctccaactgtgaggctgcggctgaccagtggctggtgaacgacccctccaagccacactgcccccacagcagctccacgaccaagcgcccggccgtcactgtgcccgggggcggtaaaacgaccccacacaaggactgcaccccatctcccctctgccagctcatcaaggacagcctgtttgcccagtgccacgcactggtgcccccgcagcactactacgatgcctgcgtgttcgacagctgcttcatgccgggctcgagcctggagtgcgccagtctgcaggcctacgcagccctctgtgcccagcagaacatctgcctcgactggcggaaccacacgcatggggcctgcttggtggagtgcccatctcacagggagtaccaggcctgtggccctgcagaagagcccacgtgcaaatccagctcctcccagcagaacaacacagtcctggtggaaggctgcttctgtcctgagggcaccatgaactacgctcctggctttgatgtctgcgtgaagacctgcggctgtgtgggacctgacaatgtgcccagagagtttggggagcacttcgagttcgactgcaagaactgtgtctgcctggagggtggaagtggcatcatctgccaacccaagaggtgcagccagaagcccgttacccactgcgtggaagacggcacctacctcgccacggaggtcaaccctgccgacacctgctgcaacattaccgtctgcaagtgcaacaccagcctgtgcaaagagaagccctccgtgtgcccgctgggattcgaagtgaagagcaagatggtgcctggaaggtgctgtcccttctactggtgtgagtccaagggggtgtgtgttcacgggaatgctgagtaccagcccggttctccagtttattcctccaagtgccaggactgcgtgtgcacggacaaggtggacaacaacaccctgctcaacgtcatcgcctgcacccacgtgccctgcaacacctcctgcagccctggcttcgaactcatggaggcccccggggagtgctgtaagaagtgtgaacagacgcactgtatcatcaaacggcccgacaaccagcacgtcatcctgaagcccggggacttcaagagcgacccgaagaacaactgcacattcttcagctgcgtgaagatccacaaccagctcatctcgtccgtctccaacatcacctgccccaactttgatgccagcatttgcatcccgggctccatcacattcatgcccaatggatgctgcaagacctgcacccctcgcaatgagaccagggtgccctgctccaccgtccccgtcaccacggaggtttcgtacgccggctgcaccaagaccgtcctcatgaatcattgctccgggtcctgcgggacatttgtcatgtactcggccaaggcccaggccctggaccacagctgctcctgctgcaaagaggagaaaaccagccagcgtgaggtggtcctgagctgccccaatggcggctcgctgacacacacctacacccacatcgagagctgccagtgccaggacaccgtctgcgggctccccaccggcacctcccgccgggcccggcgctcccctaggcatctggggagcgggtgagcggggtgggcacagcccccttcactgccctcgacagctttacctcccccggaccctctgagcctcctaagctcggcttcctctcttcagatatttattgtctgagtctttgttcagtccttgctttccaataataaactcagggggacatgc

SEQ ID NO: 60480 - DNA, 2639 bp, Homo sapiens
atgtgtcccctggattttggtgcagccatttgcacaaccgatgcgcaggcagtgtcacttgcgctgacgtctgtctgtccgggtgcagggagaagggaggaagaggggagaggtggggcggtgcaaagccccctgcccgctgggcccatgcagctgttggggctcctcggcctcctctggatgctcaaggcctccccgtgggccacagtcagttccaacacctcaaccaccccgacgtccaagtttgccttcaaggttgaaaccactccacccaccgtgttggtctattcagccaccactgagtgcgtgtatccaacgagctttataatcaccatctcccaccccacctccatctgtgtgaccacgacgcaggtggccttcaccagctcttacacctcgactcccgtgacacagaagccagtgaccaccgtcaccagtacttactctatgaccactactgagaaaggaactcacctcacacagtactcccagattcacttcttcaatcaccactaccgagaccccctcacacagtactcccagattcacttcttcattcaccaataccaagaccacctcacacagatctcccagcttcacttctttgatcaccaccacggagaccacctcacacagtactcccagcttcacttcttcgatcaccaccaccgagaccacctcacacagtgctcgcagcttcacttcttcgatcaccaccaccgagaccacctcacacaatactcggagcttcacttcttcgatcaccaccaccgagaccaactctcacagtactaccagcttcacttcttcgatcaccaccaccgagaccacctcacacatcagcacatccacaactgccatcacctcacattttactacctcagagactgcggtgactcccacacctgtaaccccatcttctctgagtacagacatcccgaccacaagcctacgaactctcaccccttcgtctacccctcctgtactgacgtcagccactgggacccaaacatctcctgcacctactactgtcacctttggaagtacggattcctccacgtccactcttcatactcttactccatcaacagccttgagcacgatcgtgtcaacatcacaggcacctgtgacaatggtggcacctgggaacagggacagtgtgcttgccttccggggttttctggggaccgctgtcagctccagaccagatgccagaatgggggtcagtgggatggcctcaaatgccagtgccccagcaccttctatggttccagttgtgagtttgctgtggaacaggtggatctagatgtagtggagaccgaggtgggcatggaagtgtctgtggatcagcagttctcgccggacctcaatgacaacacttcccaggcctacagggatttcaacaagaccttctggaatcagatgcagaagatttttgcagacatgcagggcttcaccttcaagggtgtggagatcctgtccctgaggaatggcagcatcgtggtggactacctggtcctgctggagatgcccttcagcccccagctggagagcgagtatgagcaggtgaagaccacgctgaaggaggggctccagaacgccagccaggatgcgaacagctgccaggactcccagaccctgtgttttaagcctgactccatcaaggtgaacaacaacagcaagacagagctgaccccggaagccatctgccgccgcgccgctcccacgggctatgaagagttctacttccctctggtggaggccacccggctccgctgtgtcaccaaatgcacgtcgggcgtggacaacgccatcgactgtcaccagggccagtgcgttctagagacgagcggtcccgcgtgtcggtcctgggaccaggacaggaaatggttcgagacctgggatgaggaagtcgtgggcactttttcaaactggggtttcgaggacgacggaacagacaaggatacaaatttccatgtggccttggagaacgtggacaccactatgaaggtgcacatcaagagacccgagatgacctcgtcctcagtgtgagccctgcggggccccttcaccaccccctccgccctgccccggacacaagggtctgcattgcgtccatttcaagaggtggccccaggacgcgggcagcccaggctcctgctgttcttgggcaagatgagactgttcccccaaatcccatccttctccttccaacttggctgaaacccacctggagacgcagttcacgtccaggctcttccactgtggaatcttgggcaagtcagtaacgagcctcagtttcctcacctgcaaaacgggtacagcattcctgtatgatagctcacgccgtcgttgtgaaaaccacatagacttggtcaattctcggtcctactctgccctcccgtctcagccctcgtgttgccattgcctctctcggatcctccaatcctcacgtccttcacctggtctctggccctggttcttattttctctcaattccctactgcctgtttcttactttgaacctggaggcagcctgcagccccatcccatctcctgccctctcctgatctaactccctgctgcatctcttgctctcattccttagacgtcctccccttttgaccccgttccttcat

SEQ ID NO: 60481 - DNA, 1520 bp, Homo sapiens
atgctctgtgcagatgtagtggagaccgaggtgggcatggaagtgtctgtggatcagcagttctcgccggacctcaatgacaacacttcccaggcctacagggatttcaacaagaccttctggaatcagatgcagaagatttttgcagacatgcagggcttcaccttcaagggtgtggagatcctgtccctgaggaatggcagcatcgtggtggactacctggtcctgctggagatgcccttcagcccccagctggagagcgagtatgagcaggtgaagaccacgctgaaggaggggctccagaacgccagccaggatgcgaacagctgccaggactcccagaccctgtgttttaagcctgactccatcaaggtgaacaacaacagcaagacagagctgaccccggaagccatctgccgccgcgccgctcccacgggctatgaagagttctacttccctctggtggaggccacccggctccgctgtgtcaccaaatgcacgtcgggcgtggacaacgccatcgactgtcaccagggccagtgcgttctagagacgagcggtcccgcgtgtcgctgctactccaccgacacgcactggttctctggcccgcgctgcgaggtggccgtccactggagggcgctggtcgggggcctgacggccggcgccgcgctgctggtgctgctgctgctggcgctgggcgtccgggcggtgcgctccggatggtggggcggccagcgccgaggccggtcctgggaccaggacaggaaatggttcgagacctgggatgaggaagtcgtgggcactttttcaaactggggtttcgaggacgacggaacagacaaggatacaaatttccatgtggccttggagaacgtggacaccactatgaaggtgcacatcaagagacccgagatgacctcgtcctcagtgtgagccctgcggggccccttcaccaccccctccgccctgccccggacacaagggtctgcattgcgtccatttcaagaggtggccccaggacgcgggcagcccaggctcctgctgttcttgggcaagatgagactgttcccccaaatcccatccttctccttccaacttggctgaaacccacctggagacgcagttcacgtccaggctcttccactgtggaatcttgggcaagtcagtaacgagcctcagtttcctcacctgcaaaacgggtacagcattcctgtatgatagctcacgccgtcgttgtgaaaaccacatagacttggtcaattctcggtcctactctgccctcccgtctcagccctcgtgttgccattgcctctctcggatcctccaatcctcacgtccttcacctggtctctggccctggttcttattttctctcaattccctactgcctgtttcttactttgaacctggaggcagcctgcagccccatcccatctcctgccctctcctgatctaactccctgctgcatctcttgctctcattccttagacgtcctccccttttgaccccgttccttcat

SEQ ID NO: 60482 - DNA, 2059 bp, Homo sapiens
attctggggctcgggggatcccggacaccctctcagctcctgcccgggggcccatgtagtcccttctgccctgtgcctcggtgcctgtgacctgagccccttggttgaccctgcactcgtccaacttgggccaaacgactgcccctccttctggcagtgggctggaccagccggccagcgggagcccccttggcagaagccggtcgtaaaggatcataaactggcggcgtctggctggggcgaaggtcgctgaggtaggaactgcgccagtcctagacgccagacccgctcagaccctcctgccaggtgacagccgccaagatggggtcttgggccctgctgtggcctcccctgctgttcaccgggctgctcgtccgacccccggggaccatggcccaggcccagtactgctctgtgaacaaggacatctttgaagtagaggagaacacaaatgtcaccgagccgctggtggacatccacgtcccggagggccaggaggtgaccctcggagccttgtccaccccctttgcatttcggatccagggaaaccagctgtttctcaacgtgactcctgattacgaggagaagtcactgcttgaggctcagctgctgtgtcagagcggaggcacattggtgacccagctaagggtgttcgtgtcagtgctggacgtcaatgacaatgcccccgaattcccctttaagaccaaggagataagggtggaggaggacacgaaagtgaactccaccgtcatccccgagacgcaactgcaggctgaggaccgcgacaaggacgacattctgttctacaccctccaggaaatgacagcaggtgccagtgactacttctccctggtgagtgtaaaccgtcccgccctgaggctggaccggcccctggacttctacgagcggccgaacatgaccttctggctgctggtgcgggacactccgggggagaatgtggaacccagccacactgccaccgccacactagtgctgaacgtggtgcccgccgacctgcggcccccgtggttcctgccctgcaccttctcagatggctacgtctgcattcaagctcagtaccacggggctgtccccacggggcacatactgccatctcccctcgtcctgcgtcccggacccatctacgctgaggacggagaccgcggcatcaaccagcccatcatctacagcatctttaggggaaacgtgaatggtacattcatcatccacccagactcgggcaacctcaccgtggccaggagtgtccccagccccatgaccttccttctgctggtgaagggccaacaggccgaccttgcccgctactcagtgacccaggtcaccgtggaggctgtggctgcggccgggagcccgccccgcttcccccagagcctgtatcgtggcaccgtggcgcgtggcgctggagcgggcgttgtggtcaaggatgcagctgccccttctcagcctctgaggatccaggctcaggacccggagttctcggacctcaactcggccatcacatatcgaattaccaaccactcacacttccggatggagggagaggttgtgctgaccaccaccacactggcacaggcgggagccttctacgcagaggttgaggcctgcaccggagatctcaggcacccggctcaactcagacctcccgctcccgaccctacacagagattgcctggggaggctgaggagccgatgcaaacccccaaggcgacgcacttgggagccggtggtctcaaacacctgccgggggtcctagtccccttctgaaatctacatgcttgggttggagcgcagcagtaaacaccctgcccagtgacctggactgaggcgcgctgggggtgggtgcgccgtgtggcctgagcaggagccagaccaggaggcctaggggtgagagacacattcccctcgctgctcccaaagccagagcccaggctgggcgcccatgcccagaaccatcaagggatcccttgcggcttgtcagcactttccctaatggaaatacaccattaattcctttccaaatgaaaaaaaaaaaaaaaaa

SEQ ID NO: 60483 - DNA, 2973 bp, Homo sapiens
attctggggctcgggggatcccggacaccctctcagctcctgcccgggggcccatgtagtcccttctgccctgtgcctcggtgcctgtgacctgagccccttggttgaccctgcactcgtccaacttgggccaaacgactgcccctccttctggcagtgggctggaccagccggccagcgggagcccccttggcagaagccggtcgtaaaggatcataaactggcggcgtctggctggggcgaaggtcgctgaggtaggaactgcgccagtcctagacgccagacccgctcagaccctcctgccaggtgacagccgccaagatggggtcttgggccctgctgtggcctcccctgctgttcaccgggctgctcgtccgacccccggggaccatggcccaggcccagtactgctctgtgaacaaggacatctttgaagtagaggagaacacaaatgtcaccgagccgctggtggacatccacgtcccggagggccaggaggtgaccctcggagccttgtccaccccctttgcatttcggatccagggaaaccagctgtttctcaacgtgactcctgattacgaggagaagtcactgcttgaggctcagctgctgtgtcagagcggaggcacattggtgacccagctaagggtgttcgtgtcagtgctggacgtcaatgacaatgcccccgaattcccctttaagaccaaggagataagggtggaggaggacacgaaagtgaactccaccgtcatccccgagacgcaactgcaggctgaggaccgcgacaaggacgacattctgttctacaccctccaggaaatgacagcaggtgccagtgactacttctccctggtgagtgtaaaccgtcccgccctgaggctggaccggcccctggacttctacgagcggccgaacatgaccttctggctgctggtgcgggacactccgggggagaatgtggaacccagccacactgccaccgccacactagtgctgaacgtggtgcccgccgacctgcggcccccgtggttcctgccctgcaccttctcagatggctacgtctgcattcaagctcagtaccacggggctgtccccacggggcacatactgccatctcccctcgtcctgcgtcccggacccatctacgctgaggacggagaccgcggcatcaaccagcccatcatctacagcatctttaggggaaacgtgaatggtacattcatcatccacccagactcgggcaacctcaccgtggccaggagtgtccccagccccatgaccttccttctgctggtgaagggccaacaggccgaccttgcccgctactcagtgacccaggtcaccgtggaggctgtggctgcggccgggagcccgccccgcttcccccagagcctgtatcgtggcaccgtggcgcgtggcgctggagcgggcgttgtggtcaaggatgcagctgccccttctcagcctctgaggatccaggctcaggacccggagttctcggacctcaactcggccatcacatatcgaattaccaaccactcacacttccggatggagggagaggttgtgctgaccaccaccacactggcacaggcgggagccttctacgcagaggttgaggcccacaacacggtgacctctggcaccgcaaccacagtcattgagatacaagtttccgaacaggagcccccctccacagatgtccccccatccccagaggctggaggaacaactgggccctggaccagcaccacttccgaggtccccagaccccctgagccctcccagggaccctccacgaccagctctgggggaggcacaggccctcatccaccctctggcacaactctgaggccaccaacctcgtccacacccggggggtccccgggtgcagaaaacagcacctcccaccaaccagccactcccggtggggacacagcacagaccccaaagccaggaacctctcagccgatgccccccggtgtgggaaccagcacctcccaccaaccagccacacccagtgggggcacagtacagaccccagagccaggaacctctcagccgatgccccccagtatgggaaccagcacctcccaccaaccagccacacccggtgggggcacagcacagaccccagaggcaggaacctctcagccgatgccccccggtatgggaaccagcacctcccaccaaccaaccacacccggtgggggcacagcacagaccccagagccaggaacctctcagccgatgcccctcagcaagagcaccccatcttcaggtggcggcccctcggaggacaagcgcttctcggtggtggatatggcggccctgggcggggtgctgggtgcgctgctgctgctggctctccttggcctcgccgtccttgtccacaagcactatggcccccggctcaagtgctgctctggcaaagctccggagccccagccccaaggctttgacaaccaggcgttcctccctgaccacaaggccaactgggcgcccgtccccagccccacgcacgaccccaagcccgcggaggcaccgatgcccgcagagcccgcaccccccggccctgcctccccaggcggtgcccctgagccccccgcagcggcccgagctggcggaagccccacggcggtgaggtccatcctgaccaaggagcggcggccagagggcgggtacaaggctgtctggtttggcgaggacatcgggacggaggcagacgtggtcgttctcaacgcgcccaccctggacgtggatggcgccagtgactccggcagcggcgatgagggcgagggcgcggggaggggtgggggtccctacgatgcgcccggtggtgatgactcctacatctaagtggcccctccaccctctcccccagccgcacgggcactggaggtctcgctcccccagcctccgacccgaggcagaataaagcaaggctcccgaaacccaaaaaaaaaaaaaaaa

SEQ ID NO: 60484 - DNA, 2134 bp, Homo sapiens
gaggtaggaactgcgccagtcctagacgccagacccgctcagaccctcctgccaggtgacagccgccaagatggggtcttgggccctgctgtggcctcccctgctgttcaccgggctgctcgtccgacccccggggaccatggcccaggcccagtactgctctgtgaacaaggacatctttgaagtagaggagaacacaaatgtcaccgagccgctggtggacatccacgtcccggagggccaggaggtgaccctcggagccttgtccaccccctttgcatttcggatccagggaaaccagctgtttctcaacgtgactcctgattacgaggagaagtcactgcttgaggctcagctgctgtgtcagagcggaggcacattggtgacccagctaagggtgttcgtgtcagtgctggacgtcaatgacaatgcccccgaattcccctttaagaccaaggagataagggtggaggaggacacgaaagtgaactccaccgtcatccccgagacgcaactgcaggctgaggaccgcgacaaggacgacattctgttctacaccctccaggaaatgacagcaggtgccagtgactacttctccctggtgagtgtaaaccgtcccgccctgaggctggaccggcccctggacttctacgagcggccgaacatgaccttctggctgctggtgcgggacactccgggggagaatgtggaacccagccacactgccaccgccacactagtgctgaacgtggtgcccgccgacctgcggcccccgtggttcctgccctgcaccttctcagatggctacgtctgcattcaagctcagtaccacggggctgtccccacggggcacatactgccatctcccctcgtcctgcgtcccggacccatctacgctgaggacggagaccgcggcatcaaccagcccatcatctacagcatctttaggggaaacgtgaatggtacattcatcatccacccagactcgggcaacctcaccgtggccaggagtgtccccagccccatgaccttccttctgctggtgaagggccaacaggccgaccttgcccgctactcagtgacccaggtcaccgtggaggctgtggctgcggccgggagcccgccccgcttcccccagagcctgtatcgtggcaccgtggcgcgtggcgctggagcgggcgttgtggtcaaggatgcagctgccccttctcagcctctgaggatccaggctcaggacccggagttctcggacctcaactcggccatcacatatcgaattaccaaccactcacacttccggatggagggagaggttgtgctgaccaccaccacactggcacaggcgggagccttctacgcagaggttgaggcccacaacacggtgacctctggcaccgcaaccacagtcattgagatacaagtttccgaacaggagcccccctccacaggtggcggcccctcggaggacaagcgcttctcggtggtggatatggcggccctgggcggggtgctgggtgcgctgctgctgctggctctccttggcctcgccgtccttgtccacaagcactatggcccccggctcaagtgctgctctggcaaagctccggagccccagccccaaggctttgacaaccaggcgttcctccctgaccacaaggccaactgggcgcccgtccccagccccacgcacgaccccaagcccgcggaggcaccgatgcccgcagagcccgcaccccccggccctgcctccccaggcggtgcccctgagccccccgcagcggcccgagctggcggaagccccacggcggtgaggtccatcctgaccaaggagcggcggccagagggcgggtacaaggctgtctggtttggcgaggacatcgggacggaggcagacgtggtcgttctcaacgcgcccaccctggacgtggatggcgccagtgactccggcagcggcgatgagggcgagggcgcggggaggggtgggggtccctacgatgcgcccggtggtgatgactcctacatctaagtggcccctccaccctctcccccagccgcacgggcactggaggtctcgctcccccagcctccgacccgaggcagaataaagcaaggctcccgaaaaaaaaaaaaaaaa

SEQ ID NO: 60485 - DNA, 2837 bp, Homo sapiens
agaccctcctgccaggtgacagccgccaagatggggtcttgggccctgctgtggcctcccctgctgttcaccgggctgctcgtccgacccccggggaccatggcccaggcccagtactgctctgtgaacaaggacatctttgaagtagaggagaacacaaatgtcaccgagccgctggtggacatccacgtcccggagggccaggaggtgaccctcggagccttgtccaccccctttgcatttcggatccagggaaaccagctgtttctcaacgtgactcctgattacgagaaggctgggccatttcgggatgaagctgcctgggcccacaccctcagcactgaccactgatgatggggaccctgggccagcgcctgcccacttggcctcagtctccccacctgtggggcaggacggtgactgcagacctgtctacatccacaggagaagtcactgcttgaggctcagctgctgtgtcagagcggaggcacattggtgacccagctaagggtgttcgtgtcagtgctggacgtcaatgacaatgcccccgaattcccctttaagaccaaggagataagggtggaggaggacacgaaagtgaactccaccgtcatccccgagacgcaactgcaggctgaggaccgcgacaaggacgacattctgttctacaccctccaggaaatgacagcaggtgccagtgactacttctccctggtgagtgtaaaccgtcccgccctgaggctggaccggcccctggacttctacgagcggccgaacatgaccttctggctgctggtgcgggacactccgggggagaatgtggaacccagccacactgccaccgccacactagtgctgaacgtggtgcccgccgacctgcggcccccgtggttcctgccctgcaccttctcagatggctacgtctgcattcaagctcagtaccacggggctgtccccacggggcacatactgccatctcccctcgtcctgcgtcccggacccatctacgctgaggacggagaccgcggcatcaaccagcccatcatctacagcatctttaggggaaacgtgaatggtacattcatcatccacccagactcgggcaacctcaccgtggccaggagtgtccccagccccatgaccttccttctgctggtgaagggccaacaggccgaccttgcccgctactcagtgacccaggtcaccgtggaggctgtggctgcggccgggagcccgccccgcttcccccagagcctgtatcgtggcaccgtggcgcgtggcgctggagcgggcgttgtggtcaaggatgcagctgccccttctcagcctctgaggatccaggctcaggacccggagttctcggacctcaactcggccatcacatatcgaattaccaaccactcacacttccggatggagggagaggttgtgctgaccaccaccacactggcacaggcgggagccttctacgcagaggttgaggcccacaacacggtgacctctggcaccgcaaccacagtcattgagatacaagtttccgaacaggagcccccctccacagatgtccccccatccccagaggctggaggaacaactgggccctggaccagcaccacttccgaggtccccagaccccctgagccctcccagggaccctccacgaccagctctgggggaggcacaggccctcatccaccctctggcacaactctgaggccaccaacctcgtccacacccggggggtccccgggtgcagaaaacagcacctcccaccaaccagccactcccggtggggacacagcacagaccccaaagccaggaacctctcagccgatgccccccggtgtgggaaccagcacctcccaccaaccagccacacccagtgggggcacagtacagaccccagagccaggaacctctcagccgatgccccccagtatgggaaccagcacctcccaccaaccagccacacccggtgggggcacagcacagaccccagaggcaggaacctctcagccgatgccccccggtatgggaaccagcacctcccaccaaccaaccacacccggtgggggcacagcacagaccccagagccaggaacctctcagccgatgcccctcagcaagagcaccccatcttcaggtggcggcccctcggaggacaagcgcttctcggtggtggatatggcggccctgggcggggtgctgggtgcgctgctgctgctggctctccttggcctcgccgtccttgtccacaagcactatggcccccggctcaagtgctgctctggcaaagctccggagccccagccccaaggctttgacaaccaggcgttcctccctgaccacaaggccaactgggcgcccgtccccagccccacgcacgaccccaagcccgcggaggcaccgatgcccgcagagcccgcaccccccggccctgcctccccaggcggtgcccctgagccccccgcagcggcccgagctggcggaagccccacggcggtgaggtccatcctgaccaaggagcggcggccagagggcgggtacaaggctgtctggtttggcgaggacatcgggacggaggcagacgtggtcgttctcaacgcgcccaccctggacgtggatggcgccagtgactccggcagcggcgatgagggcgagggcgcggggaggggtgggggtccctacgatgcgcccggtggtgatgactcctacatctaagtggcccctccaccctctcccccagccgcacgggcactggaggtctcgctcccccagcctccgacccgaggcagaataaagcaaggctcccgaaaaaaaaaaaaaaaaaaaaaaaa

SEQ ID NO: 60486 - DNA, 6656 bp, Homo sapiens
atgtcggggttcaggctgggtgaccacgtgtggctggagcctccctccacccacaagaccggcgtggccatcgggggcatcatcaaagaggcaaagccaggcaaagtcttggttgaagatgacgagggcaaggaacactggatccgagcagaggactttggtgtcctcagtcccatgcaccccaactcagtccagggtgtggacgacatgatccgcctgggggacctgaacgaggcaggcatggtgcacaacctcctgatccgctaccagcagcacaagatctatacatacacaggctccatcctggtggccgtcaacccgttccaggtgctgccgctctacaccctggagcaggtacagctctactacagccgccatatgggcgagctgcccccgcatgtctttgccatcgccaacaactgctacttcagcatgaagaggaacaagagggaccagtgctgcatcatcagcggcgagtctggggctggcaagacggagaccaccaagctcatcctgcagttcctggccaccatcagtggccagcattcgtggattgagcagcaggtcctggaagccaaccccatcctggaggcctttggaaatgccaagacaatccgcaacgacaactcaagccgctttgggaagtacattgacatctactttaaccccagcggggtgatcgagggcgcgcgcatcgagcaatttctcctggagaagtcccgggtctgccggcaggctcccgaggagcggaactaccatatcttctactgcatgctcatgggggtgagtgctgaggacaagcagctgctgagcctgggcacgccctccgagtaccactacctgaccatggggaactgcacttcctgtgaggggctcaacgacgccaaggactacgcccacatccgctcggccatgaagatcctccagttctccgactccgagagctgggacgtcatcaagctgctggctgccattctccacctggggaatgtggggttcatggcttcggtcttcgagaacctggacgcctcagacgtgatggagacgcccgcctttcccaccgtgatgaagttactggaggtgcagcaccaggagctccgggactgtctgatcaagcacaccatcctcatccgaggggaatttgtcaccaggtccctgaacattgcccaggctgctgaccggagggacgcctttgtcaagggcatctatgggcacctcttcctgtggattgtcaagaagatcaatgccgccatcttcacaccaccagcccaggaccccaaaaatgtgcggagggccatcggcctcctggacatatttggctttgaaaatttcgagaacaatagcttcgagcagctctgcatcaacttcgccaacgagcacctgcagcagttctttgtgcagcacgtgttcaccatggagcaagaggagtaccgctcggagaacatctcctgggactatatccactacaccgacaatcggcccaccctggacctgctggccctcaagcccatgagcatcatctccctcctggacgaagaaagccgcttcccgcaggggacagatctcaccatgctgcaaaagctgaacagcgtccatgccaacaacaaggccttcctacagcccaagaacatccacgatgccagatttggcattgcccattttgccggcgaggtgtactaccaagcagaaggcttcctggagaagaaccgagacgtgctgagcacagatatcctcaccctggtttactcctccaaaaacaagtttctgagggagatattcaacttggagttagcagagaccaagctgggccatgggaccatccgccaggcaaaggcaggaaaccatctcttcaagtctgcagactcaaataaacggccctccaccttaggaagccagttcaaacagtctctggaccagctgatgaaaatcctgaccaactgccagccttacttcatccgctgcatcaaacctaatgagtacaagaagccgctgctgttcgaccgggagctgtgcctgcggcagctgcgatactcgggcatgatggagaccgtgcacatccgcaagtcgggcttccccatccgctacacgttcgaggagttctcgcagaggttcggcgtgttgctgcccaacgccatgcggatgcagctgcaaggcaagctccgccagatgaccctgggcatcactgacgtgtggctgcggacagacaaagactggaaagcggggaagacaaaaattttcctgagggatcatcaggacactctgctggaggtacagagaagccaggtgctagacagagcggcgctcagcatccagaaagtccttcggggctacagatacaggaaggagttcctgaggcagaggcgggcagctgtgaccctgcaggcctggtggagaggctactgcaacaggaggaatttcaagctgatcctcgtgggctttgagcgcctgcaggctattgcccggagccagccgctggcgaggcagtaccaggccatgcggcagaggacagtccagctgcaggccctgtgcaggggatacctggtgcgccagcaagtccaggccaagaggagggcagtggtggtcattcaggcccatgccaggggcatggctgcccggcgcaacttccagcaaaggaaggccaatgcgccgctggtcatcccggccgaggggcagaaaagccaaggcgctctccctgccaagaagcgcagatccatctacgacaccgtcactgacacggagatggtggagaaggtgttcggcttcctccctgccatgattgggggccaggagggccaggcctcgccgcactttgaggatctggaatcgaagacccagaagctgcttgaggttgacctggacacagtccccatggcggaggagcctgaggaggatgtggatggcctggccgagtacaccttccccaagtttgctgtgacttacttccagaaatcagccagccacacacacatccggcggcccctccgatacccgttgctttaccacgaagatgacactgactgcttggccgccctggtcatatggaacgtcatcctgaggttcatgggtgatctcccagagccagtgctgtatgccaggagcagccagcagggcagctcagtgatgcggcagatccatgacacgctgggcagggagcacggtgcccaggttccacagcacagtagatctgcacaggtggccagccagctgaacattggagaggaggcattggagcctgatggccttggtgcagaccggcccatgtccaacctggagaaggtgcacttcatcgtgggctacgccatcctgcggcccagcctcagggatgagatttactgccagatctgcaagcagctctcggagaacttcaaaacaagcagcctggcccggggctggatcctgctcagcctctgcctcggctgcttcccaccctcagagaggttcatgaagtatctactgaacttcatcggccaagggccggcgacctacggccccttctgtgccgagcgcctgagacgcacctatgccaatggggtgcgtgcggagccccccacctggctggagctgcaggctgtcaagtccaagaagcacatccccatccaagtcatcttggccactggagagagcctaaccgtccccgtggactcagcctccacatctcgggaaatgtgcatgcacatcgctcacaagcagggcctcagcgaccacctgggcttctccctccaggtcgccgtgtacgacaagttctggtccctgggcagcgggcgcgaccacatgatggatgccatcgcccggtgtgagcagatggcccaggagaggggcgagagccagcgccagtcaccctggcgcatctacttccggaaggaattcttcaccccctggcacgactcccgggaggaccctgtcagcaccgagcttatttaccgccaagtcctccgaggagtctggtctggcgagtacagcttcgagaaggaggaagagctggttgagctgctggcccggcactgctacgtgcagctcggcgcctcagcagagagcaaggctgtccaggagctgctgcccagctgcatcccccacaagctgtacaggaccaagcccccagacaggtgggcgagcctcgtcactgccgcctgcgccaaggccccatacactcagaagcaagtcacaccactggccgtgcgagagcaggtggtggacgccgcccgcctgcagtggccgctgctcttctcccggctcttcgaagtcatcacactctcaggcccccgcctgcccaagacgcagctgatcttggctgttaactggaaggggctttgcttcctggaccagcaggagaagatgctgctggaactctctttcccagaggtcatgggtctggccaccaacagggaggcccagggcgggcagaggctgctgctctccacgatgcatgaggagtacgagtttgtgtcacccagcagtgtggccatcgctgagctggtggccctgttcctggagggcctgaaggagaggtccattttcgccatggccctgcaggacaggaaggccacagatgacaccaccctcctggccttcaagaagggggacctgttggtcctcacaaagaagcaggggctgctggcctctgagaactggaccctcggccagaacgacaggacaggcaagacggggctggtgcccatggcctgcctctacaccatccccacggtcactaagccctcggcacagctgctgagcttgcttgccatgtcaccagagaagaggaagctggcggctcaggaggggcagttcacagagccacgtcctgaggagccacccaaggaaaagctgcacaccctggaggagttctcctatgagttcttcagggctccagagaaggacatggtgagcatggccgtgctgcccctggcccgtgcccgtggccacctgtgggcctattcctgcgagccgctgcgacagccgctgctcaagcgagtccacgccaacgtcgacctctgggacatcgcctgccagatctttgtcgccatcctccggtacatgggcgactacccttctcggcaggcctggcccaccctggagctcaccgaccagatcttcacactggccctgcagcacccggccctccaggacgaggtctactgccagatcctgaagcagctgacgcacaactccaacaggcacagcgaagagcggggctggcagctgctgtggctgtgcacgggcctcttcccgcccagcaaggggctgctgccccatgcccagaagtttatagacactcggagggggaagctgctggcccccgactgcagccgccgaatccagaaggtcctgaggacggggccccggaagcagcccccgcaccaggtggaggtggaggccgcagagcagaacgtctcccgcatctgccacaagatctacttccccaatgacaccagtgagatgctggaggtggttgccaacacacgggtgcgggatgtgtgtgacagcattgccaccaggctgcagctggcctcctgggagggctgcagcctcttcatcaagatttcagacaaggtcatcagccagaaggagggagacttcttctttgattccttgagggaggtgtctgactgggtgaagaagaacaagccccagaaagaaggggcccccgtgacgctcccctaccaggtgtacttcatgcggaaattgtggctcaacatatctccagggaaggatgtgaatgcagacaccatactccattaccaccaggagctgcccaagtacctgcgcggattccacaagtgttcgcgggaggatgccatccacctggcgggcctcatctacaaggcccagttcaacaacgaccggtcccagctggctagtgtccccaagatcctgagggaactggtgcctgagaacctcacacgcctgatgtcctcggaggagtggaaaaagagcatccttctagcctatgacaagcataaggacaagacagtggaggaggccaaggtggccttcctgaagtggatctgccggtggcccaccttcggatccgccttcttcgaggtgaagcaaacctcggagccttcctacccggacgtcatcctcatcgccatcaaccgacatggggttctgctcatccaccccaagaccaaggacctgctcaccacctatcccttcaccaagatctccagctggagcagcggcagcacctacttccacatggcgctggggagcctgggccgtggcagccgcctgctgtgcgagacctccctgggctataagatggatgacctgctgacctcatatgtgcagcagctcctgagtgccatgaacaagcagcggggctccaaggccccagccctggccagcacctagcagcggatgctggcgtgtctgctcaggcgcccttcccgacctctagcctggcggcaccttcccaggccctctcaacccagggcctgtccttggcgggcagccttccatgctgccccccatacaaagcccactcagccccgcaggcggccccctctgtcctgggcgctgcccagggaggccaaaagacgggcccagaatggggtcgggagtctcggacccccaggctattggtggatgactgactgacaggacacctcccaaccccaccccaccccaccagaatgttcaataaaaactcctggagc

SEQ ID NO: 60487 - DNA, 2679 bp, Homo sapiens
atggaccagccagaggccccctgctccagcacggggccgcgcctcgcggtggcccgcgagctgctcctggctgcgctggaggaactgagccaagagcagctgaagcgcttccgccacaagctgcgcgacgtgggcccggacggacgcagcatcccgtgggggcggctggagcgcgcggacgccgtggacctcgcggagcagctggcccagttctacggcccggagcctgccctggaggtggcccgcaagaccctcaagagggcggacgcgcgcgacgtggcggcgcagctccaggagcggcggctgcagcggctcgggctcggctccgggacgctgctctccgtgtccgagtacaagaagaagtaccgggagcacgtgctgcagctgcacgctcgggtgaaggagaggaacgcccgctccgtgaagatcaccaagcgcttcaccaagctgctcatcgcgcccgagagcgccgccccggaggaggcgctggggcccgcggaagagcctgagccggggcgcgcgcggcgctcggacacgcacactttcaaccgcctcttccgccgcgacgaggagggccggcggccgctgaccgtggtgctgcagggcccggcgggcatcggcaagaccatggcggccaaaaagatcctgtacgactgggcggcgggcaagctgtaccagggccaggtggacttcgccttcttcatgccctgcggcgagctgctggagaggccgggcacgcgcagcctggctgacctgatcctggaccagtgccccgaccgcggcgcgccggtgccgcagatgctggcccagccgcagcggctgctcttcatcctggacggcgcggacgagctgccggcgctggggggccccgaggccgcgccctgcacagaccccttcgaggcggcgagcggcgcgcgggtgctaggcgggctgctgagcaaggcgctgctgcccacggccctcctgctggtgaccacgcgcgccgccgcccccgggaggctgcagggccgcctgtgttccccgcagtgcgccgaggtgcgcggcttctccgacaaggacaagaagaagtatttctacaagttcttccgggatgagaggagggccgagcgcgcctaccgcttcgtgaaggagaacgagacgctgttcgcgctgtgcttcgtgcccttcgtgtgctggatcgtgtgcaccgtgctgcgccagcagctggagctcggtcgggacctgtcgcgcacgtccaagaccaccacgtcagtgtacctgcttttcatcaccagcgttctgagctcggctccggtagccgacgggccccggttgcagggcgacctgcgcaatctgtgccgcctggcccgcgagggcgtcctcggacgcagggcgcagtttgccgagaaggaactggagcaactggagcttcgtggctccaaagtgcagacgctgtttctcagcaaaaaggagctgccgggcgtgctggagacagaggtcacctaccagttcatcgaccagagcttccaggagttcctcgcggcactgtcctacctgctggaggacggcggggtgcccaggaccgcggctggcggcgttgggacactcctgcgtggggacgcccagccgcacagccacttggtgctcaccacgcgcttcctcttcggactgctgagcgcggagcggatgcgcgacatcgagcgccacttcggctgcatggtttcagagcgtgtgaagcaggaggccctgcggtgggtgcagggacagggacagggctgccccggagtggcaccagaggtgaccgagggggccaaagggctcgaggacaccgaagagccagaggaggaggaggagggagaggagcccaactacccactggagttgctgtactgcctgtacgagacgcaggaggacgcgtttgtgcgccaagccctgtgccggttcccggagctggcgctgcagcgagtgcgcttctgccgcatggacgtggctgttctgagctactgcgtgaggtgctgccctgctggacaggcactgcggctgatcagctgcagattggttgctgcgcaggagaagaagaagaagagcctggggaagcggctccaggccagcctgggtggcggcagcagttctcaaggcaccacaaaacaactgccagcctcccttcttcatccactctttcaggcaatgactgacccactgtgccatctgagcagcctcacgctgtcccactgcaaactccctgacgcggtctgccgagacctttctgaggccctgagggcagcccccgcactgacggagctgggcctcctccacaacaggctcagtgaggcgggactgcgtatgctgagtgagggcctagcctggccgcagtgcagggtgcagacggtcagggtacagctgcctgacccccagcgagggctccagtacctggtgggtatgcttcggcagagccctgccctgaccaccctggatctcagcggctgccaactgcccgcccccatggtgacctacctgtgtgcagtcctgcagcaccagggatgcggcctgcagaccctcagtctggcctctgtggagctgagcgagcagtcactacaggagcttcaggctgtgaagagagcaaagccggatctggtcatcacacacccagcgctggacggccacccacaacctcccaaggaactcatctcgaccttctga

SEQ ID NO: 60488 - DNA, 5092 bp, Homo sapiens
cttggctgttcctgaggcctggcctggctccccgctgaccccttcccagacctgggatggcggaggccggcctgaggggctggctgctgtgggccctgctcctgcgcttggcccagagtgagccttacacaaccatccaccagcctggctactgcgccttctatgacgaatgtgggaagaacccagagctgtctggaagcctcatgacactctccaacgtgtcctgcctgtccaacacgccggcccgcaagatcacaggtgatcacctgatcctattacagaagatctgcccccgcctctacaccggccccaacacccaagcctgctgctccgccaagcagctggtatcactggaagcgagtctgtcgatcaccaaggccctcctcacccgctgcccagcctgctctgacaattttgtgaacctgcactgccacaacacgtgcagccccaatcagagcctcttcatcaatgtgacccgcgtggcccagctaggggctggacaactcccagctgtggtggcctatgaggccttctaccagcatagctttgccgagcagagctatgactcctgcagccgtgtgcgcgtccctgcagctgccacgctggctgtgggcaccatgtgtggcgtgtatggctctgccctttgcaatgcccagcgctggctcaacttccagggagacacaggcaatggtctggccccactggacatcaccttccacctcttggagcctggccaggccgtggggagtgggattcagcctctgaatgagggggttgcacgttgcaatgagtcccaaggtgacgacgtggcgacctgctcctgccaagactgtgctgcatcctgtcctgccatagcccgcccccaggccctcgactccaccttctacctgggccagatgccgggcagtctggtcctcatcatcatcctctgctctgtcttcgctgtggtcaccatcctgcttgtgggattccgtgtggcccccgccagggacaaaagcaagatggtggaccccaagaagggcaccagcctctctgacaagctcagcttctccacccacaccctccttggccagttcttccagggctggggcacgtgggtggcttcgtggcctctgaccatcttggtgctatctgtcatcccggtggtggccttggcagcgggcctggtctttacagaactcactacggaccccgtggagctgtggtcggcccccaacagccaagcccggagtgagaaagctttccatgaccagcatttcggccccttcttccgaaccaaccaggtgatcctgacggctcctaaccggtccagctacaggtatgactctctgctgctggggcccaagaacttcagcggaatcctggacctggacttgctgctggagctgctagagctgcaggagaggctgcggcacctccaggtatggtcgcccgaagcacagcgcaacatctccctgcaggacatctgctacgcccccctcaatccggacaataccagtctctacgactgctgcatcaacagcctcctgcagtatttccagaacaaccgcacgctcctgctgctcacagccaaccagacactgatggggcagacctcccaagtcgactggaaggaccattttctgtactgtgccaatgccccgctcaccttcaaggatggcacagccctggccctgagctgcatggctgactacggggcccctgtcttccccttccttgccattggggggtacaaaggaaaggactattctgaggcagaggccctgatcatgacgttctccctcaacaattaccctgccggggacccccgtctggcccaggccaagctgtgggaggaggccttcttagaggaaatgcgagccttccagcgtcggatggctggcatgttccaggtcacgttcatggctgagcgctctctggaagacgagatcaatcgcaccacagctgaagacctgcccatctttgccaccagctacattgtcatattcctgtacatctctctggccctgggcagctattccagctggagccgagtgatggtggactccaaggccacgctgggcctcggcggggtggccgtggtcctgggagcagtcatggctgccatgggcttcttctcctacttgggtatccgctcctccctggtcatcctgcaagtggttcctttcctggtgctgtccgtgggggctgataacatcttcatctttgttctcgagtaccagaggctgccccggaggcctggggagccacgagaggtccacattgggcgagccctaggcagggtggctcccagcatgctgttgtgcagcctctctgaggccatctgcttcttcctaggggccctgacccccatgccagctgtgcggacctttgccctgacctctggccttgcagtgatccttgacttcctcctgcagatgtcagcctttgtggccctgctctccctggacagcaagaggcaggaggcctcccggttggacgtctgctgctgtgtcaagccccaggagctgcccccgcctggccagggagaggggctcctgcttggcttcttccaaaaggcttatgcccccttcctgctgcactggatcactcgaggtgttgtgctgctgctgtttctcgccctgttcggagtgagcctctactccatgtgccacatcagcgtgggactggaccaggagctggccctgcccaaggactcgtacctgcttgactatttcctctttctgaaccgctacttcgaggtgggggccccggtgtactttgttaccaccttgggctacaacttctccagcgaggctgggatgaatgccatctgctccagtgcaggctgcaacaacttctccttcacccagaagatccagtatgccacagagttccctgagcagtcttacctggccatccctgcctcctcctgggtggatgacttcattgactggctgaccccgtcctcctgctgccgcctttatatatctggccccaataaggacaagttctgcccctcgaccgtcaactctctgaactgcctaaagaactgcatgagcatcacgatgggctctgtgaggccctcggtggagcagttccataagtatcttccctggttcctgaacgaccggcccaacatcaaatgtcccaaaggcggcctggcagcatacagcacctctgtgaacttgacttcagatggccaggttttagacacagttgccattctgtcacccaggctggagtacagtggcacaatctcggctcactgcaacctctacctcctggattcagcctccaggttcatggcctatcacaagcccctgaaaaactcacaggattacacagaagctctgcgggcagctcgagagctggcagccaacatcactgctgacctgcggaaagtgcctggaacagacccggcttttgaggtcttcccctacacgatcaccaatgtgttttatgagcagtacctgaccatcctccctgaggggctcttcatgctcagcctctgccttgtgcccaccttcgctgtctcctgcctcctgctgggcctggacctgcgctccggcctcctcaacctgctctccattgtcatgatcctcgtggacactgtcggcttcatggccctgtggggcatcagttacaatgctgtgtccctcatcaacctggtctcggcggtgggcatgtctgtggagtttgtgtcccacattacccgctcctttgccatcagcaccaagcccacctggctggagagggccaaagaggccaccatctctatgggaagtgcggtgtttgcaggtgtggccatgaccaacctgcctggcatccttgtcctgggcctcgccaaggcccagctcattcagatcttcttcttccgcctcaacctcctgatcactctgctgggcctgctgcatggcttggtcttcctgcccgtcatcctcagctacgtggggcctgacgttaacccggctctggcactggagcagaagcgggctgaggaggcggtggcagcagtcatggtggcctcttgcccaaatcacccctcccgagtctccacagctgacaacatctatgtcaaccacagctttgaaggttctatcaaaggtgctggtgccatcagcaacttcttgcccaacaatgggcggcagttctgatacagccagaggccctgtctaggctctatggccctgaaccaaagggttatggggatcttccttgtgactgccccttgacacacgccctcctcaaatcctaggggaggccattcccatgagactgcctgtcactggaggatggcctgctcttgaggtatccaggcagcaccactgatggctcctctgctcccatagtgggtccccagtttccaagtcacctaggccttgggcagtgcctcctcctgggcctgggtctggaagttggcaggaacagacacactccatgtttgtcccacactcactcactttcctaggagcccacttctcatccaacttttcccttctcagttcctctctcgaaagtcttaattctgtgtcagtaagtctttaacacgtagcagtgtccctgagaacacagacaatgaccactaccctgggtgtgatatcacaggaggccagagagaggcaaaggctcaggccaagagccaacgctgtgggaggccggtcggcagccactccctccagggcgcacctgcaggtctgccatccacggccttttctggcaagagaagggcccaggaaggatgctctcataaggcccaggaaggatgctctcataagcaccttggtcatggattagcccctcctggaaaatggtgttgggtttggtctccagctccaatacttattaaggctgttgctgccagtcaaggccacccaggagtctgaaggctgggagctcttggggctgggctggtcctcccatcttcacctcgggcctggatcccaggcctcaaaccagcccaacccgagcttttggacagctctccagaagcatgaactgcagtggagatgaagatcctggctctgtgctgtgcacataggtgtttaataaacatttgttggcagaaaaaaaaaaaaaaaaaaaaaaaaaaaaaaaaaaaaaaaaaaaaaaa

SEQ ID NO: 60489 - DNA, 2013 bp, Homo sapiens
aattcctgtcctcaggcgctgtcagatctgtggtttttctacttgaaggacacaatgttttccaaactagcacatttgcagaggtttgctgtacttagtcgcggagttcattcttcagtggcttctgctacatctgttgcaactaaaaaaacagtccaaggccctccaacctctgatgacatttttgaaagggaatataagtatggtgcacacaactaccatcctttacctgtagccctggagagaggaaaaggtatttacttatgggatgtagaaggcagaaaatattttgacttcctgagttcttacagtgctgtcaaccaagggcattgtcaccccaagattgtgaatgctctgaagagtcaagtggacaaattgaccttaacatctagagctttctataataacgtacttggtgaatatgaggagtatattactaaacttttcaactaccacaaagttcttcctatgaatacaggagtggaggctggagagactgcctgtaaactagctcgtaagtggggctataccgtgaagggcattcagaaatacaaagcaaagattgtttttgcagctgggaacttctggggtaggacgttgtctgctatctccagttccacagacccaaccagttacgatggttttggaccatttatgccgggattcgacatcattccctataatgatctgcccgcactggagcgtgctcttcaggatccaaatgtggctgcgttcatggtagaaccaattcagggtgaagcaggcgttgttgttccggatccaggttacctaatgggagtgcgagagctctgcaccaggcaccaggttctctttattgctgatgaaatacagacaggattggccagaactggtagatggctggctgttgattatgaaaatgtcagacctgatatagtcctccttggaaaggccctttctgggggcttataccctgtgtctgcagtgctgtgtgatgatgacatcatgctgaccattaagccaggggagcatgggtccacatacggtggcaatccactaggctgccgagtggccatcgcagcccttgaggttttagaagaagaaaaccttgctgaaaatgcagacaaattgggcattatcttgagaaatgaactcatgaagctaccttctgatgttgtaactgccgtaagaggaaaaggattattaaacgctattgtcattaaagaaaccaaagattgggatgcttggaaggtgtgtctacgacttcgagataatggacttctggccaagccaacccatggcgacattatcaggtttgcgcctccgctggtgatcaaggaggatgagcttcgagagtccattgaaattattaacaagaccatcttgtctttctgagggtagccagctgttttcagtggtccctgggagccagctggagacaggtggtcctgtaaaagctttattcctaatgtgggcacattccactcccatgagtcttcaaaaactttttttttgaatatatttttttcagttgatacataatagaacaacgtttatgaacctgccgtttgctttgtaacgtaactaaataatgtaatggcatctatattcagttgaagtgttttgatgtgcatgtgtacttcctaaggtgaaatgcatctatatacagacagcctctaaatcaagtccttcagtataattgatatatgtttttataatttcctcactggtataagtgtttcatatttgaaaaagttatctctgggtattgcataaaaggcttcatcttataaagtgaaatcattgttattgaattttaggaaggattaatggttaagtgtatataaaatactaatattaagtaaacttcatattggccaacaccagggttgtattctatggatgtcattattttgaattaagaattagtgtttaacattcctaaattgttttgagtgcttgattataatttgtaaaaaatgtttattttcaatacttctttaaatttaaaataaagcttatatttcaaatgtc

SEQ ID NO: 60490 - DNA, 1791 bp, Homo sapiens
atgggccgcggagcccgagcggcggctgcgcagtcccgctgggggagggcgtcgcgggcatcggtctcacctggacggacgatccgctcagcgcccgcagtcggtgaagcacaggagactgaagcagccccggagaaggagaaccgagtggatgtgggggccgaggagagagcggccgccacccggccccggcagaagtcctggctggtgaggcatttctctctgctgctgcggcgggaccggcaggcccagaaggctggacaactcttctcggggctcctggccctgaatgtggtgttcctgggtggcgccttcatctgcagcatgatcttcaacaaggtggccgtcactctgggtgacgtgtggatcctgctggccacgctgaaggtcctctccctgctttggcttctctactatgtggcaagcaccacccgccgaccacacgccgtgctctaccaagatccccacgcggggcccctctgggtgcggggttccctagtgctcttcggcagctgcaccttctgcctcaacatcttccgagtgggctacgatgtgagccacatccgctgcaagtcacagctggaccttgtcttctctgtcatcgagatggtcttcatcggcgtccagacctgggtgctctggaaacactgcaaagactgtgttcgggtccagaccaacttcactaggtgtggcctgatgctgaccctggccacaaacctgctgctgtgggttctggccgttaccaatgactccatgcaccgagagatcgaagctgagcttggcatcctcatggaaaaatccacaggcaatgagaccaacacctgtctgtgcctcaatgccaccgcgtgtgaagctttccggagaggcttcctgatgctctaccccttcagcactgagtactgcctcatctgctgtgctgtgctgtttgtcatgtggaagaacgtgggccgccacgtggcaccccacatgggtgcccaccctgccaccgcacccttccacctgcacggggccatcttcgggccgctgctgggcctgctggtgctgctggcaggtgtgtgcgtctttgtgctcttccaaatcgaggccagtggccctgccattgcttgccagtacttcaccctctactatgccttctatgtggctgtgctgcccaccatgagtctggcgtgcctggcgggcacagccatacacgggctggaggagagagagctggacacggtcaagaaccctacccgcagcctggatgtggtgctgctaatgggtgctgcactgggccagatgggcatcgcctatttctccatcgtggccattgtggccaagcgcccgcatgagctgctcaaccgcctcatcctggcctactcgctgctgctcatcctgcagcacatcgctcagaacctcttcatcatcgagggcctgcaccggcgcccactctgggagacagttcccgagggcctggcaggaaagcaggaggctgagcctccccgcagaggctccttgctggagctgggccagggcctgcagcgggcctcactggcctacatccactcctacagccacctcaactggaagcggagggcactcaaggagatctcactcttcctcatcctctgcaatatcacactgtggatgatgcctgcatttggcatacacccggagtttgagaacgggctagaaaaggatttctacggctaccagatatggttcgccatcgtcaacttcggcctgcctctgggggtcttctaccgcatgcactctgtgggaggcctggtggaggtctacctgggggcctga

SEQ ID NO: 60491 - DNA, 2246 bp, Homo sapiens
gatccagctatggagaaagccgcagatctgcaggacacagcctcgttaactctgaagtttaagtttaacccaaagctgggcattgataatcctgtcctctccctggccgaagaccacgacccctatgatccctggagcctggagcggcctcgcttctgtttactgagcaaagaggagggcaagagttttggcttccacctgcagcaggagctgggcagggctgggcatgtggtgtgcagggtggacccaggcacctctgcccagcgccagggtcttcaggaaggagacaggatcctggcggtgaacaatgatgttgtggaacacgaagactatgcggtggtggtacgccgcatccgggccagcagccctcgggtgttgctgacagtattggcacggcatgcacatgacgtggcccgagctcagctgggagaagatgcccacctctgtcccaccctaggcccaggggtccggccccggctgtgccacatagtgaaagatgagggtggttttggcttcagtgtcacccatggcaatcagggtcctttctggttggtgctaagtactggaggagcagctgagcgggcaggggtgccccccggggcccggctgctggaagtgaatgggctttggcagagtggacagcaggtgaccttgctggtggcagggccagaggtggaagaacagtgtcgccagctgggattgcccctggctgcacccctggcagagggctgggcactgcccaccaagccccgctgcctgcacctggagaaagggccccagggttttgggttcctgctccgggaggaaaagggccttgacggtcgccctggacagttcctgtgggaggtggacccgggactgccagccaagaaggctgggatgcaggctggggaccggctggtggctgtggctggggagagcgtggaggggctgggccatgaggagacagtgtccaggatccaggggcagggctcctgtgtctccctcactgtcgtcgaccctgaggcggaccgcttcttcagcatggttcgcctgtccccactcctcttcttggagaacacagaggctcccgcctcgccccagggcagcagctcagcctcactggttgagacagaggacccttcacttgaagacacaagcgtgccttctgtccctcttggctcccgacagtgcttcctgtaccctgggcctggtggcagctatggcttccgactcagttgtgtggccagtgggcctcgtctcttcatctcccaggtgactccaggaggctcagctgcccgggctgggctgcaagtgggagacgtgattctggaagtgaacgggtatcctgttgggggacagaatgacctggagaggcttcagcagctgcctgaggctgagccacccctctgcctgaagctggcagccaggtctctgcggggcttggaagcctggattccccctggggctgcagaggactgggctctggcctcggatctactgtagagcacccctgcttggtacagacatactcaggggctaccgtgtcttcactctccagcctgaggtggtgaaggcaggatgctctctctaagccagaccagagggactcagacaccaccgatcacaggctggcccaggtgctccctcccttcctgcaggcccacctgccagcagagggtgtggttggaggcctcagacaggtccctgaaggagtctgaggctccagaggatgtcatatgggagttttagagagctgtgtcccaaggatgaaggtgtggctgtgggtctggctaggattgaagccatctggaccttttctagatatgactccaggacccttgagtgtaatgcaaaaatttggagaccagctatgcctgccctctgtgggtgccttagcattgcgggagggtggtgcttggtcaccgttgcatttgttatagaaatggccattcgccataaatctgactgcctgtgtttgtgttggtgggggtaaggggcagtggtgtgaagggaccaaaagggcctcaggctcaaggggtgggatgcggctcctgcaggagagaggttgagacctggtcaaatttatttcctatcaatcactgaatctcagggataatgggtcaacccagaactgagatgtctgtatgacagccactcctaaaaataaacaacaacaaaaacaaaaaaagaagaaaactaaataaaaataaaaataaaaataaaaaaaaaaaaaaaaaaaaaaaaaaaaaaaaaaaaaaaaaaaa

SEQ ID NO: 60492 - DNA, 1092 bp, Homo sapiens
tgtccctggaattctgggacactggctggggtttgaggagagaagccagtacctacctggctgcaggatgaagctggccagtggcttcttggttttgtggctcagccttgggggtggcctggctcagagcgacacgagccctgacacggaggagtcctattcagactggggccttcggcacctccggggaagctttgaatccgtcaatagctacttcgattcttttctggagctgctgggagggaagaatggagtctgtcagtacaggtgccgatatggaaaggcaccaatgcccagacctggctacaagccccaagagcccaatggctgcggctcctatttcctgggtctcaaggtaccagaaagtatggacttgggcattccagcaatgacaaagtgctgcaaccagctggatgtctgttatgacacttgcggtgccaacaaatatcgctgtgatgcaaaattccgatggtgtctccactcgatctgctctgaccttaagcggagtctgggctttgtctccaaagtggaagcagcctgtgattccctggttgacactgtgttcaacaccgtgtggaccttgggctgccgcccctttatgaatagtcagcgggcagcttgcatctgtgcagaggaggagaaggaagagttatgaggaagaagtgattccttcctggttttgagtgacaccacagctgtcagccttcaagatgtcaagtcttcgagtcagcgtgactcattcattcttccaacagtttggacaccacaaagcaggagaaagggaacatttttctacagctggaaagtgagtcctatcctttgaggaaatttgaaaaaagacatggagtggtttgaaagctactcttcatttaagactgctctccccaaccaagacacatttgcctggaaattcagttcttagcttaaagactaaaatgcaagcaaaccctgcaattcctggacctgatagttatattcatgagtgaaattgtggggagtccagccatttgggaggcaatgactttctgctggcccatgtttcagttgccagtaagcttctcacatttaataaagtgtactttttagaacatt

SEQ ID NO: 60493 - DNA, 3328 bp, Homo sapiens
ggtccctgagcaaaatgggaaatggttcagtgaaacctaaacattctaagcacccagatggacactctgggaacctcaccactgatgctctgcggaacaaggtgacagagctggagagagagttgaggaggaaggatgctgagatccaggagcgggagtaccatttgaaggagctgcgggagcagctgtcgaagcagactgtggccattgctgaactcacagaggagctccagaacaagtgcatccagctgaacaagctgcaggatgtggtgcatatgcagggaggaagcccgcttcaggcctctccagataaagtgcctcttgaggtccaccggaagacctctggattggtctctctccatagcaggaggggagcaaaggctggcgtgtctgctgagccaacaacccggacctatgacctgaacaaaccccctgaattttcctttgagaaagcaagagtcagaaaagactccagtgagaagaagctcattacagatgcccttaataaaaatcagtttctgaaaagactggatcctcagcagatcaaagacatggtggaatgcatgtatgggagaaactatcagcaagggagttacattattaagcaaggagaaccaggaaaccatatctttgtgctggcagagggtcgactagaggtgttccaaggggagaaattgctgtcctccatccctatgtggaccacatttggggagcttgccattttatacaattgtacaaggactgcctctgtgaaagctattaccaatgttaaaacatgggcactagatcgagaggtattccagaatataatgaggaggacagcccaagctagagatgaacaatacagaaacttcctcagaagtgtatccttgctgaagaatttacctgaagataaattaaccaagatcattgactgcttggaagtggaatactatgacaaaggagattacatcattagagagggcgaggaaggaagtacctttttcattttggcaaaaggaaaggtaaaagtaacacagagcacagaaggccatgatcaaccacagctgataaaaacactgcagaaaggagaatactttggagaaaaagctcttatcagtgatgatgtcaggtcagctaacattattgctgaagaaaatgatgttgcatgcctggttatagatcgagaaacattcaaccaaactgtcggtacatttgaagagctgcaaaaataccttgaaggatatgtggcaaacctgaaccgtgatgatgaaaaaagacatgcgaagcggtccatgtctaactggaagctgtccaaagcactctctctggaaatgattcagctgaaggagaaggtggccagattttcctcatcatccccattccagaaccttgagattattgcaacactgggcgttggtgggttcggaagagttgagcttgttaaagtaaaaaatgagaatgttgcttttgctatgaagtgtataaggaagaagcacatagttgacaccaagcagcaggagcatgtctactcagagaagaggatcctagaggagctgtgctctccattcattgtgaaattatatcgtactttcaaggacaataagtatgtatacatgcttctggaggcctgcttaggtggggagctctggagtatattaagggacagaggcagctttgatgaacccacctccaaattctgcgttgcttgtgtgacagaagcatttgattacctgcatcgactaggtattatctacagagacttgaaaccagaaaacttaattctagatgctgagggttaccttaaattggttgactttggatttgcgaagaaaatagggtctggacagaaaacatggacattctgtgggactccagaatatgtagctcctgaagtcattctcaacaagggacatgacttcagtgtggatttctggtcactgggaattctagtgtatgagctcctaacgggcaacccacccttttctggggttgaccaaatgatgacctacaatttgattctcaaaggaattgaaaaaatggattttcccaggaagataacacgacgacctgaggatttgattcggaggctttgcaggcaaaatccaacagaaaggctgggaaatctgaagaatggaataaatgacattaagaaacacaggtggttaaatggttttaattgggagggactgaaagcacggagccttccatcacctttgcaaagagagctcaagggacccatagatcacagctactttgacaaatatcctcctgaaaagggaatgcctccagatgagctatcaggctgggataaagacttctgacagaagaaaagttgattactgcctgtactctacagaagaggacctcaaggatcaataatccaacacattattttcttttcagagtattataatatctttggaagaccattagggaaaagaaattcctgcacaatgggaagaggagaatggtgtggatatggttctgagttatagtgtcttatttagatgctgtgaattattgatgtattacattatttgcttttctcaactgctagaggctaccccattttcctttccacaatcagagccatttttgttaaagtggcagttttttctgcaatctattgttccattccaatcatatccttctcgtttgagtactactaacgtttaaaaagggtcttgcccttgaataactaagtcatacaaatagaaggaaaaacaatggtgaattttggagagctccccagctctcagcaacttcatataagcatggtggtatcttaaaatggtggtttgcagaaaccatggtagccaacagaacctcctgactttcacctgcttttaacctgaaaatatattaatacgcctctgacatgagtccagggagaggcaagattgagcaatagtcagtggcaccatttcctaaagtaactgaatcaatcaatccagtcaggtaattattttctattggggaacttagaaaaaaaagtaaagcaagaaatattttctctcctttatgatcagtgataccttagagacttttcgaaagtccttgttaaagatagttacaatgtgtggttaaatgatgctaaaatattttcacaaccagagtagaaaacgtgctggaacaaaattgcgaaggcttttgcctcccagtaaatagaaaggaaaatatattctagtaggtaagactgctgactctttgaaaatctgaggtattttgaaaaattctgtgatagttgctattaataaaccaaaattgtatagaatcatcgttaatttttaatataaatcccattgacaaatgttgatgcactgtagtcactgctgagttaatagcg

SEQ ID NO: 60494 - DNA, 3696 bp, Homo sapiens
accagacagttcttaaattagcaagccttcaaaaccaaaaatggggtcgaaaagaggcatatcttctaggcatcattctctcagctcctatgaaatcatgtttgcagctctctttgccatattggtagtgctctgtgctggattaattgcagtatcctgcctgacaatcaaggaatcccaacgaggtgcagcacttggacagagtcatgaagccagagcgacatttaaaataacatccggagttacatataatcctaatttgcaagacaaactctcagtggatttcaaagttcttgcttttgaccttcagcaaatgatagatgagatctttctatcaagcaatctgaagaatgaatataagaactcaagagttttacaatttgaaaatggcagcattatagtcgtatttgaccttttctttgcccagtgggtgtcagatcaaaatgtaaaagaagaactgattcaaggccttgaagcaaataaatccagccaactggtcactttccatattgatttgaacagcgttgatatcctagacaagctaacaaccaccagtcatctggcaactccaggaaatgtctcaatagagtgcctgcctggttcaagtccttgtactgatgctctaacgtgtataaaagctgatttattttgtgatggagaagtaaactgtccagatggttctgacgaagacaataaaatgtgtgccacagtttgtgatggaagatttttgttaactggatcatctgggtctttccaggctactcattatccaaaaccttctgaaacaagtgttgtctgccagtggatcatacgtgtaaaccaaggactttccattaaactgagcttcgatgattttaatacatattatacagatatattagatatttatgaaggtgtaggatcaagcaagattttaagagcttctatttgggaaactaatcctggcacaataagaattttttccaaccaagttactgccacctttcttatagaatctgatgaaagtgattatgttggctttaatgcaacatatactgcatttaacagcagtgagcttaataattatgagaaaattaattgtaactttgaggatggcttttgtttctgggtccaggatctaaatgatgataatgaatgggaaaggattcagggaagcaccttttctccttttactggacccaattttgaccacacttttggcaatgcttcaggattttacatttctaccccaactggaccaggagggagacaagaacgagtggggcttttaagcctccctttggaccccactttggagccagcttgccttagtttctggtatcatatgtatggtgaaaatgtccataaattaagcattaatatcagcaatgaccaaaatatggagaagacagttttccaaaaggaaggaaattatggagacaattggaattatggacaagtaaccctaaatgaaacagttaaatttaaggttgcttttaatgcttttaaaaacaagatcctgagtgatattgcgttggatgacattagcctaacatatgggatttgcaatgggagtctttatccagaaccaactttggtgccaactcctccaccagaacttcctacggactgtggaggaccttttgagctgtgggagccaaatacaacattcagttctacgaactttccaaacagctaccctaatctggctttctgtgtttggattttaaatgcacaaaaaggaaagaatatacaacttcattttcaagaatttgacttagaaaatattaacgatgtagttgaaataagagatggtgaagaagctgattccttgctcttagctgtgtacacagggcctggcccagtaaaggatgtgttctctaccaccaacagaatgactgtgcttctcatcactaacgatgtgttggcaagaggagggtttaaagcaaactttactactggctatcacttggggattccagagccatgcaaggcagaccattttcaatgtaaaaatggagagtgtgttccactggtgaatctctgtgacggtcatctgcactgtgaggatggctcagatgaagcagattgtgtgcgttttttcaatggcacaacgaacaacaatggtttagtgcggttcagaatccagagcatatggcatacagcttgtgctgagaactggaccacccagatttcaaatgatgtttgtcaactgctgggactagggagtggaaactcatcaaagccaatcttctctaccgatggtggaccatttgtcaaattaaacacagcacctgatggccacttaatactaacacccagtcaacagtgtttacaggattccttgattcggttacagtgtaaccataaatcttgtggaaaaaaactggcagctcaagacatcaccccaaagattgttggaggaagtaatgccaaagaaggggcctggccctgggttgtgggtctgtattatggcggccgactgctctgcggcgcatctctcgtcagcagtgactggctggtgtccgccgcacactgcgtgtatgggagaaacttagagccatccaagtggacagcaatcctaggcctgcatatgaaatcaaatctgacctctcctcaaacagtccctcgattaatagatgaaattgtcataaaccctcattacaataggcgaagaaaggacaacgacattgccatgatgcatctggaatttaaagtgaattacacagattacatacaacctatttgtttaccggaagaaaatcaagtttttcctccaggaagaaattgttctattgctggttgggggacggttgtatatcaaggtactactgcaaacatattgcaagaagctgatgttcctcttctatcaaatgagagatgccaacagcagatgccagaatataacattactgaaaatatgatatgtgcaggctatgaagaaggaggaatagattcttgtcagggggattcaggaggaccattaatgtgccaagaaaacaacaggtggttccttgctggtgtgacctcatttggatacaagtgtgccctgcctaatcgccccggagtgtatgccagggtctcaaggtttaccgaatggatacaaagttttctacattagcgcatttcttaaactaaacaggaaagtcgcattattttcccattctactctagaaagcatggaaattaagtgtttcgtacaaaaattttaaaaagttaccaaaggtttttattcttacctatgtcaatgaaatgctagggggccagggaaacaaaattttaaaaataataaaattcaccatagcaatacagaataactttaaaataccattaaatacatttgtatttcattgtgaacaggtatttcttcacagatctcatttttaaaattcttaatgattatttttattacttactgttgtttaaagggatgttattttaaagcatataccatacacttaagaaatttgagcagaatttaaaaaagaaagaaaataaattgtttttcccaaagtatgtcactgttggaaataaactgccataaattttctagttccagtttagtttgctgctattagcagaaactcaattgtttctctgtcttttctatcaaaattttcaacatatgcataaccttagtattttcccaaccaatagaaactatttattgtaagcttatgtcacaggcctggactaaattgattttacgttcctctt

SEQ ID NO: 60495 - DNA, 1992 bp, Homo sapiens
agcaaatactcactaccacaaataagaacatttccaaatctgatgttctgaggatttttagagcttatagtagcaaaaagaaaagggaaattctctctgagatgtccttttttgtaggcctaatgacaaaaggttgaagataaagttctagtactcatttaagtgtaatattgaaaattgatattaccaaatctggaacaaccaatttaaaataaggaaagaaagacactgtgttttctaggttaaaaatgcccagctggcaggggccaaaggagtcattctctactcagaccctgctgactactttgctcctggggtgaagtcctatccagacggttggaatcttcctggaggtggtgtccagcgtggaaatatcctaaatctgaatggtgcaggagaccctctcacaccaggttacccagcaaatgaatacgcttataggcatggaattgcagaggctgttggtcttccaagtattcctgttcatccagttggatactatgatgcacagaagctcctagaaaaaatgggtggctcagcaccaccagatagcagctggagaggaagtctcaaagtgtcctacaatgttggacctggctttactggaaacttttctacacaaaaagtcaagatgcacatccactctaccaatgaagtgacgagaatttacaatgtgataggtactctcagaggagcagtggaaccagacagatatgtcattctgggaggtcaccgggactcatgggtgtttggtggtattgaccctcagagtggagcagctgttgttcatgaaactgtgaggagctttggaacactgaaaaaggaagggtggagacctagaagaacaattttgtttgcaagctgggatgcagaagaatttggtcttcttggttctactgagtgggcagaggataattcaagactccttcaagagcgtggcgtggcttatattaatgctgactcatctatagaaggaaactacactctgagagttgattgtacaccactgatgtacagcttggtatacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacaatatttctatgaaacatccacaggaaatgaagacatacagtttatcatttgattcacttttttctgcagtaaaaaattttacagaaattgcttccaagttcagcgagagactccaggactttgacaaaagcaacccaatattgttaagaatgatgaatgatcaactcatgtttctggaaagagcatttattgatccattagggttaccagacagacctttttataggcatgtcatctatgctccaagcagccacaacaagtatgcaggggagtcattcccaggaatttatgatgctctgtttgatattgaaagcaaagtggacccttccaaggcctggggagatgtgaagagacagatttctgttgcagccttcacagtgcaggcagctgcagagactttgagtgaagtagcctaagaggattctttagagactctgtattgaatttgtgtggtatgtcactcaaagaataataatgggtatattgataaattttaaaattggtatatttgaaataaagttgaatattatatataaaaaaaaaaaaaaaaaaa

SEQ ID NO: 60496 - DNA, 1069 bp, Homo sapiens
gcccctggaggaactgaacccactatcggtcatggggccgagactaaatgtggcgggttgtctttaatctgctgccaagaggaaactcattcaggcaagttcagccctttatgaggaattcccctgtggtcacattccaattcctggacctgctgccaccctcagaactgcatgctccttcttcagactttctaagaatgactcaggtcattggtggagtgaagtcaagatttccaactcagtcacctgaagagatggagataccattcatggagctggaggtccctggagatttgggaattcagataacaagctaagataaggagtttgcctacctctgtcctagagcgaagcctgagccttgggcgcgcagcacaccacaagtatctgttactgtgttttgcagaagcttcaggcggggatataagccccacaaggaaagcgctgagcagaggaggcctcagcttgacctgcggcagtgcagcccttgggacttccctcgccttccacctcctgctcgtctgcttcacaagctatcgctatggtgttcgtgcgcaggccgtggcccgccttgaccacagtgcttctggccctgctcgtctgcctaggggcgctggtcgacgcctaccccatcaaacccgaggctccccgcgaagacgcctcgccggaggagctgaaccgctactacgcctccctgcgccactacctcaacctggtcacccggcagcggtatgggaaaagagacggcccggacacgcttctttccaaaacgttcttccccgacggcgaggaccgccccgtcaggtcgcggtcggagggcccagacctgtggtgaggacccctgaggcctcctgggagatctgccaaccacgcccacgtcatttgcatacgcactcccgaccccagaaacccggattctgcctcccgacggcggcgtctgggcagggttcgggtgcggccctccgcccgcgtctcggtgcccccgccccctgggctggagggctgtgtgtggtccttccctggtcccaaaataaagagcaaattccacagaaaaaaaaaaaaaaaaaaa

SEQ ID NO: 60497 - DNA, 1250 bp, Homo sapiens
ccacgttgtcttctttccttcaccaccacccaggagctcagagatctaagctgctttccatcttttctcccagccccaggacactgactctgtacaggatggggccgtcctcttgcctccttctcatcctaatcccccttctccagctgatcaacccggggagtactcagtgttccttagactccgttatggataagaagatcaaggatgttctcaacagtctagagtacagtccctctcctataagcaagaagctctcgtgtgctagtgtcaaaagccaaggcagaccgtcctcctgccctgctgggatggctgtcactggctgtgcttgtggctatggctgtggttcgtgggatgttcagctggaaaccacctgccactgccagtgcagtgtggtggactggaccactgcccgctgctgccacctgacctgacagggaggaggctgagaactcagttttgtgaccatgacagtaatgaaaccagggtcccaaccaagaaatctaactcaaacgtcccacttcatttgttccattcctgattcttgggtaataaagacaaactttgtacctctctgtgcttatgtcatctctgttattgtccccagcttggggctcccctatccagaaaatgttgtcagtgtcccagtggtgacatctcagtttgggaagtgggatgggaagttaggaaagatatgggaagaatgggaaaaacaaactgacactccaaacccccacttccctcatttttatttatttatttatttatttttttcttttttttcatttttttttttttttattatactctaaagtttagggtacatgggcaacattgtgcaggttagtaacatatgtatacatgtgccatgctggtgcgctgcacccactaacgtggcatctagcattaggtatatctcccaatgctatccctcccccatcccccgaccccaccacaagtccccaagagtgtgatattccccttccctgtgtccacgtgatctcattgttcaattcccacctatgagtgagaatatgcggtgtttggttttttgttcttgcgatagtttactgagaatgatggtttccaatttcatccatgtccctacaaaggacatgaactgatcatttttatggctgcatagtattccatggtgtatatgtgccacattttcttaatccagtctatcattgttggacatttgggttggttccaagtctttgctattgtgaatagtgccgcaataaaca

SEQ ID NO: 60498 - DNA, 1268 bp, Homo sapiens
aagaaacaagctgggcagctctgggagagaggagtgtcagacagctgttgtcaacaggcacctggccagagtgaaaaggaggggcagattccatccaagtcccagcggcgccagctgacactctctgccaatgcccaggtgctgagcgacagtgtcccaccggtccctgtgcccagaatggcctgcaccaagaccctgcaacagtcccagcccatctccgcaggagccaccacaaccaccaccgctgtggcccctgctgggggtcattctggctccacagaatgtgacctggagtgtctggtgtgccgggagccctacagctgtccccggttgcccaagctgctggcctgccagcatgccttctgcgccatctgcctgaagctcctgctgtgcgtgcaggacaacacctggtccatcacctgcccgctgtgccgcaaggtcaccgccgtccccgggggcctcatctgcagcctgcgcgaccatgaggcggtggtggggcagctggcccagccatgcacagaggtatcgctctgtcctcaggggctggtggatcctgctgacttggcagcaggacaccccagcttggtgggagaggatggacaggatgaagtaagtgcaaaccacgtggcagcccggcgcctggccgcgcacctactcctgctggccttgctcattatcctcatcgggcccttcatctacccgggtgtcttacgatgggtgctcaccttcatcatcgccctggccctgctgatgtccaccctcttctgctgtctccccagcacccggggcagctgctggccctcctccaggactctcttctgcagagagcagaaacacagccacatctcttccattgcctgagtgccctctgatgaggctatccctgcagccctttctgcccttgggcccccggacttccacaatgaacagggtaaggggttacggactaagactggctcctttgggaaatcacatgccagcgggacttgcaagccacaaccgagatggccagcctgggtcaagaattacacgcttggatgacaggcttgcacttgcccttgggatagcatagctaaaactgttggtggctaggggagcagacacaaactacttgaacatgacaagatgggggaagctcctgttcctcttattccaatgttcttggtttttctttatataacttgatgaaagtattgcagtattgatgccattgtagaatagaactggaattccattctttttgcaatttaaaaaaaaaaaaaaaaaaa

SEQ ID NO: 60499 - DNA, 3037 bp, Homo sapiens
caaagagggagtcccaggttcttggcagcttgcttttcctcaggatggcttctggaaggctcattaagttcgtggtttttgagctcctagagtttgccgctttctccatccccacactcgtgatcacagaacagtttgccaccgcctaccaaggaacaagggctagatctgacaacacacactactggctgatcatctcctgttctattgcctatgttgcgttagtgactctactgatctgggttcctgtaaaagttatcctgcacaagaaacgttatatttacagaaaaattaaaggatggagacctgttctgatgatgtgtgtggtcctcaccacactgccctgcctcaccttttccatagcagtgactgaggttcaaaagagcattaatgggtccgctgatgtcttacctgatatgttacctgacctgcccgtatctctggttctgttatccctgatcatggttgatattattgaaaaactcaggatatatcctcttagagggagtcaaaagagtagtgaaaatggacacatccattcaacctctttgcaacacataaaaactgtgacggagcaagtgaggcaaagtccagaaaacgctgcatctccccaggcaaccaacagcacccaggtgtcgcagccatcaggagccatgacacggagccaggagtctgtgttcatgggaccccaggagccctcctgtgactccggaatcctgagaatgatgtcccggcgagatgtccgggcagagttattcttatggagctttctcctgtggtctgacacgatagaaatggatttttctcacactgtaaaagaagatttactcacagttgttaaaagcttgccttccagctttctaatttgaggtaggttctataacctctgtgggtccccgtttccacatgtaaaagatgaacataatactagtactacattaatagggttaggagggttaaagggtaaagagtcctttgagcacattttctggcaaaccataataacttgataaatgctaagcattggaacgggtaccaagtctccaagaaacaagtatctcaatgcagttttagaaatttcctgttttattcttttctgtggccctgctcaccctctgggaataatcatttcaactttgcatttgtgaaaaataatacatacaatcttaaggttacttcagactatactttttcatcgagcagtattgtattcaaaagtgatcgatctgctgaatatataaattaaaatggacacaagccttcattcatcagacatttgagtgtctgtcctctgagttcccatagaatctgaattacaccactttattcatacttacattatgtgtttacttttctgagtgtcctattaatctttattccttaaaggaaagcctgagggcatcttgtttaacaatgcatctctctcttcatcaatcaacgctgcaggtgcttacaagacttataacttaaaaaaattataatacaaggctcagcgcagtgcctcaagtgccaacagtttcggaggccttggcaggcggatcacttgaggccaagagttcgagactagcctggccaacatggtgaaacaccgtctgtactaaaaatacaaaaattagctgggtgtggtggcacgcgcctgtagtctcagctacttgggaggctgaggcaggagaatcacttgaacctgggaggcagaggttgcaatgagctgagattgcgccattgcacaccagcctgggtgacaagagtctcaaaaaaaaaattataatacaagtaattactttcgaattctgccatgggtatctttttattattaagaaaagcctgtcatcaagggattcatttatgatattcctaaatatgaaaatattttgtgtaagtatatatttatctccatattagaacttagcaacagtgctcagataaactcaaaagtattacttgagtttagaatgcattttgtatctaatattttaatatgaatgtgcctgatattttcggaagtcacaacactttatacaaataatgaaggcatgtacagaagattatgtgtaggaggaaaattgagtagctaatttaatttcatttaatattttacttagagtgtatacatgtttatagactgcaagtctatgggatttaatagatattacagcaaattacactgcgaaaacattgatagttctacactgtaattaaatgttatatatattattaaaattattaggttggtgcaaaagtaattgaggtttttgccattgaaagtggtggtgcatgcctgtaatcccagctactcgggaggctgaatcagaattgcttgaacccggagggcagaggttgcagtgagctgagatctcgccactatgctccagcctgggcaacagattgagactctgtctcaaaaaaaaaaaaaagtcaagtacagttagttaaaggaatgtgcatttaaaaattaatctatgattaggctattaatatatagtctaataattttattgcattataattataaagtagttttataattttataaaattttattgatgctgtaatttttataaaattttatttattttataattttacaaaaaattctaatacctgtaatacactttttagtgccttttctttctaaaagttaatgtttgaaattacaatgtgtaaatgttatctcgtcttgtttttcttattagggccccatttcactgaatgacaattgcaatgaggcataggaaagaaaagggaaatgaaattgcttgctgaagtcctactatgttctgggcactatgctgtttgcctaataaataattgccttgtgctgtgtaccttggagcagggccttacatagtgaatatatcaatagttgttcacaaaaagagcaatataccacttagaagctacagaacttaaaaatggctacttatactccatagaagatatagtaaataatagaagaaaaaaatgaaatggctaaagacattttgttttacaatggggctgtttttacatgttaattaaaattctatgtttaaacaaa

SEQ ID NO: 60500 - DNA, 1520 bp, Homo sapiens
gctctcctcccctcccctcccctgggcctttgacccctcccagcctctctccttccctccaccgacacctttgcccagtgacgttggtctgtccttacgcagacctggccggaggctggggctccttccggggctgccatgttctctcttccatccctcccctcctggctccccggcctcccctccctcgagtggggctctagcctccttgactccctcctgcaaggcctgatcggggcccttggagtcttggtcctgaacagcctcctgaaagtttacttcttcgtgggctgtgccaatgacccgcagcggcgacccgaaaaggagcggcttcgggcccagtgggcctccctggaaacggtgcacctggcagggctggccctgtttctgacggtcgtggggtcccgggtggctgccctcgtggtgctcgagttctccctccgggccgtgtccacgctgctgtccctgggcaagggctcccagggtgccgccgagaggctgcagctctacctgctgtgccagtactcgctgggctgcgggctgacctgtggcctgagcttcctgcaggagggcgcccctcaccgcacgctgaacctgctgctgagcctcgggctggccacgctgctgggcctgggtgcccggcgcctccaccgccacgtctgccgcctctacgagctgcacagcagccagcgctactgtggggtgtgcctgggcctgctggcccatgcacatggcctcccccagctgctgggccgtgccctggccatagcctttgccgtgggtgacctggcagctgtggccctcatcaaccaggacttcctgaccacctcggaggccatgcggttctggacaccgctcaccatctgctacacgctgctggtcatctacatgcaggaggagcagcggcagcaccccggcctgcagagccaggtgcagacggtgctggtgcgcatgggcggcctcttcgtgctgctgctgactgtgggtcgctggctggacctgctgggcatccttgtctccctactgggcgagctctggtgtctcgtgggcgtccgcaccctgcttgacctctgccagatacaggattttccatcccagaggcctccagtgtcaacaccaagccagcccctgccctcggcaccccagtcccagagttcggccccctcttgacctgcctcagggaggatctggagtctgtctcaagcccactagcctgatctccgaggccttgaccccagggcgatgcctggaggcagagtggcagagctggcctcctgcccagagctcagcacaggccctgggagccccgagaagggaaggcaggatttggggatgggagcctctggagaggggacacctggggacccctggttgaaccctctttttcttggggtgggcaatgatgcagcctctcagacctgccttcctgggcaggggtgggggtgcatcctcaggagggctccccctttactggtctcccttcccttctccatgaacaataaagacgatgtctttctcaa

SEQ ID NO: 60501 - DNA, 456 bp, Homo sapiens
aaaaaactcctctttgattcttctagctgtttcactattgggcaaccagacaccagaatgagtactaaaaagtctcctgaggaactgaagaggatttttgaaaaatatgcagccaaagaaggtgatccagaccagttgtcaaaggatgaactgaagctattgattcaggctgaattccccagtttactcaaaggtccaaacaccctagatgatctctttcaagaactggacaagaatggagatggagaagttagttttgaagaattccaagtattagtaaaaaagatatcccagtgaaggagaaaacaaaatagaaccctgagcactggaggaagagcgcctgtgctgtggtcttatcctatgtggaatcccccaaagtctctggtttaattctttgcaattataataacctggctgtgaggttcagttattattaataaagaaattattagacat

SEQ ID NO: 60502 - DNA, 1736 bp, Homo sapiens
aggaagcctctgcctcagagatgctgctgcccctgctatgggcaaatgaagagagggacagtgggggctgggctgaccctcgtttctccacagcgtcccaggacctactgtcaagatacaggctggaggtgccagagtcggtgactgtgcaggagggtctgtgtgtctctgtgccctgcagtgtcctttacccccattacaactggactgcctctagccctgtttatggatcctggttcaaggaaggggccgatataccatgggatattccagtggccacaaacaccccaagtggaaaagtgcaagaggatacccacggtcgattcctcctccttggggacccacagaccaacaactgctccctgagcatcagagatgccaggaagggggattcagggaagtactacttccaggtggagagaggaagcaggaaatggaactacatatatgacaagctctctgtgcatgtgacagccctgactcacatgcccaccttctccatcccggggaccctggagtctggccaccccaggaacctgacctgctctgtgccctgggcctgtgaacaggggacgccccccacgatcacctggatgggggcctccgtgtcctccctggaccccactatcactcgctcctcgatgctcagcctcatcccacagccccaggaccatggcaccagcctcacctgtcaggtgaccttgcctggggccggcgtgaccatgaccagggctgtccgactcaacatatcctatcctcctcagaacttgaccatgactgtcttccaaggagatggcacagcatccacaaccttgaggaatggctcggccctttcagtcctggagggccagtccctgcaccttgtctgtgctgtcgacagcaatccccctgccaggctgagctggacctgggggagcctgaccctgagcccctcacagtcctcgaaccttggggtgctggagctgcctcgagtgcatgtgaaggatgaaggggaattcacctgccgagctcagaaccctctaggctcccagcacatttccctgagcctctccctgcaaaacgagtacacaggcaaaatgaggcctatatcaggagtgacgctaggggcattcgggggagctggagccacagccctggtcttcctgtacttctgcatcatcttcgttgtagtgaggtcctgcaggaagaaatcggcaaggccagcagtgggcgtgggggatacaggcatggaggacgcaaacgctgtcaggggctcagcctctcagggacccctgattgaatccccggcagatgacagccccccacaccatgctccgccagccctggccaccccctccccagaggaaggagagatccagtatgcatccctcagcttccacaaagcgaggcctcagtacccacaggaacaggaggccatcggctatgagtactccgagatcaacatccccaagtgagaaactgcagagactcaggcctgtttgagggctcacgacccctgcagcaaagaagcccgagactgattcctttagaattaacagccctccatgctgtgcaacaggacatcagaacttattcctcttgtcaaactgaaaatgcgtgcctgatgaccaaactctccctttctccatccaatcggtccacactccccgcccccggcctctggtacccaccattctcttctctacttctctgaggtcgactattttaggttccaaatatagtgagatcgtagagtg

SEQ ID NO: 60503 - DNA, 2126 bp, Homo sapiens
gaagaaccctgaggaacagacttacctcagcaaccctggcacctccaacccgacacatgctactgctgctgctactgctgccacccctgctctgtgggagagtgggggctaaggaacagaaggattacctgctgacaatgcagaagtccgtgacggtgcaggagggcctgtgtgtctctgtgctttgctccttctcctacccccaaaatggctggactgcctccgatccagttcatggctactggttccgggcaggggaccatgtaagccggaacattccagtggccacaaacaacccagctcgagcagtgcaggaggagactcgggaccgattccacctccttggggacccacagaacaaggattgtaccctgagcatcagagacaccagagagagtgatgcagggacatacgtcttttgtgtagagagaggaaatatgaaatggaattataaatatgaccagctctctgtgaatgtgacagcgtcccaggacctactgtcaagatacaggctggaggtgccagagtcggtgactgtgcaggagggtctgtgtgtctctgtgccctgcagtgtcctttacccccattacaactggactgcctctagccctgtttatggatcctggttcaaggaaggggccgatataccatgggatattccagtggccacaaacaccccaagtggaaaagtgcaagaggatacccacggtcgattcctcctccttggggacccacagaccaacaactgctccctgagcatcagagatgccaggaagggggattcagggaagtactacttccaggtggagagaggaagcaggaaatggaactacatatatgacaagctctctgtgcatgtgacagccctgactcacatgcccaccttctccatcccggggaccctggagtctggccaccccaggaacctgacctgctctgtgccctgggcctgtgaacaggggacgccccccacgatcacctggatgggggcctccgtgtcctccctggaccccactatcactcgctcctcgatgctcagcctcatcccacagccccaggaccatggcaccagcctcacctgtcaggtgaccttgcctggggccggcgtgaccatgaccagggctgtccgactcaacatatcctatcctcctcagaacttgaccatgactgtcttccaaggagatggcacagcatccacaaccttgaggaatggctcggccctttcagtcctggagggccagtccctgcaccttgtctgtgctgtcgacagcaatccccctgccaggctgagctggacctgggggagcctgaccctgagcccctcacagtcctcgaaccttggggtgctggagctgcctcgagtgcatgtgaaggatgaaggggaattcacctgccgagctcagaaccctctaggctcccagcacatttccctgagcctctccctgcaaaacgagtacacaggcaaaatgaggcctatatcaggagtgacgctaggggcattcgggggagctggagccacagccctggtcttcctgtacttctgcatcatcttcgttgtagtgaggtcctgcaggaagaaatcggcaaggccagcagtgggcgtgggggatacaggcatggaggacgcaaacgctgtcaggggctcagcctctcagggacccctgattgaatccccggcagatgacagccccccacaccatgctccgccagccctggccaccccctccccagaggaaggagagatccagtatgcatccctcagcttccacaaagcgaggcctcagtacccacaggaacaggaggccatcggctatgagtactccgagatcaacatccccaagtgagaaactgcagagactcaggcctgtttgagggctcacgacccctgcagcaaagaagcccgagactgattcctttagaattaacagccctccatgctgtgcaacaggacatcagaacttattcctcttgtcaaactgaaaatgcgtgcctgatgaccaaactctccctttctccatccaatcggtccacactccccgcccccggcctctggtacccaccattctcttctctacttctctgaggtcgactattttaggttccaaatatagtgagatcgtagagtg

SEQ ID NO: 60504 - DNA, 3779 bp, Homo sapiens
ttctattgaaagggaaatgggagaacaatatgtgttcctatggctcagtccctataagattctgtactattcagagttgattttaagtgtcacttaactgaaattatccaacaaaccttcatggcatgaaacattaacacagctctttttatatggcatggttcctatggctcaatccctataagattctgtactagttcagagttgattttaaaagtcacttaactgaaattatccaacaaaccctcgaggacattaaacattaacgtggctctttttatatggcatggttcattatcatgccaataaatgattaatcgtaactctctgtcttgaccaataattttgctggacttttgtgattcacaacgtgctctgtgttgtaatgctacctcttgaaactgacatcctagctttattgttttttattacttccctaaggtggctttcaaaagagacaccaagtgacatatttttaggaggggtttaaaagtttgatggggtagaagtaaacgttgcttaactcaaccagcagcagagccagggcccagggaccagcgcttctgtggacttggcctttccagcagcagacccagcaatgaatgatccgaacagctgtgtggacaatgcaacagtttgctctggtgcatcctgtgtggtacctgagagcaatttcaataacatcctaagtgtggtcctaagtacggtgctgaccatcctgttggccttggtgatgttctccatgggatgcaacgtggaaatcaagaaatttctagggcacataaagcggccgtggggcatttgtgttggcttcctctgtcagtttggaatcatgcccctcacaggattcatcctgtcggtggcctttgacatcctcccgctccaggccgtagtggtgctcattataggatgctgccctggaggaactgcctccaatatcttggcctattgggtcgatggcgacatggacctgagcgtcagcatgaccacatgctccacactgcttgccctcggaatgatgccgctgtgcctccttatctataccaaaatgtgggtcgactctgggagcatcgtaattccctatgataacataggtacatctctggttgctctcgttgttcctgtttccattggaatgtttgttaatcacaaatggccccaaaaagcaaagatcatacttaaaattgggtccatcgcgggcgccatcctcattgtgctcatagctgtggttggaggaatattgtaccaaagcgcctggatcattgctcccaaactgtggattataggaacaatatttcctgtggcgggttactccctggggtttcttctggctagaattgctggtctaccctggtacaggtgccgaacggttgcttttgaaacggggatgcagaacacgcagctatgttccaccatcgttcagctctccttcactcctgaggagctcaatgtcgtattcaccttcccgctcatctacagcattttccagctcgcctttgccgcaatattcttaggattttatgtggcatacaagaaatgtcatggaaaaaacaaggcagaaattccagagagcaaagaaaatggaacggagccagagtcatcgttttataaggcaaatggaggatttcaacctgacgaaaagtagacatcaagtggacaaaacagacgagttccaaattacgttcttaaaccgtaactatatttaattatttgttttggtaggacagttggcagaaaagagttaaagtgaaaattggaatttcattggaattcatgtattggtttcagtaccaagtgactggtggcccaattctttaatgggacaaatattgtttcctatatatatgtatatgttttatatatgtatgtatactcatatagatatattgtcattgaaatattcccccaaaatattctcagactaaacctgacatagggaacaccgagaatgaaaacatcgttaacaccaaaactgaattcttatgcagaatttcctagcccatagatgacaacctgagtttctgtatgttaaagtagatgtaatgaattattattattacagtggtcacgattttcttcagtgtttatgattataaaaattgacatgaacatctttcactgacattttaatcattattttaaaagctttgcaacctatatatttatataactttgtaatataacatgggcaaatatctgacttcagtatttttaaaaagttgccttctccagtggcagtccaaaagcagaaatgagaggaaattattacaaaatagaattcaataaccatattggatgcaggctcttaactcagcagggatatcgtacatctattgctctacctcaggggtccagtgatacccactagatcttccaaggaaaaacataattctttcaaacggtgtgtatttggcaaagagctcttcaaatctgggagagggacttcctcaaggttttcctgtgtgcagtggatccacatagctaatatgacagctagtcagttgacagggaccacccacagtaagcaccatggtcagggaggtggcaggaggtgcaaagacagaagtattgagagaaacaccaagactctagtggaggaattaattcaatgggagatagtataaaatacatagaaaacacaagtaacagaaacctggttgaaatgcttaactagagtcaattagatgtgcaggagtaagtagtataagaagaatcaagtccgagagtgatcaggaaatgagtattaaacagtatttgaaacagagaacgtgtcccagggcccaaaagtcagaagggccccaccagccaggaaagttgtttcaatgctgtaagtaggtgtagccaagggaagccaggactatctgatatacggtagcaggggtttacggctgccaggggaaaataactcatcaagtgttggactttcaattataagatcgaatttaatttcctttccctcattctgcagcaatcagaatacacaatcttaaccactcggtccttagtggttttgttccattttgcattgggtattttcactgcctcatagagtctatttcaagtgtttggctgaaagggctttttgcatttgcatgttctgagttcagattctgctggtgcacccaagcattatgggaacaggaactcaacttagctcttccagtagaggggtgagggattctgcttttcaaattcataacattgatctttttatgcaagatttccatttacagttgaataagtacttcatatttttccatcattagacaaatacaaaatggactaaataattttaagagatagtggaggcagcagggggtacagacttccttcttagagagtgtcagagaatatgctcccaatggtggaaaggaagatttacagtctagcggctaagtacctcctacacatttcccatcaatcagaaaatagacaggtacactaaagggacctgagaactcctcttgtaatttcaacacacccaaaatcaagggcctggatgccagcagctgcagcaagcaggtttttcctccctgttgagcaagacaggtgaggcaagataggacttggctttcttacatgatgcggtaacttgtgacttgagtctttttccctaatttgctagtgggaagaaaaatagctgagctttctaaaatgatagctctctatttttaaatgaatttgaaaagtcgattaaattatgtattttattgcctctgagtatcatattaaatgaatattttattttaaaggcttaaataaatgaaaatgatttttgt

SEQ ID NO: 60505 - DNA, 3105 bp, Homo sapiens
ccacctgccaggagcacgtcccgccggcagtcgcaggagccctgggagccgccgccatgggaatgtccaaatcacacagtttctttggttatcccctgagcatcttcttcatcgtggtcaatgagttttgcgaaagattttcctactatggaatgcgagcaatcctgattctgtacttcacaaatttcatcagctgggatgataacctgtccaccgccatctaccatacgtttgtggctctgtgctacctgacgccaattctcggagctcttatcgccgactcgtggctgggaaagttcaagaccattgtgtcgctctccattgtctacacaattggacaagcagtcacctcagtaagctccattaatgacctcacagaccacaaccatgatggcacccccgacagccttcctgtgcacgtggtgctgtccttgatcggcctggccctgatagctctcgggactggaggaatcaaaccctgtgtgtctgcgtttggtggagatcagtttgaagagggccaggagaaacaaagaaacagatttttttccatcttttacttggctattaatgctggaagtttgctttccacaatcatcacacccatgctcagagttcaacaatgtggaattcacagtaaacaagcttgttacccactggcctttggggttcctgctgctctcatggctgtagccctgattgtgtttgtccttggcagtgggatgtacaagaagttcaagccacagggcaacatcatgggtaaagtggccaagtgcatcggttttgccatcaaaaatagatttaggcatcggagtaaggcatttcccaagagggagcactggctggactgggctaaagagaaatacgatgagcggctcatctcccaaattaagatggttacgagggtgatgttcctgtatattccactcccaatgttctgggccttgtttgaccagcagggctccaggtggacactgcaggcaacaactatgtccgggaaaatcggagctcttgaaattcagcccgatcagatgcagaccgtgaacgccatcctgatcgtgatcatggtcccgatcttcgatgctgtgctgtaccctctcattgcaaaatgtggcttcaatttcacctccttgaagaagatggcagttggcatggtcctggcctccatggcctttgtggtggctgccatcgtgcaggtggaaatcgataaaactcttccagtcttccccaaaggaaacgaagtccaaattaaagttttgaatataggaaacaataccatgaatatatctcttcctggagagatggtgacacttggcccaatgtctcaaacaaatgcatttatgacttttgatgtaaacaaactgacaaggataaacatttcttctcctggatcaccagtcactgctgtaactgacgacttcaagcagggccaacgccacacgcttctagtgtgggcccccaatcactaccaggtggtaaaggatggtcttaaccagaagccagaaaaaggggaaaatggaatcagatttgtaaatacttttaacgagctcatcaccatcacaatgagtgggaaagtttatgcaaacatcagcagctacaatgccagcacataccagttttttccttctggcataaaaggcttcacaataagctcaacagagattccgccacaatgtcaacctaatttcaatactttctaccttgaatttggtagtgcttatacctatatagtccaaaggaagaatgacagctgccctgaagtgaaggtgtttgaagatatttcagccaacacagttaacatggctctgcaaatcccgcagtattttcttctcacctgtggcgaagtggtcttctctgtcacgggattggaattctcatattctcaggctccttccaacatgaagtcggtgcttcaggcaggatggctgctgaccgtggctgttggcaacatcattgtgctcatcgtggcaggggcaggccagttcagcaaacagtgggccgagtacattctatttgccgcgttgcttctggtcgtctgtgtaatttttgccatcatggctcggttctatacttacatcaacccagcggagatcgaagctcaatttgatgaggatgaaaagaaaaacagactggaaaagagtaacccatatttcatgtcaggggccaattcacagaaacagatgtgaaggtcaggaggcaagtggaggatggactgggcccgcagatgccctgacctctgcccccaggtagcaggacactccattggatggcccctgatgaggaagacttcagaattgggaactaaaccatgaatgctattttcttttttctttttcttttcttttttttttttttttttttgagacagagttttgctcttgttgtccaggctggagtgcaatggcacgatctcagctcactgcaacctccgcctcccaggttcaagtaattctcctgcctcagcctcccgagtggctgggattagcggcatgcaccaccacgcccagctatttttgtatttttagtagagatggggtttcaccatgttaaccaggatggtctcgatctcttgacctggtgatctgcccacctcggcctgccaaagtgctgggattacaggcttgagctaccgcgcccggccgtgaacgctattttctaagcagccagcagtgaatctaaaactctggaagaagtcttctgtttgaaaggcttatttaagccacacgtacacacactgtcttagagtactgtgagcccaccccacattggtcatcttccctatcacacaaatgatgttattttggactagcttaattttgaaatggtaacaaagtttcctattccatactgttcatttctaatactcttacgaaaactattctaaaggaggcaggagccaaggccaaaagtgaacgtacaggtttaaaatggctgtgataagggccagctggtattaactgataactttacctttgggtttttgttattttgtttttctagtccctacctgtgtttaaattatggataactcgaaagacaggctcaggtgaaggccgagtaatgattttttttgaagtttcaatggtgtgaaataaatttctgttctta

SEQ ID NO: 60506 - DNA, 3838 bp, Homo sapiens
tcttggaagatccgagctgggtttcatctcctttttgattttgagtagttccctccacgagaactgacttccaggtgttcaccaagggaaacaaggtggttctcacactggaaatgaggaaggatgacagtttttgagactgactgttaacggctcagaggtgcccctcattcaaaatgccttttaaagcatttgataccttcaaagaaaaaattctgaaacctgggaaggaaggagtgaagaacgccgtgggagattctttgggaattttacaaagaaaaatcgatgggacaactgaggaagaagataacattgagctgaatgaagaaggaaggccggtgcagacgtccaggccaagccccccactctgcgactgccactgctgcggcctccccaagcgttacatcattgctatcatgagtgggctgggattctgcatttcctttgggatccggtgcaatcttggagttgccattgtggaaatggtcaacaatagcaccgtatatgttgatggaaaaccggaaattcagacagcacagtttaactgggatccagaaacagtgggccttatccatggatcttttttctggggctatattatgacacaaattccaggtggtttcatttcaaacaagtttgctgctaacagggtctttggagctgccatcttcttaacatcgactctgaacatgtttattccctctgcagccagagtgcattacggatgcgtcatgtgtgtcagaattctgcaaggtttagtggagggtgtgacctacccagcctgccatgggatgtggagtaagtgggcaccacctttggagagaagccgactggccacaacctctttttgtggttcctatgcaggggcagtggttgccatgcccctggctggggtgttggtgcagtacattggatggtcctctgtcttttatatttatggcatgtttgggattatttggtacatgttttggctgttgcaggcctatgagtgcccagcagctcatccaacaatatccaatgaggagaagacctatatagagacaagcataggagagggggccaacgtggttagtctaagtaaatttagtaccccatggaaaagatttttcacatctttgccggtttacgcaatcattgtggcaaatttttgcagaagctggaccttttatttgctcctcataagtcagcctgcttattttgaagaggtctttggatttgcaataagtaaggtgggtctcttgtcagcagtcccacacatggttatgacaatcgttgtacctattggaggacaattggctgattatttaagaagcagacaaattttaaccacaactgctgtcagaaaaatcatgaactgtggaggttttggcatggaggcaaccttactcctggtggttggcttttcgcataccaaaggggtggctatctcctttctggtacttgctgtaggatttagtggcttcgctatttcaggttttaatgtcaaccacctggacattgccccacgctatgccagcattctcatggggatctcaaacggagtgggaaccctctctggaatggtctgtcccctcattgtcggtgcaatgaccaggcacaagacccgtgaagaatggcagaatgtgttcctcatagctgccctggtgcattacagtggtgtgatcttctatggggtctttgcttctggggagaaacaggagtgggctgacccagagaatctctctgaggagaaatgtggaatcattgaccaggacgaattagctgaggagatagaactcaaccatgagagttttgcgagtcccaaaaagaagatgtcttatggagccacctcccagaattgtgaagtccagaagaaggaatggaaaggacagagaggagcgacccttgatgaggaagagctgacatcctaccagaatgaagagagaaacttctcaactatatcctaatgtctgagaggcacttctgtcttctccttactttagaaacagaaagtatccatacctattgcctttcttgtagcccagcttgccagaggtccaaatattgggaggggagaagatctaaccagcaacagggaaaagagaaatattatctttcaatgacatgtataggtaaggagctgcgctcagttgataacatagttgataatacatattttttgaattgacagttgacccttctctcaaagagctaaacttattcagaaaggaatgactagaagaaaaaggagacaataccatgttgttcaaagaaacattgaaggaaattgggatgtttggccagaaggaatgtaaacagtagtagtagctgccaccacatctctagggtagccatgcagaggagggcttcatattcccaataaaccccacgttgtggcaggtgctttataaacactcttatttaatctccacacctttatgacacacatttcttatccccattttacaaccaaggcatctaaagcaacaagaaatgaacttgcccaaggtcatctgccagggtcagtgctgagactgttgaagctctcaataggtggcagttttagggaagatttccattcagtgtagggaagacatttgtaataatgaaaactgaaaatggagtaattgtgagtaactcaccactttagcaggtgttggggaagggaaacatttgggttgatgaggcagaggggattcaaatgtgtgagaggctagattcaaagaccctcagtgttctatgttatctgaagagtcaaatggttttgtgactccatagtttttaaagtaataagggtcaaagactacatcagagattcaaataggtttttaaagaaaagctaagcaagagagccaaatttttagaaatctgatggtcaaaatagctgaaagcagtaaacaagagattggctattaaatttcaactttccataatattaagaatgtagctaaatgatgtcccaaactacttacaaacttttaagacatttaataatttaagaagtaggttcatgtgttttcttaggtaaagttcttctgaaagaattttctatttttaaaaaatgtatctctttagccttttctgctggagattatattaggaagtttcatcagattgtataaaattatgattttgtatcaaaagtattcatgatgactctatttggaatgatattcagggaaatcacaataatatagcagtagttatacagagaaatactacaatgaaaacatttggggcaattagacctacagttactgttgaaaaattcacctttgattgcataaggcaattacatggatacttttagatatatttaaaattttaacattggcatctaaagtgttatttgaaaataaaattattttcctgttcattgattttaaacattttattcctactttcagaagaaaaatataatacggaaaaaattatagatttacttgtagcttattattgtaaagtgttttttttttttttctaatttctcccacatgtatttctggtccccagtgatactagctgagttgtagtgtattttataaatggaataatcttggggaaaaattgcgattcttcattaaataatattctttatgtcactagcatacaatttatgttagtagacatctttaaatctctttaatgagtgaatccatgcaagccccataaaacagttcctagcatgcagaaaatgcccacgtaaatagctgtcatcatcattatcttttaacattttgggggactttccagttgaaaagaaaacatgctatgtcatttttatccattatccctggaacttattgtgaaagttgtgctgttttctaagtaaaataaaaaataaaaaattagcaattta

SEQ ID NO: 60507 - DNA, 2326 bp, Homo sapiens
ggcctttgtcaagtcatcccctcttctcctcaggaactgctcaaacctgtgccccaaagatgagggcccaggaggacctcgagggccggacacagcatgaaaccaccagggacccctcgaccccgctacccacagagcctaagtttgacatgttgtacaagatcgaggacgtgccaccttggtacctgtgcatcctgctgggcttccagcactacctgacatgcttcagtggtaccatcgccgtgcccttcctgctggctgaggcgctgtgtgtgggccacgaccagcacatggttagtcagctcatcggcaccatcttcacgtgcgtgggcatcaccactctcatccagaccaccgtgggcatccggctgccgctgttccaggccagtgcctttgcatttctggttccagccaaagccatactggctctggagagatggaaatgccccccggaagaggagatctacggtaactggagtctgcccctgaacacctctcatatttggcacccacggatacgggaggtccagggtgcaatcatggtgtccagcgtggtggaggtggtgattggcctgctggggctgcctggggccctgctcaactacattgggcctctcacagtcacccccactgtctccctcattggcctttctgtcttccaagctgctggcgaccgagctggctcccactggggcatctcagcttgctccattctcctgatcatcctcttctcccagtacctgcgcaacctcaccttcctgctgcctgtctaccgctggggcaagggcctcactctcctccgcatccagatcttcaaaatgtttcctatcatgctggccatcatgaccgtgtggctgctctgctatgtcctgaccttgacagacgtgctgcccacagacccaaaagcctatggcttccaggcacgaaccgatgcccgtggtgacatcatggctattgcaccctggatccgcatcccctacccctgtcagtggggcctgcccacggtgactgcggctgctgtcctgggaatgttcagcgccactctggcaggcatcattgagtccatcggagattactacgcctgtgcccgcctggctggtgcaccaccccctccagtacatgctatcaacaggggcatcttcaccgaaggcatttgctgcatcatcgcggggctattgggcacgggcaacgggtccacctcgtccagtcccaacattggcgtcctgggaattaccaaggtgggcagccggcgcgtggtgcagtatggtgcggctatcatgctggtcctgggcaccatcggcaagttcacggccctcttcgcctcgctccctgaccccatcctggggggcatgttctgcactctctttggcatgattacagctgtggggctgtccaacctgcaatttgtggacatgaactcctctcgcaacctcttcgtgctgggattttccatgttcttcgggctcacgctgcccaattacctggagtccaaccctggcgccatcaatacaggcattcttgaagtggatcagattctgattgtgctgctgaccacggagatgtttgtgggcgggtgccttgctttcatacttgacaacacagtgccagggagcccagaggagcgtggtctgatacagtggaaagctggggctcatgccaacagtgacatgtcttccagcctcaagagctacgatttccccattgggatgggcatagtaaaaagaattacctttctgaaatacattcctatctgcccagtcttcaaaggattttcttcaagttcaaaagatcagattgcaattccagaagacactccagaaaatacagaaactgcatctgtgtgcaccaaggtctgaaaaatgacttccaggaaaggaagcatggtatataacaggaaaagaaaactacatggggaaccagaagacctaagcctgaaatcccagccctgcccctaactaacttctgtgtaaactcagataagtcacctttctctgggattcaaatttttgcatcagttaaaaaaaaaggggtgggggggaatgggccaaagtctgagtcttagagacttgtaccaatgttatgctatgtctctaaatctttactctcctaagtagacttgtcagcatctaggaagaacagctagaaattttcctctgtgatattttagactgcaagttgaaaaaaataaaaagaaatgagggcaggttccagggcctgaaatgtaggtatgctgcaaggcttttacattgaatttgaccctacatcacttcaagactaatgcataatattaaacatcatgttgaagaaaaaaaaaaaaaaaaaaaaa

SEQ ID NO: 60508 - DNA, 2338 bp, Homo sapiens
ggcctttgtcaagtcatcccctcttctcctcaggaactgctcaaacctgtgccccaaagatgagggcccaggaggacctcgagggccggacacagcatgaaaccaccagggacccctcgaccccgctacccacagagcctaagtttgacatgttgtacaagatcgaggacgtgccaccttggtacctgtgcatcctgctgggcttccagcactacctgacatgcttcagtggtaccatcgccgtgcccttcctgctggctgaggcgctgtgtgtgggccacgaccagcacatggttagtcagctcatcggcaccatcttcacgtgcgtgggcatcaccactctcatccagaccaccgtgggcatccggctgccgctgttccaggccagtgcctttgcatttctggttccagccaaagccatactggctctggagagatggaaatgccccccggaagaggagatctacggtaactggagtctgcccctgaacacctctcatatttggcacccacggatacgggaggtgggtttgcatgtccagggtgcaatcatggtgtccagcgtggtggaggtggtgattggcctgctggggctgcctggggccctgctcaactacattgggcctctcacagtcacccccactgtctccctcattggcctttctgtcttccaagctgctggcgaccgagctggctcccactggggcatctcagcttgctccattctcctgatcatcctcttctcccagtacctgcgcaacctcaccttcctgctgcctgtctaccgctggggcaagggcctcactctcctccgcatccagatcttcaaaatgtttcctatcatgctggccatcatgaccgtgtggctgctctgctatgtcctgaccttgacagacgtgctgcccacagacccaaaagcctatggcttccaggcacgaaccgatgcccgtggtgacatcatggctattgcaccctggatccgcatcccctacccctgtcagtggggcctgcccacggtgactgcggctgctgtcctgggaatgttcagcgccactctggcaggcatcattgagtccatcggagattactacgcctgtgcccgcctggctggtgcaccaccccctccagtacatgctatcaacaggggcatcttcaccgaaggcatttgctgcatcatcgcggggctattgggcacgggcaacgggtccacctcgtccagtcccaacattggcgtcctgggaattaccaaggtgggcagccggcgcgtggtgcagtatggtgcggctatcatgctggtcctgggcaccatcggcaagttcacggccctcttcgcctcgctccctgaccccatcctggggggcatgttctgcactctctttggcatgattacagctgtggggctgtccaacctgcaatttgtggacatgaactcctctcgcaacctcttcgtgctgggattttccatgttcttcgggctcacgctgcccaattacctggagtccaaccctggcgccatcaatacaggcattcttgaagtggatcagattctgattgtgctgctgaccacggagatgtttgtgggcgggtgccttgctttcatacttgacaacacagtgccagggagcccagaggagcgtggtctgatacagtggaaagctggggctcatgccaacagtgacatgtcttccagcctcaagagctacgatttccccattgggatgggcatagtaaaaagaattacctttctgaaatacattcctatctgcccagtcttcaaaggattttcttcaagttcaaaagatcagattgcaattccagaagacactccagaaaatacagaaactgcatctgtgtgcaccaaggtctgaaaaatgacttccaggaaaggaagcatggtatataacaggaaaagaaaactacatggggaaccagaagacctaagcctgaaatcccagccctgcccctaactaacttctgtgtaaactcagataagtcacctttctctgggattcaaatttttgcatcagttaaaaaaaaaggggtgggggggaatgggccaaagtctgagtcttagagacttgtaccaatgttatgctatgtctctaaatctttactctcctaagtagacttgtcagcatctaggaagaacagctagaaattttcctctgtgatattttagactgcaagttgaaaaaaataaaaagaaatgagggcaggttccagggcctgaaatgtaggtatgctgcaaggcttttacattgaatttgaccctacatcacttcaagactaatgcataatattaaacatcatgttgaagaaaaaaaaaaaaaaaaaaaaa

SEQ ID NO: 60509 - DNA, 2036 bp, Homo sapiens
caaggcagcatgagccgatcacccctcaatcccagccaactccgatcagtgggctcccaggatgccctggcccccttgcctccacctgctccccagaatccctccacccactcttgggaccctttgtgtggatctctgccttggggcctcagctgtcttctggctctgcagcatgtcttggtcatggcttctctgctctgtgtctcccacctgctcctgctttgcagtctctccccaggaggactctcttactccccttctcagctcctggcctccagcttcttttcatgtggtatgtctaccatcctgcaaacttggatgggcagcaggctgcctcttgtccaggctccatccttagagttccttatccctgctctggtgctgaccagccagaagctaccccgggccatccagacacctggaaactcctccctcatgctgcacctttgtaggggacctagctgccatggcctggggcactggaacacttctctccaggaggtgtccggggcagtggtagtatctgggctgctgcagggcatgatggggctgctggggagtcccggccacgtgttcccccactgtgggcccctggtgctggctcccagcctggttgtggcagggctctctgcccacagggaggtagcccagttctgcttcacacactgggggttggccttgctcacctgggctcctgccagtttcatgtgtgcccctggaggcgagcttcaacgtcatcaactcacactcctctccctgtcttccggctcctttcggaactgtctgcccccaccaaggcaccatggatttggctgcctcacccaggctggatctcagcaagtggctcacttagtggggctactctgcgtggggcttggactctcccccaggttggctcagctcctcaccaccatcccactgcctgttgttggtggggtgctgggggtgacccaggctgtggttttgtctgctggattctccagcttctacctggctgacatagactctgggcgaaatatcttcattgtgggcttctccatcttcatggccttgctgctgccaagatggtttcgggaagccccagtcctgttcagcacaggctggagccccttggatgtattactgcactcactgctgacacagcccatcttcctggctggactctcaggcttcctactggagaacacgattcctggcacacagcttgagcgaggcctaggtcaagggctaccatctcctttcactgcccaagaggctcgaatgcctcagaagcccagggagaaggctcaagtgtacagacttcctttccccatccaaaacctctgtccctgcatcccccagcctctccactgcctctgcccactgcctgaagaccctggggatgaggaaggaggctcctctgagccagaagagatggcagacttgctgcctggctcaggggagccatgccctgaatctagcagagaagggtttaggtcccagaaatgaccagaacgcctacttctgccctggttaatttagccctaactctcatctgctggagagtcagctcccaaactgttctttcttgtaggcagaggatatgtgtgtgtgtattacatgggactgtctagaggttccatttcccaatagggtgggttgcctttccttgtcttaattaggcctaactgttccagagcagaggccatgatttagtggaccatgaatgattgagattttgcctgtgtactatcaatgccacttgaaccccagcattcactttaatacttactgagcatctcccatgtgcaaggtcctggaactacagggataagacagggtccatgccgtctcaaggcatttacggtttaaaaagacctttgtaattactaacgaaaatgcaaagcagaaagcagtctgtaataaagattaaaataatgccgtgggagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 60510 - DNA, 2459 bp, Homo sapiens
tccttcactgaggagccagagggaatcaattccccaagctgggttgaggagaacaggagatggagaaagcaagtggaagacagtccattgctctgtccacagtggagactggcacagtgaacccggggctggagctcatggaaaaagaagtagagcctgagggaagcaagaggactgacgcacaaggacacagcctgggggatggactgggcccttccacttaccagaggaggagtcggtggcctttcagcaaagcaagaagtttctgcaaaacacacgccagattgttcaagaagatcctgttgggcctgttgtgtttggcctatgctgcctatctcctggcagcttgcatcttgaatttccagagggcactggccttgtttgtcatcacctgcttggtgatctttgtcctggttcactcgtttttgaaaaagctcctgggcaaaaaattaacaagatgtctgaagccctttgaaaactcccgcctgaggctttggacgaaatgggtgtttgcaggagtctccttggttggccttatactgtggttggctttagacacagcccaaaggccagagcagctgatcccctttgcaggaatctgcatgttcatccttatcctctttgcctgctccaaacaccacagcgcagtgtcctggaggacagtgttttcgggcctaggtcttcaatttgtctttgggatcttggtcatcagaactgatcttggatatactgtatttcagtggctgggagagcaggtccagattttcctgaactacactgtggccggctccagttttgtctttggggatacactggtcaaggatgtctttgcttttcaggccttaccaatcatcattttctttggatgtgtggtgtccattctctactacctgggcctggtgcaatgggtagttcagaaggtcgcctggtttttacaaatcactatgggcaccactgctacagagaccctggctgtggcaggaaacatctttgtgggtatgacagaggcacctctgctcatccgtccctaccttggggacatgacactctctgaaatccatgcggtgatgactggagggtttgccaccatttctggcactgtgctgggagccttcatagcctttggggttgatgcatcatccctgatttctgcctctgtgatggccgccccttgtgctctcgcctcatcaaagctagcgtatccggaagtggaggagtccaagttcaagagtgaggagggggtaaagctgccccgtgggaaggagaggaatgtcctggaagctgccagcaacggagccgtagatgccataggccttgctactaatgtagcagccaacctgattgcctttttggctgtgttggccttcatcaatgctgccctctcctggctgggggaattggtggacatacaggggctcactttccaggtcatctgctcctatctcctaaggcccatggttttcatgatgggtgtagagtggacagactgtccaatggtggctgagatggtgggaatcaagttcttcataaatgagtttgtggcttatcagcaactgtctcaatacaagaacaaacgtctctctggaatggaggagtggattgagggagagaaacagtggatttctgtgagagctgaaatcattacaacattttcactctgtggatttgccaatcttagttccataggaatcacacttggaggcttgacatcaatagtacctcaccggaagagtgacttgtccaaggttgtggtcagggccctcttcacaggggcctgtgtatcccttatcagtgcctgtatggcaggaatcctctatgtccccaggggagctgaagctgactgtgtctccttcccaaacacaagtttcaccaatagaacctatgagacctacatgtgctgcagagggctctttcagagtacttctctgaatggcaccaaccctccttctttttctggtccctgggaagataaggagttcagtgctatggcccttactaactgctgtggattctacaacaataccgtctgtgcctaaggctgcttgatctatttctataacagttttgatcttaaaagctttgtgattgcaaaggtgtttatgtactcagggtgcccacaactcactcaccaagatgtttaacagtaagtaacagtaaatgtaaaagattcattttgggccgggctcagtggctcacgcctgtaatcccagcgctttgggaggccgaggcgggcggatcgcagggtcaggagatcgagaccatcctggctaacacggtgaaaccccgtctctactaaaggtacaaaaaattggccgggagtggtgtcgggcgactgtagtcccagctactcgcgagactgaggcaggagaatggcgtgaatccgggaggcggagcttgcagcgagccgggatcgcgccactgtactccagcctgggtgacagagcgagactctgtctcag

SEQ ID NO: 60511 - DNA, 2317 bp, Homo sapiens
aaaactccaggaggcggaggaggctagtggcagtacctgggcaccctgaccctccccacaggccagagcccaccctcctgctcatgagggcagacaggcctttccagggacacagtccctcttctccccaggaccccagggccaactccccctgccggccctctgccatcaaattggcagtggctccaggggagtcccctggggatgggggaccactgttggggacccctctgcgtgcacccctgtagttggggaagcaggacaggggcctggggagacggaagggcgccaggggttgagagaggatggtggacgttgttggacttgaaagggaaacaggccctcggggaagcccctggccaggcctgcctctcccctccctggtgggcccagcgcccctgctcacttgtctctgcccacagtgcctgtctgtggaggacgccctgggcctgggcgagcctgaggggtcagggctgcccccgggcccggtcctggaggccaggtacgtcgcccgcctcagtgccgccgccgtcctgtacctcagcaaccccgagggcacctgtgaggacgctcgggctggcctctgggcctctcatgcagaccacctcctggccctgctcgagagccccaaggccctgaccccgggcctgagctggctgctgcagaggatgcaggcccgggctgccggccagacccccaagacggcctgcgtagatatccctcagctgctggaggaggcggtgggggcgggggctccgggcagtgctggcggcgtcctggctgccctgctggaccatgtcaggagcgggtcttgcttccacgccttgccgagccctcagtacttcgtggactttgtgttccagcagcacagcagcgaggtccctatgacgctggccgagctgtcagccttgatgcagcgcctgggggtgggcagggaggcccacagtgaccacagtcatcggcacaggggagccagcagccgggaccctgtgcccctcatcagctccagcaacagctccagtgtgtgggacacggtatgcctgagtgccagggacgtgatggctgcatatggactgtcggaacaggctggggtgaccccggaggcctgggcccaactgagccctgccctgctccaacagcagctgagtggagcctacacctcccagtccaggccccccgtccaggaccagctcagccagtcagagagatatctgtacggctccctggccacgctgctcatctgcctctgcgcggtctttggcctcctgctgctgacctgcactggctgcaggggggtcgcccactacatcctgcagaccttcctgagcctggcagtgggtgcactcactggggacgctgtcctgcatctgacgcccaaggtgctggggctgcatacacacagcgaagagggcctcagcccacagcccacctggcgcctcctggctatgctggccgggctctacgccttcttcctgtttgagaacctcttcaatctcctgctgcccagggacccggaggacctggaggacgggccctgcggccacagcagccatagccacgggggccacagccacggtgtgtccctgcagctggcacccagcgagctccggcagcccaagcccccccacgagggctcccgcgcagacctggtggcggaggagagcccggagctgctgaaccctgagcccaggagactgagcccagagttgaggctactgccctatatgatcactctgggcgacgccgtgcacaacttcgccgacgggctggccgtgggcgccgccttcgcgtcctcctggaagaccgggctggccacctcgctggccgtgttctgccacgagttgccacacgagctgggggacttcgccgccttgctgcacgcggggctgtccgtgcgccaagcactgctgctgaacctggcctccgcgctcacggccttcgctggtcttacgtggcactcgcggttggagtcagcgaggagagcgaggcctggatcctggcagtggccaccggcctgttccttacgtagcactctgcgacatgctcccggcgatgttgaaagtacgggacccgcggcccctggctcctcttcctgctgcacaacgtgggcctgctgggcggctggaccgtcctgctgctgctgtccctgtacgaggatgacatcaccttctgataccctgccctagtcccccacctttgacttaagatcccacacctcacaaacctacagcccagaaacccagaagcccctatagaggccccagtcccaactccagtaaagacactcttgtcccttggaaaaaaaaaaaaaaaaaaa

SEQ ID NO: 60512 - DNA, 2192 bp, Homo sapiens
agtctggccctggacaaccccagcaaagccgccctcagccagcccagaagcactgggccttggccacagcaacacccactgagcacgctgggagctgagtatggcgtccctggtctcgctggagctggggctgcttctggctgtgctggtggtgacggcgacggcgtccccgcctgctggtctgctgagcctgctcacctctggccagggcgctctggatcaagaggctctgggcggcctgttaaatacgctggcggaccgtgtgcactgcaccaacgggccgtgtggaaagtgcctgtctgtggaggacgccctgggcctgggcgagcctgaggggtcagggctgcccccgggcccggtcctggaggccaggtacgtcgcccgcctcagtgccgccgccgtcctgtacctcagcaaccccgagggcacctgtgaggacactcgggctggcctctgggcctctcatgcagaccacctcctggccctgctcgagagccccaaggccctgaccccgggcctgagctggctgctgcagaggatgcaggcccgggctgccggccagacccccaagacggcctgcgtagatatccctcagctgctggaggaggcggtgggggcgggggctccgggcagtgctggcggcgtcctggctgccctgctggaccatgtcaggagcgggtcttgcttccacgccttgccgagccctcagtacttcgtggactttgtgttccagcagcacagcagcgaggtccctatgacgctggccgagctgtcagccttgatgcagcgcctgggggtgggcagggaggcccacagtgaccacagtcatcggcacaggggagccagcagccgggaccctgtgcccctcatcagctccagcaacagctccagtgtgtgggacacggtatgcctgagtgccagggacgtgatggctgcatatggactgtcggaacaggctggggtgaccccggaggcctgggcccaactgagccctgccctgctccaacagcagctgagtggagcctgcacctcccagtccaggccccccgtccaggaccagctcagccagtcagagaggtatctgtacggctccctggccacgctgctcatctgcctctgcgcggtctttggcctcctgctgctgacctgcactggctgcaggggggtcgcccactacatcctgcagaccttcctgagcctggcagtgggtgcactcactggggacgctgtcctgcatctgacgcccaaggtgctggggctgcatacacacagcgaagagggcctcagcccacagcccacctggcgcctcctggctatgctggccgggctctacgccttcttcctgtttgagaacctcttcaatctcctgctgcccagggacccggaggacctggaggacgggccctgcggccacagcagccatagccacgggggccacagccacggtgtgtccctgcagctggcacccagcgagctccggcagcccaagcccccccacgagggctcccgcgcagacctggtggcggaggagagcccggagctgctgaaccctgagcccaggagactgagcccagagttgaggctactgccctatatgatcactctgggcgacgccgtgcacaacttcgccgacgggctggccgtgggcgccgccttcgcgtcctcctggaagaccgggctggccacctcgctggccgtgttctgccacgagttgccacacgagctgggggacttcgccgccttgctgcacgcggggctgtccgtgcgccaagcactgctgctgaacctggcctccgcgctcacggccttcgctggtctctacgtggcactcgcggttggagtcagcgaggagagcgaggcctggatcctggcagtggccaccggcctgttcctctacgtagcactctgcgacatgctcccggcgatgttgaaagtacgggacccgcggccctggctcctcttcctgctgcacaacgtgggcctgctgggcggctggaccgtcctgctgctgctgtccctgtacgaggatgacatcaccttctgataccctgccctagtcccccacctttgacttaagatcccacacctcacaaacctacagcccagaaaccagaagcccctatagaggccccagtcccaactccagtaaagacactcttgtccttggaaaaaaaaaaaaaaaaaaaaaaaaa

SEQ ID NO: 60513 - DNA, 1895 bp, Homo sapiens
gtctacagcaaggcctaataggggacctgagggcacagtcctcaggatgtttcggggagaataggagccagaacctgagcccctaagccattcccctcaccaatgatggggtccccagtgagtcatctgctggccggcttctgtgtgtgggtcgtcttgggctgggtagggggctcagtccccaacctgggccctgctgagcaggagcagaaccattacctggcccagctgtttggcctgtacggcgagaatgggacgctgactgcagggggcttggcgcggcttctccacagcctggggctaggccgagttcaggggcttcgcctgggacagcatgggcctctgactggacgggctgcatccccagctgcagacaattccacacacaggccacagaaccctgagctgagtgtggatgtctgggcagggatgcctctgggtccctcagggtggggtgacctggaagagtcaaaggcccctcacctaccccgtgggccagccccctcgggcctggacctccttcacaggcttctgttgctggaccactcattggctgaccacctgaatgaggattgtctgaacggctcccagctgctggtcaattttggcttgagccccgctgctcctctgacccctcgtcagtttgctctgctgtgcccagccctgctttatcagatcgacagccgcgtctgcatcggcgctccggcccctgcacccccaggggatctactatctgccctgcttcagagtgccctggcagtcctgttgctcagcctcccttctcccctatccctgctgctgctgcggctcctgggacctcgtctactacggcccttgctgggcttcctgggggccctggcggtgggcactctttgtggggatgcactgctacatctgctaccgcatgcacaagaagggcggcacgcaggacctggcggactaccagagaaggacctgggcccggggctgtcagtgctcggaggcctcttcctgctctttgtgctggagaacatgctggggcttttgcggcaccgagggctcaggccaagatgctgcaggcgaaaacgaaggaatctcgaaacacgcaacttggatccggagaatggcagtgggatggcccttcagcccctacaggcagctccagagccaggggctcagggccagagggagaagaacagccagcacccaccagctctggcccctcctgggcaccaaggccacagtcatgggcaccagggtggcactgatatcacgtggatggtcctcctgggagatggtctacacaacctcactgatgggctggccataggtgctgccttctctgatggcttctccagcggcctcagtaccaccttagcggtcttctgccatgagctgccccacgaactgggtgactttgccatgctgctccagtcagggctgtcctttcggcggctgctgctgctgagcctcgtgtctggagccctgggattggggggtgcagtcctgggggtggggctcagcctgggccctgtccccctcactccctgggtgtttggggtcactgctggggtcttcctctatgtggcccttgtggacatgctaccagccctgcttcgtcctccggagcccctgcctacgccccatgtgctcctgcaggggctggggctgctgctggggggcggcctcatgcttgccataaccctgctggaggagcggctactgcccgtgaccactgagggctgatggggccagtggaaaggggtcgggttgcccttccttccccccaaccacaggaatggaggcgggacacagggccagtaggagcaataggattttaataaacagaacccatcccaaaaaaaaaaaaaaaaaaaaaaaaaaaaaaaaaaaaaaaaaaaaaaaaaaaaaaaaaa

SEQ ID NO: 60514 - DNA, 3227 bp, Homo sapiens
aacagatgagcaaggagctggcagcaatggggcctggagcttcaggggacggggtcaggactgagacagctccacacatagcactggactccagagttggtctgcacgcctacgacatcagcgtggtggtcatctactttgtcttcgtcattgctgtggggatctggtcgtccatccgtgcaagtcgagggaccattggcggctatttcctggccgggaggtccatgagctggtggccaattggagcatctctgatgtccagcaatgtgggcagtggcttgttcatcggcctggctgggacaggggctgccggaggccttgccgtaggtggcttcgagtggaacatgaggaaatcaaggtctggaggagacagagggatccatccaaggtcacacgggaggactggggtcaggtcccaggcaacctggctgctcctggcccttggctgggtcttcgtccctgtgtacatcgcagcaggtgtggtcacaatgccgcagtatctgaagaagcgatttgggggccagaggatccaggtgtacatgtctgtcctgtctctcatcctctacatcttcaccaagatctcgactgacatcttctctggagccctcttcatccagatggcattgggctggaacctgtacctctccacagggatcctgctggtggtgactgccgtctacaccattgcaggtggcctcatggccgtgatctacacagatgctctgcagacggtgatcatggtagggggagccctggtcctcatgtttctgggctttcaggacgtgggctggtacccaggcctggagcagcggtacaggcaggccatccctaatgtcacagtccccaacaccacctgtcacctcccacggcccgatgctttccacattcttcgggaccctgtgagcggggacatcccttggccaggtctcattttcgggctcacagtgctggccacctggtgttggtgcacagaccaggtcattgtgcagcggtctctctcggccaagagtctgtctcatgccaagggaggctccgtgctggggggctacctgaagatcctccccatgttcttcatcgtcatgcctggcatgatcagccgggccctgttcccagacgaggtgggctgcgtggaccctgatgtctgccaaagaatctgtggggcccgagtgggatgttccaacattgcctaccctaagttggtcatggccctcatgcctgttggtctgcgggggctgatgattgccgtgatcatggccgctctcatgagctcactcacctccatcttcaacagcagcagcaccctgttcaccattgatgtgtggcagcgcttccgcaggaagtcaacagagcaggagctgatggtggtgggcagagtgtttgtggtgttcctggttgtcatcagcatcctctggatccccatcatccaaagctccaacagtgggcagctcttcgactacatccaggctgtcaccagttacctggccccacccatcaccgctctcttcctgctggccatcttctgcaagagggtcacagagcccggagctttctggggcctcgtgtttggcctgggagtggggcttctgcgtatgatcctggagttctcatacccagcgccagcctgtggggaggtggaccggaggccagcagtgctgaaggacttccactacctgtactttgcaatcctcctctgcgggctcactgccatcgtcattgtcattgtcagcctctgtacaactcccatccctgaggaacagctcacacgcctcacatggtggactcggaactgccccctctctgagctggagaaggaggcccacgagagcacaccggagatatccgagaggccagccggggagtgccctgcaggaggtggagcggcagagaactcgagcctgggccaggagcagcctgaagccccaagcaggtcctggggaaagttgctctggagctggttctgtgggctctctggaacaccggagcaggccctgagcccagcagagaaggctgcgctagaacagaagctgacaagcattgaggaggagccactctggagacatgtctgcaacatcaatgctgtccttttgctggccatcaacatcttcctctggggctattttgcgtgattccacagacctggcttcagtgtagacagattaaacaaagcccaagcctgtcagccacagaaacaggctctcctcttactttgctgtctaaactggagatcacagaagtcaagactgcaagctcccctgaagagaatccaactcaacctgcacacttgacaagtggagaaacagaagcccagagagagcactgggtttgttcaggaccacccagaaggtgtcacacggggtttccccactctttctgatatattgccttacagacctacctcaaacacactgtttccaccctcttcttgaatgtattcagtagcctttactgaatgtgtgtcttgagagtagaaaaatggaggatacaagaaaaggagcaggaagaaatttgcaaaaatccaagagcacctttgctcccccttatcctccttcctcttcccctttctagttcccctacctctctatctttctattctcaccaataatctctttgttgcatgaatttacccaggagagtcctatatttccattggtggctccacagtggtggctgtcagacccgaaggggtggggagccaagggtggactttaagcatggtgacagatggtattttgggcagaaagctcttagacaatggactatccaaagcactatttaaattctgcctcttcctactctctaacccaaatatgcacaaactctctatggccttgagaagcagttggagagacatgacttgttaaaacctcaaggaatcaagacatgttactctgtatttaagggtaagccccacagcgggcagcacaaacagcctgggagccactgtgcctgtgcttctctgtccttctccctttgcttgccatgaatccgcataccttggaatacactgtgaccccagttaagtgtcccttcgccaggaagctgccgcaacgtccagacctgggtcaagttcccactcctgctcccatagccttgacctgcttctgtcacagcactgatcacactgagatggaagactccagggggcaaggaccaagggccatatcccaagtgactttgtacccagaaaataacagctgttcaataaatgtgtattgagttaattagtt

SEQ ID NO: 60515 - DNA, 1905 bp, Homo sapiens
atggtgaggctcgtgctgcccaaccccggcctagacgcccggatcccgtccctggctgagctggagaccatcgagcaggaggaggccagctcccggccgaagtgggacaacaaggcgcagtacatgctcacctgcctgggcttctgcgtgggcctcggcaacgtgtggcgcttcccctacctgtgtcagagccacggaggaggagccttcatgatcccgttcctcatcctgctggtcctggagggcatccccctgctgtacctggagttcgccatcgggcagcggctgcggcggggcagcctgggtgtgtggagctccatccacccggccctgaagggcctaggcctggcctccatgctcacgtccttcatggtgggactgtattacaacaccatcatctcctggatcatgtggtacttattcaactccttccaggagcctctgccctggagcgactgcccgctcaacgagaaccagacagggtatgtggacgagtgcgccaggagctcccctgtggactacttctggtaccgagagacgctcaacatctccacgtccatcagcgactcgggctccatccagtggtggatgctgctgtgcctggcctgcgcatggagcgtcctgtacatgtgcaccatccgcggcatcgagaccaccgggaaggccgtgtacatcacctccacgctgccctatgtcgtcctgaccatcttcctcatccgaggcctgacgctgaagggcgccaccaatggcatcgtcttcctcttcacgcccaacgtcacggagctggcccagccggacacctggctggacgcgggcgcacaggtcttcttctccttctccctggccttcgggggcctcatctccttctccagctacaactctgtgcacaacaactgcgagaaggactcggtgattgtgtccatcatcaacggcttcacatcggtgtatgtggccatcgtggtctactccgtcattgggttccgcgccacgcagcgctacgacgactgcttcagcacgaacatcctgaccctcatcaacgggttcgacctgcctgaaggcaacgtgacccaggagaactttgtggacatgcagcagcggtgcaacgcctccgaccccgcggcctacgcgcagctggtgttccagacctgcgacatcaacgccttcctctcagaggccgtggagggcacaggcctggccttcatcgtcttcaccgaggccatcaccaagatgccgttgtccccactgtggtctgtgctcttcttcattatgctcttctgcctggggctgtcatctatgtttgggaacatggagggcgtcgttgtgcccctgcaggacctcagagtcatccccccgaagtggcccaaggaggtgctcacaggcctcatctgcctggggacattcctcattggcttcatcttcacgctgaactccggccagtactggctctccctgctggacagctatgccggctccattcccctgctcatcatcgccttctgcgagatgttctctgtggtctacgtgtacggtgtggacaggttcaataaggacatcgagttcatgatcggccacaagcccaacatcttctggcaagtcacgtggcgcgtggtcagccccctgctcatgctgatcatcttcctcttcttcttcgtggtagaggtcagtcaggagctgacctacagcatctgggaccctggctacgaggaatttcccaaatcccagaagatctcctacccgaactgggtgtatgtggtggtggtgattgtggctggagtgccctccctcaccatccctggctatgccatctacaagctcatcaggaaccactgccagaagccaggggaccatcaggggctggtgagcacactgtccacagcctccatgaacggggacctgaagtactga

SEQ ID NO: 60516 - DNA, 5350 bp, Homo sapiens
actgccgtgccggacccccgagccggagccgagcgcgccgaggccggggccatggagaaagcgcggccgctgtgggccaactcgctacagttcgtgttcgcctgcatctcgtacgccgtgggcctgggcaacgtgtggcgattcccgtacctgtgccagatgtacggcggaggtagtttcctggtcccctacatcatcatgcttatcgtggagggaatgccgctcttgtacctggaactggctgtggggcagcgcatgcggcagggcagcatcggcgcctggaggaccatcagcccgtacctcagtggtgtcggggtcgccagcgtggtggtctctttcttcctctccatgtactacaacgtcatcaacgcctgggccttctggtacctcttccactccttccaggatcccctgccgtggtctgtctgcccactgaatggtaaccacacgggctacgatgaggagtgtgagaaggcgtcctccacacagtacttctggtacaggaaaaccctcaatatctcgccgtccctccaggagaacgggggtgtgcagtgggagccggcgctgtgcctcctcctggcctggctggtggtgtacctgtgcatcctgcgtggcaccgagtccactggcaaggtggtgtatttcacggcgtcactgccctattgcgtgctcatcatctacctcatcaggggcctcacgctccacggagccaccaatggcctcatgtacatgttcactcccaagatagagcagctggccaaccccaaggcctggatcaatgcagccacccagatcttcttctcacttggcctgggcttcggcagcctgatcgccttcgccagctacaatgagccatccaacaactgccagaagcacgccatcatcgtgtccctcatcaacagcttcacctccatatttgccagcattgtcaccttctccatctatggcttcaaggccaccttcaattatgaaaactgcttgaagaaggtgagtctgctgctgaccaacacttttgaccttgaagatggctttttgacagccagcaacctggagcaggtgaagggctacctcgcatctgcctacccaagcaaatacagcgagatgttcccgcaaatcaaaaactgcagcttggaatcggagctagacacggccgtccagggcactggcctggcattcatcgtctacacagaggccattaaaaacatggaggtgtcccagctgtggtcggtgctctacttcttcatgctgctgatgctgggcattgggagcatgctggggaacacagcggccatcctcacccctctgacagacagcaagatcatctccagccacctgcccaaggaggccatctcaggtctggtgtgccttgtcaactgtgccattggcatggtgttcacgatggaggctgggaactactggtttgacatattcaacgactacgcggccacactgtccctgctgctcatcgtgctggtggagacgattgccgtgtgctacgtgtacgggctgaggagatttgaaagtgaccttaaggccatgaccggccgagctgtgagctggtactggaaggtgatgtgggctggcgtaagcccactgctgattgtcagcctctttgtcttctacctgagcgactacatcctcacggggaccctgaagtatcaagcctgggacgcctcccagggccagctcgtgaccaaagattacccggcctatgcactggctgtcatcgggctgcttgtggcctcctccaccatgtgcatccccctggcggccctggggacttttgttcagcgtcgcctcaagaggggagacgcagaccccgtggcctgagatgtgggcttcccagccgctcacggttttacagatactatttacaggcggaaactcctcggctgctttttcaaatgcttaagccaggagtgctcagcccatcaacttcctgagtgtctaaagaagatgaggaaggtgtgcaggaagaaaactcccttgggagaacgcacaccctcccgtggtggctgttcctccctgtcacctgcctcctcatcatggaagggggtgggctatgaaagccggtctcaaagataactgcatccttcattccaggaaagccctagaattagggcacattgcaaactgaaatatgactataattcttatgggaccaaatttaagcaatttttgtttttggctgaagagacaccaaaatattagaggacaaatatttttagatccatttaaggagttttgaagtgcctaagatgacctatttgtcagtggtgcaaaattaattctcttcttttttgagttgtagtgaatatgcaatttctgtgttccccttccaccctttaaatcttaggatgacaagttataaagaaagaagatctttgtctgggacccccaaagggatcctttctctaaggtctctgacagtgggtccaggaccagacctctctacaaaaaattgccccaactacagtttgcaaccccaaaccacattagaagtctgtgcagacatccctccgtggtgtgtgtcttggtgcattggaaaaggagtcaggagccactgtgaggtgagaatgaaagtggatctcagctgggcacggtggctcacgcctgtaatcctagcaccttgggggtcaaggtgggtggatcacttgaggtcaggagtttgaggccagcctggccaacatggcgaaaccccatttctactaaaaatacaaaaaaattagctgggagtggtggcataggcctgtaattccagctactctggctgctgaggcacaagaatcatttgaacctaggaggtggcggttgctgtgagccaagatcatgccactccactccagtctgggcgacagagcaagactctgactcaaaaaaaaaaaaaagtggctctgactttcccataggcttaatattacatttggacatcgtggccaactctatcaagaccacaaataccacttacaattaattttaaattattcatctgtacatagttttctaaaatgtatataattcaaacagagcatcttgtaactgaagacacaccatatctatgatatcgcattagtccatgtggggaaaagaaagatcagattgttactgtgtctgtgtagaaaaggaagacataagaaactccattttgatctgtactaagaaaaattgtttctgctttgagatgttgttagcctataactttagccccaactctgtgctcacagaaacatgcgctgtaatgaatcaaagtttaatggatttagggctgtgcaggatgtgccttgttaacaatatgtttgcaggctgtatgcttggtagaagtcatcgccattctccattctcgattaaccagggacacaatgcacagcagaaagctgcagggacctctgcccaagaaagcctgggtattgtccaaggtttcccccccactgagacagcctgagatatggcctcatgggaagggaaagacctgactgtcccccagcccgacacctgtaaagggtcggtgctgaggaggaatagtgaaggagggaggcctctttgcagttgagataagaggaaggcttctgtctcctgcttgtccctggtaatggaatgtctcggtgtaaagctgaccattcccattcgttctattctgagataggagaaaaccgccctgtggctggaggtgagatatgctggcagcaatactgctctgttactccttgctacactgagatgtttgggtaaagagaaacataaatctagcctacgtgcacatctgggcacagtacctttccttgaacttattcgtgatacagattcctttgctcacatgtttccctgctgaccttcttcccacctgttgccctgctacactcccctcgctaagacagtaaaaataatgatcaataaatactgagggaactcagaggccagcgccggtgcgggtcctccacatgctgagcgccggtcctgggcccactgttctttctctatactttgtctctgtgtcttatttcttttctcaaaaaaatttttctttttttaactgcaataaagtaggtcgttacccctaaagtgagcgagtcccttcctgctctaacgtccagtgcttccttgagatcatggaattctggagagtttctgtggatatatttgcacagatatctttgaagacacaaacactcacctgggacgttggccggagatgtctttttatttttgtgctgtaaaattctcttacagcaaaaataggctttagaaaggtcttctactgtcttcagcaaccatctcatcttccagcttcacctgattgtccagttatcatacatttgactttcaaatgtatgaaccagcatgtaccccatggatttaatcttatctaccccgtggattcaatcttcttatcagaaggttcttttatgtcaaaaaacctgctgtcaaggcttgaagagccggcacactcaatggcaaacacagcaccgagtctgctctgaatcctggaggatctggccctcctctcaacccccactcacagtcaccgtcttacaactcagggccacctgggatcagtcatcagtcagggtgcgtaagccttgaataccaggtagcctcaggagtgaaaagataaatgtcctagatcattaccttattcagtgtccccaccttgcagcgcattccaaccacctgggagcatttaaaactccagatgcccacaccacaccctggggccacccatcagaccttctggaagcaagacctgggcctccatggccccaaaaactccctaggtgatccgatgtgcagccaaatctgagaggccccatttaaaaaagaaagaacatgggtggtacattgaggagtatttacattttataaaatgacttaaaaatttgaaggcatttttgagcatttccaattatatggaagagttacttctacggaatagtttttgctcatggaactcaaacagatgaagcaccactgttacagaataatgtgctccagatgaaaatgtctcgtttctgtgaatttcatgaagagcagaacatttctcaagaatcctcttgagccagtaatcaatcctgtctcaaaaaatgttctttgccatttcctagatactgcacaaaagtggccatgtcgacatttgtccacccaccctccaataagctggagcgacaaagggacattccatccctgtacccttagtggtagccatgacacgatggccagatcatggactccggaaagctttctgtttttactggaaacatagcaaaccttgatttagctccaagaaattgagtagggaaatatttgttttttagcaattgtcatagtaaataaaactctaagcaagtgtgtgtac

SEQ ID NO: 60517 - DNA, 5239 bp, Homo sapiens
actgccgtgccggacccccgagccggagccgagcgcgccgaggccggggccatggagaaagcgcggccgctgtgggccaactcgctacagttcgtgttcgcctgcatctcgtacgccgtgggcctgggcaacgtgtggcgattcccgtacctgtgccagatgtacggcggaggtagtttcctggtcccctacatcatcatgcttatcgtggagggaatgccgctcttgtacctggaactggctgtggggcagcgcatgcggcagggcagcatcggcgcctggaggaccatcagcccgtacctcagtggtgtcggggtcgccagcgtggtggtctctttcttcctctccatgtactacaacgtcatcaacgcctgggccttctggtacctcttccactccttccaggatcccctgccgtggtctgtctgcccactgaatggtaaccacacgggctacgatgaggagtgtgagaaggcgtcctccacacagtacttctggtacaggaaaaccctcaatatctcgccgtccctccaggagaacgggggtgtgcagtgggagccggcgctgtgcctcctcctggcctggctggtggtgtacctgtgcatcctgcgtggcaccgagtccactggcaagatagagcagctggccaaccccaaggcctggatcaatgcagccacccagatcttcttctcacttggcctgggcttcggcagcctgatcgccttcgccagctacaatgagccatccaacaactgccagaagcacgccatcatcgtgtccctcatcaacagcttcacctccatatttgccagcattgtcaccttctccatctatggcttcaaggccaccttcaattatgaaaactgcttgaagaaggtgagtctgctgctgaccaacacttttgaccttgaagatggctttttgacagccagcaacctggagcaggtgaagggctacctcgcatctgcctacccaagcaaatacagcgagatgttcccgcaaatcaaaaactgcagcttggaatcggagctagacacggccgtccagggcactggcctggcattcatcgtctacacagaggccattaaaaacatggaggtgtcccagctgtggtcggtgctctacttcttcatgctgctgatgctgggcattgggagcatgctggggaacacagcggccatcctcacccctctgacagacagcaagatcatctccagccacctgcccaaggaggccatctcaggtctggtgtgccttgtcaactgtgccattggcatggtgttcacgatggaggctgggaactactggtttgacatattcaacgactacgcggccacactgtccctgctgctcatcgtgctggtggagacgattgccgtgtgctacgtgtacgggctgaggagatttgaaagtgaccttaaggccatgaccggccgagctgtgagctggtactggaaggtgatgtgggctggcgtaagcccactgctgattgtcagcctctttgtcttctacctgagcgactacatcctcacggggaccctgaagtatcaagcctgggacgcctcccagggccagctcgtgaccaaagattacccggcctatgcactggctgtcatcgggctgcttgtggcctcctccaccatgtgcatccccctggcggccctggggacttttgttcagcgtcgcctcaagaggggagacgcagaccccgtggcctgagatgtgggcttcccagccgctcacggttttacagatactatttacaggcggaaactcctcggctgctttttcaaatgcttaagccaggagtgctcagcccatcaacttcctgagtgtctaaagaagatgaggaaggtgtgcaggaagaaaactcccttgggagaacgcacaccctcccgtggtggctgttcctccctgtcacctgcctcctcatcatggaagggggtgggctatgaaagccggtctcaaagataactgcatccttcattccaggaaagccctagaattagggcacattgcaaactgaaatatgactataattcttatgggaccaaatttaagcaatttttgtttttggctgaagagacaccaaaatattagaggacaaatatttttagatccatttaaggagttttgaagtgcctaagatgacctatttgtcagtggtgcaaaattaattctcttcttttttgagttgtagtgaatatgcaatttctgtgttccccttccaccctttaaatcttaggatgacaagttataaagaaagaagatctttgtctgggacccccaaagggatcctttctctaaggtctctgacagtgggtccaggaccagacctctctacaaaaaattgccccaactacagtttgcaaccccaaaccacattagaagtctgtgcagacatccctccgtggtgtgtgtcttggtgcattggaaaaggagtcaggagccactgtgaggtgagaatgaaagtggatctcagctgggcacggtggctcacgcctgtaatcctagcaccttgggggtcaaggtgggtggatcacttgaggtcaggagtttgaggccagcctggccaacatggcgaaaccccatttctactaaaaatacaaaaaaattagctgggagtggtggcataggcctgtaattccagctactctggctgctgaggcacaagaatcatttgaacctaggaggtggcggttgctgtgagccaagatcatgccactccactccagtctgggcgacagagcaagactctgactcaaaaaaaaaaaaaagtggctctgactttcccataggcttaatattacatttggacatcgtggccaactctatcaagaccacaaataccacttacaattaattttaaattattcatctgtacatagttttctaaaatgtatataattcaaacagagcatcttgtaactgaagacacaccatatctatgatatcgcattagtccatgtggggaaaagaaagatcagattgttactgtgtctgtgtagaaaaggaagacataagaaactccattttgatctgtactaagaaaaattgtttctgctttgagatgttgttagcctataactttagccccaactctgtgctcacagaaacatgcgctgtaatgaatcaaagtttaatggatttagggctgtgcaggatgtgccttgttaacaatatgtttgcaggctgtatgcttggtagaagtcatcgccattctccattctcgattaaccagggacacaatgcacagcagaaagctgcagggacctctgcccaagaaagcctgggtattgtccaaggtttcccccccactgagacagcctgagatatggcctcatgggaagggaaagacctgactgtcccccagcccgacacctgtaaagggtcggtgctgaggaggaatagtgaaggagggaggcctctttgcagttgagataagaggaaggcttctgtctcctgcttgtccctggtaatggaatgtctcggtgtaaagctgaccattcccattcgttctattctgagataggagaaaaccgccctgtggctggaggtgagatatgctggcagcaatactgctctgttactccttgctacactgagatgtttgggtaaagagaaacataaatctagcctacgtgcacatctgggcacagtacctttccttgaacttattcgtgatacagattcctttgctcacatgtttccctgctgaccttcttcccacctgttgccctgctacactcccctcgctaagacagtaaaaataatgatcaataaatactgagggaactcagaggccagcgccggtgcgggtcctccacatgctgagcgccggtcctgggcccactgttctttctctatactttgtctctgtgtcttatttcttttctcaaaaaaatttttctttttttaactgcaataaagtaggtcgttacccctaaagtgagcgagtcccttcctgctctaacgtccagtgcttccttgagatcatggaattctggagagtttctgtggatatatttgcacagatatctttgaagacacaaacactcacctgggacgttggccggagatgtctttttatttttgtgctgtaaaattctcttacagcaaaaataggctttagaaaggtcttctactgtcttcagcaaccatctcatcttccagcttcacctgattgtccagttatcatacatttgactttcaaatgtatgaaccagcatgtaccccatggatttaatcttatctaccccgtggattcaatcttcttatcagaaggttcttttatgtcaaaaaacctgctgtcaaggcttgaagagccggcacactcaatggcaaacacagcaccgagtctgctctgaatcctggaggatctggccctcctctcaacccccactcacagtcaccgtcttacaactcagggccacctgggatcagtcatcagtcagggtgcgtaagccttgaataccaggtagcctcaggagtgaaaagataaatgtcctagatcattaccttattcagtgtccccaccttgcagcgcattccaaccacctgggagcatttaaaactccagatgcccacaccacaccctggggccacccatcagaccttctggaagcaagacctgggcctccatggccccaaaaactccctaggtgatccgatgtgcagccaaatctgagaggccccatttaaaaaagaaagaacatgggtggtacattgaggagtatttacattttataaaatgacttaaaaatttgaaggcatttttgagcatttccaattatatggaagagttacttctacggaatagtttttgctcatggaactcaaacagatgaagcaccactgttacagaataatgtgctccagatgaaaatgtctcgtttctgtgaatttcatgaagagcagaacatttctcaagaatcctcttgagccagtaatcaatcctgtctcaaaaaatgttctttgccatttcctagatactgcacaaaagtggccatgtcgacatttgtccacccaccctccaataagctggagcgacaaagggacattccatccctgtacccttagtggtagccatgacacgatggccagatcatggactccggaaagctttctgtttttactggaaacatagcaaaccttgatttagctccaagaaattgagtagggaaatatttgttttttagcaattgtcatagtaaataaaactctaagcaagtgtgtgtac

SEQ ID NO: 60518 - DNA, 1790 bp, Homo sapiens
ccatttctagggttggaccgagcaggcacgggcggtcagctgggccgcagctcctccggctctgcagggtcacggaggaagccagctcccctagtccaggccgagcttgcacttgcgtcttgtctgctgctgctgaaccaagatttagctgtgcgccctccttgcagtctcctggaaccagcaggaggaaacatgggggatactggcctgagaaagcggagagaggatgagaagtcgatccagagccaagagcctaagaccaccagtctccaaaaggagctgggcctcatcagtggcatctccatcatcgtgggcaccatcattggctctgggatcttcgtttcccccaagtctgtgctcagcaacacggaagctgtggggccctgcctcatcatatgggcggcttgcggggtcctcgcgacgctgggtgccctgtgctttgcggagcttggcacaatgatcaccaagtcagggggagagtatccctacctgatggaggcctacgggcccatccccgcctacctcttctcctgggccagcctgatcgtcattaagcccacgtccttcgccatcatctgcctcagcttctccgagtatgtgtgtgcgcccttctatgtgggctgcaagcctcctcaaatcgttgtgaaatgcctggccgccgccgccatcttgttcatctcgacagtgaactcactgagcgtgcggctgggaagctacgtccagaacatcttcaccgcggccaagctggtgatcgtggccatcatcatcatcagcgggctggtgctcctggcccaaggaaacacaaagaattttgataattctttcgagggcgcccagctgtctgtgggagccatcagcctggcgttttacaatggactctgggcctatgatggatggaatcaactcaattacatcacagaagaacttagaaacccttacagaaacctgcctttggccattatcatcgggatccccctggtgacggcgtgctacatcctcatgaacgtgtcctacttcaccgtgatgactgccaccgaactcctgcagtcccaggcggtggctgtgacatttggtgaccgtgttctctatcctgcttcttggatcgttccactttttgtggcattttcaaccatcggtgctgctaacgggacctgcttcacagcgggcagactcatttacgtggcgggccgggagggtcacatgctcaaagtgctttcttacatcagcgtcaggcgcctcactccagcccccgccatcatcttttatggtatcatagcaacgatttatatcatccctggtgacataaactcgttagtcaattatttcagctttgccgcatggctgttttatggcctgacgattctaggactcatcgtgatgagatttacaaggaaagagctggaaaggcctatcaaggtgcccgtagtcattcccgtcttgatgacactcatctctgtgtttttggttctggctccaatcatcagcaagcccacctgggagtacctctactgtgtgctgtttatattaagcggccttttattttacttcctgtttgtccactacaagtttggatgggctcagaaaatctcaaagccgattaccatgcaccttcagatgctaatggaagtggtcccaccggaggaagaccctgagtaacaagctccgtctcttgtagccaagtcagctgaatttattttcttaagcaatatttgtggttatttcttcctttttttcttacgaataaaatatactcagatgttaaaaaaaaaaaaaaaaaaaaaaaaaaaaaa

SEQ ID NO: 60519 - DNA, 386 bp, Homo sapiens
ccaggatcagcatggccgtccgccagtgggtaatcgccctggccttggctgccctccttgttgtggacagggaagtgccagtggcagcaggaaagctccctttctcaagaatgcccatctgtgaacacatggtagagtctccaacctgttcccagatgtccaacctggtctgcggcactgatgggctcacatatacgaatgaatgccagctctgcttggcccggataaaaaccaaacaggacatccagatcatgaaagatggcaaatgctgatcccacaggagcacctcaagccatgaagtgtcagctggagaacagtggtgggcatggagaggatatgacatgaaataaaagatccagcccaactgaaaaaaaaaaaaaaaaaaa

SEQ ID NO: 60520 - DNA, 2437 bp, Homo sapiens
tcggatccactagtaacggccgccagtgtgctggaattcgcggccggtcgacccaccaccatgaggtcctgcctgtggagatgcaggcacctgagccaaggcgtccagtggtccttgcttctggctgtcctggtcttctttctcttcgccttgccctcttttattaaggagcctcaaacaaagccttccaggcatcaacgcacagagaacattaaagaaaggtctctacagtccctggcaaagcctaagtcccaggcacccacaagggcaaggaggacaaccatctatgcagagccagtgccagagaacaatgccctcaacacacaaacccagcccaaggcccacaccaccggagacagaggaaaggaggccaaccaggcaccgccggaggagcaggacaaggtgccccacacagcacagagggcagcatggaagagcccagaaaaagagaaaaccatggtgaacacactgtcacccagagggcaagatgcagggatggcctctggcaggacagaggcacaatcatggaagagccaggacacaaagacgacccaaggaaatgggggccagaccaggaagctgacggcctccaggacggtgtcagagaagcaccagggcaaagcggcaaccacagccaagacgctcattcccaaaagtcagcacagaatgctggctcccacaggagcagtgtcaacaaggacgagacagaaaggagtgaccacagcagtcatcccacctaaggagaagaaacctcaggccaccccaccccctgcccctttccagagccccacgacgcagagaaaccaaagactgaaggccgccaacttcaaatctgagcctcggtgggattttgaggaaaaatacagcttcgaaataggaggccttcagacgacttgccctgactctgtgaagatcaaagcctccaagtcgctgtggctccagaaactctttctgcccaacctcactctcttcctggactccagacacttcaaccagagtgagtgggaccgcctggaacactttgcaccaccctttggcttcatggagctcaactactccttggtgcagaaggtcgtgacacgcttccctccagtgccccagcagcagctgctcctggccagcctccccgctgggagcctccggtgcatcacctgtgccgtggtgggcaacgggggcatcctgaacaactcccacatgggccaggagatagacagtcacgactacgtgttccgattgagcggagctctcattaaaggctacgaacaggatgtggggactcggacatccttctacggctttaccgccttctccctgacccagtcactccttatattgggcaatcggggtttcaagaacgtgcctcttgggaaggacgtccgctacttgcacttcctggaaggcacccgggactatgagtggctggaagcactgcttatgaatcagacggtgatgtcaaaaaaccttttctggttcaggcacagaccccaggaagcttttcgggaagccctgcacatggacaggtacctgttgctgcacccagactttctccgatacatgaagaacaggtttctgaggtctaagaccctggatggtgcccactggaggatataccgccccaccactggggccctcctgctgctcactgcccttcagctctgtgaccaggtgagtgcttatggcttcatcactgagggccatgagcgcttttctgatcactactatgatacatcatggaagcggctgatcttttacataaaccatgacttcaagctggagagagaagtctggaagcggctacacgatgaagggataatccggctgtaccagcgtcctggtcccggaactgccaaagccaagaactgaccggggccagggctgccatggtctccttgcctgctccaaggcacaggatacagtgggaatcttgagactctttggccatttcccatggctcagactaagctccaagcccttcaggagttccaagggaacacttgaaccatggacaagactctctcaagatggcaaatggctaattgaggttctgaagttcttcagtacattgctgtaggtcctgaggccagggatttttaattaaatggggtgatgggtggccaataccacaattcctgctgaaaaacactcttccagtccaaaagcttcttgatacagaaaaaagagcctggatttacagaaacatatagatctggtttgaattccaggatcgagtttacagttgtgaaatcttgaaggtattacttaacttcactacagattgtctagaagacctttctaggagttatctgattctagaagggtctatacttgtccttgtctttaagctatttgacaactctacgtgttgtagaamactgataataatacaaatgattgttgtccatggaaaggcaaataaattttctacagtgaaaaaaaa

SEQ ID NO: 60521 - DNA, 1558 bp, Homo sapiens
cacgaggggtgaccaccccttccagcaggcaggttcccagccccagccaagcagtgtttctccaggagccggacagcctctctgtctccatggcagccttcctatctgctggcctcggcatacttgcaccctcagagacctaccccctacctacaaccagctctggctgggagccccggctggggtcaccattcccatcaggcccttgcaccagctctactggggcccaagctgtggccgagcccactgggcagggccccaagaacccacgtgtgtccagagtgacagttcagctggagatgaagcctctgtgggaggaattcaaccagctgggcactgagatgatcgtcaccaaggcaggcaggaggatgttcccccccttccaggtgaagatcctgggcatggactccctggccgactacgccctgctcatggacttcatccccctggacgacaagagatacaggtatgccttccacagctcggcctggctggtggcgggcaaggcagacccagccacacctggccgcgtgcacttccaccccgactcgccagccaagggtgcccagtggatgcgccagattgtgtcctttgacaagctcaagctgaccaacaacctgctggatgacaatggccacatcattctcaactctatgcaccgctaccagccccgtttccacgtggtcttcgtggacccacgcaaggacagtgagcgctatgcccaggagaacttcaagtccttcatcttcacagagacccagttcacagcagtgacagcctatcagaaccacaggatcacccagctgaaaatcgccagcaacccttttgccaaaggctttagagagagtgacctggactcctggcctgtggccccacggcccctgctcagtgtcccagcccggagtcacagcagcctcagtccctgtgtgctgaagggtgccacagacagggagaaagaccccaacaaagcttcagcttccacctccaagacccctgcttggctccatcatcagctgctgcccccacctgaggtcctgctggccccggccacctacaggcctgtcacgtatcagagcctgtactctggagccccgagccacctagggatcccaaggacccgaccagcaccataccccctccccaacatccgggctgatagggatcaaggaggcctgcctctcccagctgggctggggctcctgtcccccactgtggtgtgcctggggcctggccaggactcccagtgatgccagaagccctggggggaagccctgctaccctggaccttacaccgggtgtgggaatcagcctctgccccgccccctccagccccatctctgtctcaaggagagcagggtaggtgaaagtctagagaaagaggctacctgcccagggtcacagcaaggctgggaccatggcaagcttggaaccaggacttctacctcccaaccccagcagcctgaatactgtgccctcttgctttgggggtaactcccgaaaaccctgccttacctctcccttccccctaacattaaactatttggcatgaaaaaaaaaa

SEQ ID NO: 60522 - DNA, 2308 bp, Homo sapiens
aagccactttgacaacgtttctgagccaggggtgaccatgacctgctgcgaaggatggacatcctgcaatggattcagcctgctggttctactgctgttaggagtagttctcaatgtgatacctctaattgtcagcttagttgaggaagaccaattttctcaaaaccccatctcttgctttgagtggtggttcccaggaattataggagcaggtctgatggccattccagcaacaacaatgtccttgacagcaagaaaaagagcgtgctgcaacaacagaactggaatgtttctttcatcacttttcagtgtgatcacagtcattggtgctctgtattgcatgctgatatccatccaggctctcttaaaaggtcctctcatgtgtaattctccaagcaacagtaatgccaattgtgaattttcattgaaaaacatcagtgacattcatccagaatccttcaacttgcagtggtttttcaatgactcttgtgcacctcctactggtttcaataaacccaccagtaacgacaccatggcgagtggctggagagcatctagtttccacttcgattctgaagaaaacaaacataggcttatccacttctcagtatttttaggtctattgcttgttggaattctggaggtcctgtttgggctcagtcagatagtcatcggtttccttggctgtctgtgtggagtctctaagcgaagaagtcaaattgtgtagtttaatgggaataaaatgtaagtatcagtagtttgaattaatttgagaagtacacttgttttcaaagtcatctttgagatgatttaaaaaatcaacccttcacgtagaaagcacgttgtaaatgcataacactctcatatcagtggttgatttgggaaaggtggagagaattttcaattagttttgtgttgtactattcaaattttttacctcttcactgtgtgtagagaaaggagaagggaaggaggatgagaaggaacggaagtcatcctgaaaataaaagtacaggactttttttttttttttttgagacagggtctcaaaaaaggctggagtacagtagtacagtggtgctatctcagcttactgcagcctcaacctcctgggctcaggtgattctcccatctcagcctccctagtagctgggactacaggtgcgtgccactatgccaagctaatttttgtatttttagtagagatgggggttttccatattgcccaggctggtcccgaactcatggactcaagtgatctgcctgcctcagcctcctaaagtgctgcgattacaggcatgagccatcgcgcctaaaggacaggacctttttattgtatttctttaaagaataaatacataacctgaatgcaatcaagtctttagatctaattctcagcttgcagggaacactaggacaaatccaaaaagtgggtcagcgggcacagaatggcccaattttcaacaggaaaatgttataaaagaaaaatatttttgagggaactgttatagattaagagaatagaggcatgtttcagctaaacacatgtaaactttgtcagagataattgggaggagtatgtagaagaatcggattattgttaattttggtaggtctgataatggttttatagtataaaggctgagtaccccttatccaaaatgattaagatcagaagtgttttggctttcacatttttttggattttggaattttgcctataataatgagacatcttggggatgggatgcaagtctaaccacaaaattcatttatgtctcatacacactttgaacacctggcctgaaggtaatttcacacaatattttaaataactttgtgcatgaaacacaattttgactgcattttgactgcaactcatcacatgaggtcaggtatggaattttccacttgtggtgttacgttactggctcaaaaagttttggatctcggagcattctggattttgaatttttggattagtgatgctcaacctgtatacagaaatgtcctcatttttaaaaaaagaaatgcatatttatatgttttaaaattacttcaaccaaaagcaacggggagatgtttactgttatatttaggtgacaggtacatggcaattcattataccctcctattttcctatgtttacattattcattaattaaaaaacaatacctagaaaaacccaagactttcaaaagctattttctatatgtgccaatctttaaaaaacaggataacaagggtatttatcacattaaaatgttgtaaaacagcaaagctaaaatctaaaaaaaaaaaaaaaaaa

SEQ ID NO: 60523 - DNA, 1360 bp, Homo sapiens
gcgccctggagaacgcgtcggggctgagccggggtccagcagccgccgctatggacatcccgccgctggccggcaagatcgcggcgctgtcgctgagcgccctcccggtgtcctacgcgctcaaccacgtctcggcgctctcgcaccccctgtgggtggcattgatgagcgccctaatcctgggtctgcttttcgtggcggtctacagcttgtcccatggcgaggtctcctatgacccactctatgctgtcttcgctgtcttcgccttcacctcggttgtggacctcatcatcgctcttcaggaagacagctatgtggtgggcttcatggagttctacaccaaggagggagagccatacctgcgcacagcgcacggagtcttcatctgctactgggatggcactgttcactacctcctctacctggccatggccggcgccatctgcagaaggaagagataccggaattttggactctactggctgggttccttcgccatgagcatcctggtgttccttacaggaaacattcttggcaaatacagctccgagatcaggcctgccttcttcctcaccatcccctacctgctggtgccatgctgggctggcatgaaggtcttcagccagccccgggcgctaacccgctgcaccgccaacatggtgcaagaggaacaaagaaagggactcctgcagcgtccggctgacctggcccttgtcatatatctcatccttgctggcttcttcactctgttccggggcctggtggtgcttgattgccccacagatgcctgctttgtctatatctaccagtatgagccatacctgcgggaccctgtggcctaccctaaggtgcagatgctgatgtacatgttttatgtcctgcctttctgcggcctggctgcctatgctctcaccttccctggttgctcctggcttccagactgggccttggtgtttgctggaggcatcggccaggcacagttctcgcacatgggggcttccatgcacctgcgcacacccttcacctaccgttgccttcagtggcccgcattcttccaccagccaccaccctccgaccccctagccctccacaagaagcagcattgagagagctgtggactcaggacccaggactctgtttacgtgcccagtcagccctacctggggaagcgggggttgggtgttttagagacaggagggacatctccgggtgtctttagtcttggctatggtagtttcagctgtcaccatgctccaactcccacacaaacgcttctaccccttccagaacttacccatcatccccccatggatcctttcagtaaaaaccctttcaatttccaaaaaaaaaaaaaaaaaaa

SEQ ID NO: 60524 - DNA, 1841 bp, Homo sapiens
gcgccctggagaacgcgtcggggctgagccggggtccagcagccgccgctatggacatcccgccgctggccggcaagatcgcggcgctgtcgctgagcgccctcccggtgtcctacgcgctcaaccacgtctcggcgctctcgcaccccctgtgggtggcattgatgagcgccctaatcctgggtctgcttttcgtggcggtctacagcttgtcccatggcgaggtctcctatgacccactctatgctgtcttcgctgtcttcgccttcacctcggttgtggacctcatcatcgctcttcaggaagacagctatgtggtgggcttcatggagttctacaccaaggaggtacttgggggacgaccagggagccccctaccgcactgcccgtctgagtctcccacctgcccccacagggagagccatacctgcgcacagcgcacggagtcttcatctgctactgggatggcactgttcactacctcctctacctggccatggccggcgccatctgcagaaggtgcaggaggcagggagagggtggcccctgaccctgggagagaagttgcatcctcagatggggtcccagggcagggtggagccagaagtgtctgtaggagaaatcaggacgcctctctagggctccagccaggggtggccaggagaaggttccagggaacgtctcaggtgtaggtggtggcctagcattgcttacatccaccctgtgcctgggcagccacttctgttcttggacagagggtctcactgttatttccccgttcaactccctgttgtcccttccatcctgggcaaaactgaaagggacccggagctgggaaacccacggtggtctccaggccctggctggggctctgagattacggagtgactacctgctggtcacccctccatcccctgctcaggaagagataccggaattttggactctactggctgggttccttcgccatgagcatcctggtgttccttacaggaaacattcttggtgcaagaggaacaaagaaagggactcctgcagcgtccggctgacctggcccttgtcatatatctcatccttgctggcttcttcactctgttccggggcctggtggtgcttgattgccccacagatgcctgctttgtctatatctaccagtatgagccatacctgcgggaccctgtggcctaccctaaggtgcagatgctgatgtacatgttttatgtcctgcctttctgcggcctggctgcctatgctctcaccttccctggttgctcctggcttccagactgggccttggtgtttgctggaggcatcggccaggcacagttctcgcacatgggggcttccatgcacctgcgcacacccttcacctaccgtgtgcctgaggacacctggggctgcttcttcgtgtgcaatctgctgtatgcgctgggcccccacctgctggcctaccgttgccttcagtggcccgcattcttccaccagccaccaccctccgaccccctagccctccacaagaagcagcattgagagagctgtggactcaggacccaggactctgtttacgtgcccagtcagccctacctggggaagcgggggttgggtgttttagagacaggagggacatctccgggtgtctttagtcttggctatggtagtttcagtccagtgggtgggatggagaccaacgaccaagtgttcctgcaaggagagcctcccacagctgtcaccatgctccaactcccacacaaacgcttctaccccttccagaacttacccatcatccccccatggatcctttcagtaaaaaccctttcaatttccaaaataaaaaaaaaaaa

SEQ ID NO: 60525 - DNA, 2396 bp, Homo sapiens
agcccaggcgctgctgctggcgccagacggcaccggccgctggtagagcgcgtgccgcgagatgcggcctcaggacagcaccggggtcgcggagctccaggagcccgggctgccgctaacggacgatgcacccccgggcgccactgaggagccggcggccgccgaggcagctggggcgccagaccgcggtaggtgctggctctgcctttcctcgccgtgttgctcccgcaccgagccggccaagaagaaagcaccctgtcctggacttggcttgttttacacattattgtctgccttccttttctcagtgggctctttatttgttaaaaaagtgcaagacgtccatgctgtagagattagtgcgtttcgatgtgtgttccaaatgctagttgttatcccttgcttaatatacagaaaaactgggtttataggcccaaaaggtcaacgaattttcctcattctcagaggagtccttggttctaccgccatgatgcttatatactatgcttaccagacaatgtccctcgctgatgccacagttatcacgtttagcagtccagtgtttacgtccatatttgcttggatatgtctcaaggaaaaatatagcccttgggatgctcttttcaccgtgttcacaatcactggagtgatccttatcgtgagaccaccatttttgtttggttccgacacttcggggatggaagaaagctattcaggccaccttaagggaacattcgcagcaattggaagtgccgtatttgctgcatcgactctagttatcctaagaaaaatgggaaaatctgtggactactttctgagcatttggtattatgtagtacttggcctcgttgaaagtgtcatcatcctctctgtattaggagagtggagtctgccttactgtgggttggacaggctatttctcatattcattgggctctttggtttggggggtcagatatttatcacaaaagcacttcaaatagaaaaagcagggccagtagcaataatgaagacaatggatgtggtctttgcttttatctttcagattattttctttaataatgtgccaacgtggtggacagtgggtggtgctctctgcgtagtagccagtaatgttggagcggccattcgtaaatggtaccaaagttccaaatgaagcatcattgctgaaatacatatttttttcaagtacaccatcacctaattcacatacagcatacgcacacatctggaaaatctgcattttcttcattggttgtatttaataaattgcctaaagtaccatttttgaatatagtatgtctttagttaagaatagctagtctgtttggtgtaacaattttttggtagctttggttttggttttggtttttttgttgttgttggggtcaagttggtgagaggagagctcattgtttgaagaaaaaccaaaacattttatggctagtaatattatatgtaatttttaaaatgtatttttggtactgatgggatatgggtggggaggctattttagatattcttttagcagtgtagagcctaagaaacttggttctactaccatgatctttataaactatgccttccagacaattgataatgctgctataattagtattatgttgataattcatttgcaaccttattctatttaggaggatgaagttgaagcttagaataggtgcctgcttaatggtgttaataatacaaatgaattggccttattttcaaggattttataaatgattatcatacttgtaactcatatttgtgccttttcattttaatgctggaatttttattatgtcacctctaaaacacttaaattgccaaatttggctagtagttttgtttcagtggcattagcaactgcagctagcatactataattttaattgtcctcacttttttttgaaactgcactaaatttttcttaacattccaagatttcagatctctaaatcacaaagagaaatcttggcatgaccagtgtgcacgtttccatcctgaagtgttttctcttcactagaaatgtgattttctataaattccccttgaatttatagtgtgatgccaaataaaattttctcaggatcttattaggttgaaccatatgtaattgccaagattttactattttaacttagaaaaaccatcgtttcatatgattcaccctaatagatacctccattattctctaaatgaaatagaagactttggagtatatgtttttaaagtaattttttaaaatatggtaatgtattaaacttatttttatagttatgaaattatgtgtaataacgctttatgttatacattaaatgtaaagacttgtgaatccatgtttgattgactttcatagtttcctgcattgaaataaaatcactatgaattct

SEQ ID NO: 60526 - DNA, 1124 bp, Homo sapiens
ccatggcccttggggcctgtggcctcctgctgctcctggctgtgcccggtgtgtccctcaggactttgcagccagggtgtggccggccgcaggtttcggatgcaggcggccggatcgtggggggtcacgctgccccggccggcgcatggccatggcaggccagcctccgcctgcggaggatgcacgtgtgcggcgggtcactgctcagcccccagtgggtgctcacagctgcccactgcttctccgggtccctgaactcatccgactaccaggtgcacctgggggaactggagatcactttgtctccccacttctccaccgtgaggcagatcatcctgcactccagcccctcaggacagccggggaccagcggggacatcgccctggtggagctcagtgtccccgtgaccctctccagccggatcctgcccgtctgcctcccggaggcctcagatgacttctgccctgggatccggtgctgggtgaccggctggggctatacgcgggagggagagcctctgccacccccgtacagcctgcgggaggtgaaagtctccgtggtggacacagagacctgccgccgggactatcccggccccgggggcagcatccttcagcccgacatgctgtgtgcccggggccccggggatgcctgccaggacgactccggggggcctctggtctgccaggtgaacggtgcctgggtgcaggctggcattgtgagctggggtgagggctgcggccgccccaacaggccgggagtctacactcgtgtccctgcctacgtgaactggatccgccgccacatcacagcatcagggggctcagagtctgggtaccccaggctccccctcctggctggcttcttcctccccggcctcttccttctgctagtctcctgtgtcctgctggccaagtgcctgctgcacccatctgcggatggtactcccttccccgcccctgactgatggcaggaatccaagtgcatttcttaaataagttactatttattccgctccgccccctccctctcccttgagaagctgagtcttctgcatcagattattgcaacatttaacctgaatttaaaagcacacgaaacaaaaaaaaaaaaaaaaaaaaaa

SEQ ID NO: 60527 - DNA, 6470 bp, Homo sapiens
cgcagaaccgaggtcgccgagtgatgatgttgtgaagtcgcccgcctgtccctgccacgcccgggcggttgctggcagtgggagcagcggcagcagcttcggctgctgctttcaggctgccgctgcattaggggcttcctgaggaaacgcgggcggacgacagaggatgccgaaccactccagtcatgactgtccaaagtatgataatcacatgagagtgctcgttgctacggatgtcatttgactcatcagagaaaatctgtctaaaagaaaatatccatgtgaccaaatccatttcattattgaatggcttgatggatttcctttactctgattcataccaaagctgtccttctcaaccaaagcaagaaaggatcctgcatgagtcaatcccagaatgcaatttttacatcaccaacaggtgaagaaaacctcatgaatagcaatcacagagactcggagagcatcactgatgtctgctccaatgaggatctccctgaagttgagctggtgagtctgctagaagaacaactaccacagtataggctaaaagtagacactctctttctatatgaaaatcaagactggactcagtctccacaccagcggcagcatgcatctgatgctctctctccagtccttgctgaagagactttccgttacatgattctaggcacagacagggtggagcagatgaccaaaacttacaatgacatcgacatggttacacatctcctggcagagagggatcgtgatctggaactcgctgctcgaattggacaagctctcttaaagcggaaccatatcttatctgagcagaacgaatccctggaggagcaattgggacaagcctttgatcaagttaatcagctgcagcatgagctatgcaagaaagatgagttacttcgaatcgtctccattgcttctgaagaaagtgaaactgattccagctgttctacacctcttcggttcaatgagtcctttagcttatctcaagggttgctgcagttggaaatgctgcaagaaaagctcaaggaactggaagaagagaatatggctcttcgatccaaggcttgtcacataaagacagaaactgttacctatgaagaaaaggaacaacagcttgtcagcgactgtgttaaagaacttcgtgaaacaaatgctcagatgtccagaatgactgaagaattgtcagggaagagtgatgagctgattcgataccaagaagagctttcctctcttttgtcacagattgtagaccttcagcataaacttaaagaacatgtgattgagaaggaagaactaaaacttcacctgcaagcttccaaagatgcccaacggcaactgacaatggagctgcacgagttacaagacaggaatatggagtgtctaggaatgttacatgaatcccaagaagaaataaaggaacttcgtagtagatctggccctactgctcatctctacttctcccaatcatatggagcttttactggggaatctttggcagctgagattgaggggactatgcgtaaaaagctgagtttggatgaggaatcttctctctttaaacaaaaagcccaacagaagcgggtatttgataccgtcaggattgccaatgacacacggggccgctctatctcattcccagctctgttacccattccaggctccaaccgttcaagtgtcatcatgacagcaaaaccttttgagtctggtcttcagcaaacagaggacaaatcactcctgaaccaggggagcagctcagaggaggttgcagggagctcccagaagatgggccaaccaggaccctcaggagatagtgatttggctacagcactgcatcgccttagcttgcgtcgacaaaactatttaagtgagaagcagttctttgctgaagaatggcagcggaagatccaggttctggcagaccagaaggaaggagttagtggctgtgtcaccccgacagagagccttgcctctctctgcaccacccagtcagagatcacagacctcagcagtgccagttgccttcgaggttttatgccagaaaaattacaaattgtcaagccccttgaaggatcacaaactctgtatcactggcagcagcttgctcaaccaaacttgggaaccatccttgatccacgaccaggtgtcattactaaaggctttacccagttgcccggggatgctatttatcacatctcagatttagaagaggatgaagaggagggtattacttttcaggttcagcaacctcttgaagtggaagagaaactttcaacatccaagccagtaacagggatcttcctgccacccattacttcagcaggtggaccagttacagttgcaaccgccaacccaggaaagtgcctgtcgtgcacaaactcaacattcactttcaccacctgtagaatattacatccctctgacatcactcaggttacccccagctctgggttcccttcattatcctgtggaagtagcggtagcagttcatccaacacggctgtgaattctcctgccttgtcctatagactcagcattggtgagtccatcaccaaccgacgagattccactacaaccttcagtagcaccatgagcttggccaaacttctacaagagcgaggcatctctgccaaagtgtaccacagcccaatttcagagaaccccctccagcctctccctaaatccctggctatcccttccacaccaccaaattcaccatctcactcaccttgcccttctcctttaccctttgagcctcgagtgcatctctctgaaaattttttggcctctcgaccagctgagacattcctccaggagatgtatggcttgagaccctcccggaaccctcctgatgttggccagttgaagatgaacttagtggacaggctgaagagactggggatagccagagtggtcaagaaccctggtgcccaagagaatggaagatgccaggaggcagaaattggtcctcaaaaaccagattctgctgtttatttaaattcaggtagcagtttattaggtggactaaggaggaatcagagtcttccagtcataatgggtagctttgctgccccagtttgcacatcctcacccaaaatgggtgtcctgaaggaggactgaggttcagcagttaactgaccttttatacaagttagcacatgaaggatagatatgcactgaaacatgtggtctggtctgacttgagagaaaaggaatgttgcacaagggttgtgaatgtgaaagggggaatggaggaatggaaataaaattgggatgagccctaatggaggaagtcgggcaaattgaaagtataaatgaatgggccatgagtgttcagagggagaaaagaaaggtttaatatactccttcagttgagttttcttgtcttgaacataaaaagtgaatacaaataaattcagtaatactaaaacatacagagatactgaacttgctggcacatttacttctggtaagcataaagcagagagaacccaggttagaaggatgggaagagaaaaggagcagttttattgcttatagaaagccgttctgaggggttggtggggtaagctcagtctattactgagacaatagtgagatggcttatatgtttcccctgttaatatctggttaaattatgtatccatcaaatggtatgctcgcagcattagcaaaattaggagtttcatctttttcattgaatcacaggtggagactcctattttcctttctgttttcaggcctttgagcccctgggagcccaaataccactcaattattttgtatttatgattaataaaagttcattttttaaatttgtatttttatacaacctccaaaaaaaaaaacaactgggtagagggtgggagggatttacttttaagaggcaaaatgtgagtaaattgaaaccaagaaaacttgtttttagaatatttcgtctgaataagtacagtagccaaggaatacaaacctaattgcatgtttttaaaaattccttggaggctggaaggggttaagccagaagtgcaatcaataggaattagggaatgttgtatatttatatatgtaaactttttttgtaagaaaagttggtgacaactaaaccaactttttccaaagtgcgctatgcatatttttaatgaaagatgacatgtatttgcacaaaaattctcaggcacattaaattattgtaaactgaagtaaaacccgggtgcttgctttgagattgtggttttttcttcctaatgtaaaataaaataaaacacatctgccttcttgatatttatagaattagagaataaactttttaatgggggagtcaaagctttttctttttctctaaggttcttttttttattcaaactgtatgaaatggcaaagtgaggctctggggttagatttcagcattcagcagttgacacaggctaagaaatggaaagaagtagatctgttttttctcaatgttgctgagcaaagtctgcttctcatcagatgacgtggctttgtctagacagcacgcagttcagaaagaaatgtctttatacaaaagacatgatagagaaaagatgagagaggggactaattattttgtttatgaaaatggcaagtaaattacttgatctttttggtgcttaatttgcaaatgttttgttcctttgtcctgacttaaaggcagttttctgaagaactcttgactcttgctcctatggttcccataggcacacctattcccaggccaaggagagtccttcctctccccttttgaggcatccccgccatccccccacttagagctatgtgctcaaaaagccaacatgaatgcagtggtaaaaatttgttagtttcttatactttttagaatctctcaataaaatttttctaaataaattccacaaaaacaaagggtgaagatggtctctccctttcgttccccttcactcagttgtgctgaggtcaatagagtgtagagtttcagaaaggattccagcaggtttatatgtgaatataagtgtccctgaatggggcaggcattaaatagaagaatccctgctgtttaaatttcccgcatattccaattcacttttaaaaaataccatttgaatttgtatttcataaagtgactctggggtgcttactttagtcaattcttaaaattttttatttgttccctaagaaagtaattactgtttctgttgcctggacagttacagtttccaggaaacatcaggaagtaggaaactgtagggccagagagtagtacaacgttaaattgtccgatttatgtgtattacttaaagctataaattgaactagatcttgccgtgctctgtattgagtataatttgtatacttttttataattaatgactaaatgatcactttggaggcagggtggtgggggtgtattagcagccaaataagcatatctgatcaaaaagaaccaggcttagattttttttaagtacattgatgttgatgttccaccagaaacaccttaagtgtatactgttgtgtaatgtctctagaaaggaatcctgtcttaaaactgggttttgctgttttttgaagtttctacctaaaatcatttttggtatatcctgataatctctataatactagaattgtctgcaaaatatagtaagaagaattggagcctaatagctgattcctcccaatttatctgttatgttttgtcactattcacattttagtcttttctacgataaaaattgtatgtgtactttcatgccagtataggaaacctcaatcttttttttttttcgcctttaagaaggttttcagtgattatacctcaggtatttctgagtgtcctattgtctaataggagaaatatcttcccgagctcagaattaaaagttctcctaaattatgaagatcccaaatcttatgtaaataaccttaggcatgagtccttagggagaagttaatgaccattgttaaagtgcttttttagaaaatgttgtgctgtatgttcttgatttgacataaatgaatagactttggcaagggaggaaataagttaaaaggcagcttacaagagcctattccctataaagggtataattttacacagtactcaaagcttgttatcttttctgaccattttagtacagaattagtacttggtggttactaacatcaacttgtgacatctagaactagggctcttagtgtttagtgggccacttctctgatgtcagatgcatgcagacctgtactccacatgcaacccaacagcagtgcagtgtgataactgagcggtcgcatggcagaggacatccccctcagagtgggcacaagtgccctctagggcagccaggggaatactattgttcgatacctgggatttgactttgtcaaacagctctttgtgcccctatctttgttttgtcaaatgtagatcagttaataaacatgagtagcttgaattttcaaaaaaaaaa

SEQ ID NO: 60528 - DNA, 1854 bp, Homo sapiens
gaattccgggccgaaggtgcctgggcttgctcattcagtcacagtcacagccaccatgccagggaggacctgggagctgtgcctgctactgctgctggggctgggactggggtcccaggaggccctacccccaccctgtgagagtgagatttactgccacggggagctcctaaaccaagttcaaatggccaagctctaccaggatgacaagcagtttgtggacatgccactgtctatagctccagaacaagtcctgcagaccttcactgagctgtccagggaccacaatcacagcatccccagggagcagctgcaggcgtttgtccacgaacacttccaggccaaggggcaggagctgcagccctggacccctgcagactggaaagacagcccccagttcctgcagaagatttcagatgccaaactgcgtgcctgggcagggcagctgcatcagctctggaagaagctggggaagaagatgaagccagaggttctcagccaccctgagcggttctctctcatatactcagaacatcctttcattgtgcctggcggtcgctttgttgagttctactactgggactcctactgggtcatggagggtctgctcctctcagagatggctgagacggtgaagggcatgctgcagaacttcttggacctggtgaaaacctatgggcatgtccccaatggtgggcgcgtgtactacttgcagcggagccagcccccactcttgaccctcatgatggattgctacttgactcacaccaatgacaccgcctttctacaggaaaacattgaaacactagccttggaattggacttttggaccaagaacaggactgtctctgtgagcttggagggaaagaactacctcctgaatcgctattatgtcccttatgggggacccaggcctgagtcctacagcaaagatgtggagttggctgacaccttgccagaaggagaccgggaggctctgtgggctgagctcaaggctggggctgagtctggctgggacttctcttcacgctggctcattggaggcccaaaccccaactcgcttagcggcatccgaacaagcaaactggtgcctgttgacctgaatgccttcctatgccaagcagaggagctgatgagcaacttctattccaggctggggaacgactcccaggccacgaagtacagaatcctgcggtcgcagcgcttggccgccctgaacacagtcctgtgggatgagcagaccggagcctggttcgattacgaccttgagaagaagaagaaaaaccgggagttttacccatccaacctcactccactctgggccgggtgtttctctgaccctggcgtggcggacaaggctctgaaatacctggaggacaaccggatcctgacttaccagtatgggatcccgacctctctccagaagacaggccagcagtgggatttccccaatgcctgggcccccctgcaggacttggtcatcagaggcctggccaaggcacctttacgtcgggcccaggaagtggctttccagctggctcagaattggatccgaaccaattttgatgtctactcgcagaagtcagccatgtatgagaagtatgacgtcagcaacggtggacagcccggtgggggaggagaatatgaagttcaggagggatttggctgggacgaaggtgtggtcctgatgctgctggaccgctatggtgaccggctgacctcaggggccaagctggctttcctggagccccactgcctggcggccacccttctgcccagcctcctgctcagcctcctgccatggtgacagccctcctctcctcacctggccccagctcctgccccccggaattc

SEQ ID NO: 60529 - DNA, 1817 bp, Homo sapiens
attcattactacagggcaggaagggcacgttctcatcagcatgagggagtgcctttccatccacatcggtcaagctggcatccagattggggacgcctgctgggaactctattgcctggaacatggaatccagccaaatggcgttgttcttgacactcaacaggatcagctggaaaatgcaaaaatggagcacacaaatgcatctttcgataccttcttctgtgagacaagagctgggaagcatgtgcctagagcactcttcgtggacttggagccaactgttatagatgggatccggacgggccagcaccgttcactcttccaccccgagcagctccttagcggaaaggaggatgctgccaacaattacgcgcgaggccgttactctgtggggtcggaggtcatcgaccttgtgctggagaggacccggaagctggcagaacagtgtggtggacttcagggatttttgattttccgaagctttggaggaggcactggttcagggtttacgtctctcttaatggagaggctcacaggagaatatagcagaaagactaagctggagttctcggtctacccagcccccaggatctccactgccgtggtagagccttataactctgtcctcaccacccactccaccacagagcacacggactgtaccttcatggtggacaacgaggccgtctatgatatatgccatcgtaaactcggtgttgaatgcccctctcatgccagcatcaatagattggtggttcaggtggtatcttccatcactgcctccctccggtttgaagggcccttgaatgtagacctaattgaattccagaccaacctggtaccttatccgagaatacatttccccatgacagccttcgcccccatcgtctctgctgacaaagcctaccatgagcagttctctgtgtcagacatcaccactgcttgctttgagtcctccaaccagctggtcaagtgtgatcctcggcttgggaagtacatggcctgctgcctactctatagaggggatgtggtccccaaggaagtgaatgcagcaatcgcagccacgaagtcgaggcactctgttcagtttgtagattggtgtccaactggtttcaaggtgggcatcaacaatcggccgcccacggtgatgccgggtggggacctggccaaagtccaccggtccatctgcatgctgagcaacaccacggcgattgtggaggcctgggcccgcctggaccacaagtttgacctcatgtacgccaagagagcatttctgcactggtacctcagagaaggcatggaagaagcagagttcttggaggccagggaagatctggcagccctggagagggactatgaggaagtggcgcaaagtttctgaggcatgtatgatgggtgcaaatgaatgtcaagttaaaatggcatgttttcttttcaagccgttatatgcctagtgggtagttcccctgatgagcagaaaaatgaactcaaatcaggcaagactctaggttccacactaaattaagtgggtcagtaccaacaatgaacacattatttcctggtctactggtacaagtcagctctgctacctgggagcctttggaagcttagagtcctttgaactgctgagtcacttctaggtgggatttttttgttttaccaagagacaatgaaatcctaaagtttatgcttttcctttctggtaccggaagtagaaaacagcacatgttgattacgaatgttttttcccccatgtctacattttttacactgattaaatcataaatattttcagtatgaaaaaaaaaaaaaaaaaa

SEQ ID NO: 60530 - DNA, 3329 bp, Homo sapiens
cttgcacagtccgcctcgggcagcccaaagctcctctgcccaccctggctcccagagccctccaaaacaaaagaccagagaagcactctccacccagcagccagacgcctccttcttgacgccagcscccaccctctgtctgctcgagcccaggaaaggcctgaaggaagaggccggggaaagagccctccctctctcccttgtccctccatccacccagcgccggcatctggagaccctatggcccgggctcactggggctgctgcccctggctggtcctcctctgtgcttgtgcctggggccacacaaagccagtggaccttggagggcaggatgtgagaaactgttccaccaaccccccttaccttccagttactgtggtcaataccacaatgtcactcacagccctccgccagcagatgcagacccagaatctctcagcctacatcatcccaggcacagatgctcacatgaacgagtacatcggccaacatgacgagaggcgtgcgtggattacaggctttacagggtctgcaggaactgcagtggtgactatgaagaaagcagctgtctggaccgacagtcgctactggactcaggctgagcggcagatggactgcaactgggagctccataaggaagttggcaccactcctattgtcacctggctcctcaccgagattcctgctggagggcgtgtgggttttgaccccttcctcttgtccattgacacctgggagagttatgatctggccctccaaggctctaacagacagctggtgtccatcacaaccaatcttgtggacctggtatggggatcagagaggccaccggttccaaatcaacccatttatgccctgcaggaggcattcacagggagcacttggcaggagaaagtatctggcgtccgaagccagatgcagaagcatcaaaaggtcccgactgccgtccttctgtcggcgcttgaggagacggcctggctcttcaaccttcgagccagtgacatcccctataaccccttcttctattcctacacgctgctcacagactcttctattaggttgtttgcaaacaagagtcgctttagctccgaaaccttgagctatctgaactccagttgcacaggccccatgtgtgtgcaaatcgaggattacagccaagttcgtgacagcatccaggcctactcattgggagatgtgaggatctggattgggaccagctataccatgtatgggatctatgaaatgataccaagggagaaactcgtgacagacacctactccccagtgatgatgaccaaggcagtgaagaacagcaaggagcaggccctcctcaaggccagccacgtgcgggacgctgtggctgtgatccggtacttggtctggctggagaagaacgtgcccaaaggcacagtggatgagttttcgggggcagagatcgtggacaagttccgaggagaagaacagttctcctccggacccagttttgaaaccatctctgctagtggtttgaatgctgccctggcccactacagcccgaccaaggagctgaaccgcaagctgtcctcagatgagatgtacctgctggactctggggggcagtactgggacgggaccacagacatcaccagaacagtccactggggcaccccctctgccttccagaaggaggcatacacccgtgtgctgataggaaatattgacctgtccaggctcatctttcccgctgctacatcagggcgaatggtggaggcctttgcccgcagagccttgtgggatgctggtctcaattatggtcatgggacaggccacggcattggcaacttcctgtgtgtgcatgagtggccagtgggattccagtccaacaacatcgctatggccaagggcatgttcacttccattgaacctggttactataaggatggagaatttgggatccgtctcgaagatgtggctctcgtggtagaagcaaagaccaagtacccagggagctacctgacctttgaagtggtatcatttgtgccctatgaccggaacctcatcgatgtcagcctgctgtctcccgagcatctccagtacctgaatcgctactaccagaccatccgggagaaggtgggtccagagctgcagaggcgccagctactagaggagttcgagtggcttcaacagcacacagagcccctggccgccagggccccagacaccgcctcctgggcctctgtgttagtggtctccacccttgccatccttggctggagtgtctagaggctccagactctcctgttaaccctccatctagatggggggctcccttgcttagctcccctcaccctgcactgaacataccccaagagcccctgctggcccattgcctagaaacctttgcattcatcctccttctccaagacctatggagaaggtcccaggccccaggaacacagggcttcttggccccagatggcacctccctgcaccccggggttgtataccacaccctgggcccctaatcccaggccccgagataggaaagccagctagtctcttctcttctgtgatctcagtaggcctaacctataacctagcacagactgctacagctgctcccctcccgccaaacaaaaccccaagagagcaatgcccctaccacccaagggtgccatggtcccgggagagcccaaacctatcaccacctgttgggcatagccagagctgttcccacccagccagggcatgaaacatcaaccccccacatgtgaacccatcattcctaaaccctgggtaggctccatgccaagtaacagcagagggagttaagccataggaatttggctgtggagtaagagggaatgcggtgaggcactctggaatatgaccctaccagaggttggagaacaaacttgggcagccggaacccgtcactattctagacttccctggcattcgaggagccctttgaactttccaaagtgcagccacagctacaatgctgttaaatcctcccacattcttggatgccccttcaccttgtgtggacagtgtctggtttctccattttacagacaggaaaactgagcttcagacagggggtgggctttgcctaaggacacacaaatttggttgggagttgatggggccagatgagccagcattccagctctttcacccttcagcaacatgcagagtccctgagcccacctcccagccctctcctcattctctgaacccactgtggtgagaagaatttgctccggccaaattggccgttagccacctgggtccacatcctgctaagacgtttaaaacagcctaacaaagacacttgcctctgg

SEQ ID NO: 60531 - DNA, 3513 bp, Homo sapiens
ggaggaggctgtgctgcaccagcacctcttgctccacatctccagagagcccagggccctgtggccgagtgtgtccagcccagtgtcatggggagcttccatatctcatggctccttgctgggccaagccctccagaaccccaaacccccaaagactgatgaatgccagagtggccaccttgcttatctgtggccccggccctggtgatcaccatggcagctgggaagggagccccgttgagcccatcggctgaaaacagatggcgacttagcgaacctgagctgggccggggctgcaagccagtgctgctcgagaagacgaaccgcctgggccctgaggctgctgtgggcagggcgggccgggatgtgggcagtgcggagctggcactgttggtagccccaggcaagccccgacctggcaagccgctgcccccgaagacacgtggagagcagaggcagagcgccttcacggagctgccgaggatgaaggaccggcaggtggatgctcaggcccaggagagggagcacgatgaccccacaggccaacctggtgccccacagctgacccagaacatccccagaggcccagctggcagcaaagtcttctctgtgtggcccagcggagcacgaagtgagcaaagaagcgcctttagcaaaccaaccaagcgaccagcagagaggcctgagctaacctcagtcttccctgcaggggaatctgcagatgccctgggggagctgtctggactcctcaacactacagacctcgcttgttggggtcgactttcaactcccaagcttttggttggtgatttgtggaacttgcaagcattgccacagaatgctccactctgtagcacttttctgggtgcccctacactgtggctggagcatacccaggcccaggtgcccccaccctcatcatcctccaccacttcgtgggccctcctgccacccaccctcacctccctgggcttgtccacccagaactggtgtgcaaagtgcaacctgtcctttcgcctaacgtccgacctggtctttcacatgcgatcccaccacaaaaaggagcatgcggggcctgacccacattctcagaagcggagagaagaggcccttgcctgccctgtgtgccaggagcacttccgggagcgccaccacctctcccggcacatgacttctcacagctagcaggtgaccgcagaatgacctgctgggtgcagcagccagcctttggcagaggggggctccctgggcctgcgttgagggggctgtcatggtcctttgcagagctgctgcttttggcattcatagataaacagctcaggcataatttgaaaaagccacacctgcatgatgtgttttgaaggaaatgaagtcctgaaataaagtgatgggctttgcaaatccagggtagaggccctaacaggcacagagagcaggggcaactcctggcacacatcatgggctttggaggcacacaagcctggattcgaatctgggctctttcacatactagctgtgaccctggacaaagagctttaacctgctgagtccccattttctcatctgtgaaatggagatgataacactgtgtcttaggttggcattcaggtcacatgaaaggtgtgtggaaagtggccagcattctgcctgcagaccctgagcactgagtcaacaaggtttgtgatgatgtctgtactagttagctattgttattaacaagatctccatggcagacaagctaaagcatctgcctaagtcgtgagtctgtgggttggctcaggttaagctgagcttggctgggcttggcagcaagtctcagatttgatcaagtcatattcgttttcttcttcggctggtgggctacccagagcgagcacgcttctctcgtggtcatgccaagaacacaggagggtgagtctaacaagcacacctcaagcctctgcttgggtcacattgccaatgtcctctcagcccatacaagtggcaggaccaggcccaatattaaggagtggaaaagtgtaggctgcccttggtgaagctgtgacaagggagtgaccatccatcccctccacaggagggtgaggaattgggacaggtaattccagccaatacctggtccatagttcttcacattgtgagtatatgaatacggggaaatagaaccccctccccaccacctacacacatgctgttttaccttccaagaataggacatgtgcaaaaactaggcttccagatcgtgaggctggggagcattctaggtaccatttattatctactgcgtttcggtcagtagctgttgtaggtacccgcatcagcccttgttcctaaggatgtgtggagcccaggctgtactctttgacattccacaggtcagtctgcgtgaaagccctttgtggggagtttccaagccagtgtcgtttttgcactggtttccacctcactgtcagatattgttcttttgatatgcagtttccagccctccaatgagtccccagcacagatctcaggcttgtggctgggaataagcccagctgagcaggtggggatctcagccagcctcccagactgcacctcttctattgctctcctctgtccaccgttccaggcagcagcactcccacctggctgctctgatgtcctcgctccctccattcctgcctctcaccatgcacgcatccattgtccacacacacacaaccagataatcttctgaaagtgtaactcagatgatgcctccaaccctgtggctgcccttcacacttacaggcctaaccccagcaggacctgccagctgcttcatgaacaagtccctgcctcatgttaattgcaagcactcatttcactctccctgtgtgccaggcaatagcataagcactggaagaatacagatgttatagtgagtcctacaatagccctggaaggcaagagctgtttcctttccatttctacaatgagtcaattgcagatgatgctataacacttccagtgtttctgacacttccctgaagctatacctgctaccttcatgggccgagcttgcccttatgaggcccacaggtggcagtgggcagaggggaccccgctataccacctcgctgctgttccactgtctgctcccgtgttctgaccacagctctggtgccgtttctcaagcctgggcttcattcaacattttctatctagctcttcatggtgctgctcctgctatggttccacagggcttcttctcgcaggtcagctccttagagaggtctcccagattccccgtaaagcagccctgcagcctctgcctctctcagccgcatcaccctgttgcttccttcacagcatgtctcaccatctgcaaccatctttctgtttgtcgtcttgttgatttgctgcctccacactgtcagctccttgggaacagagattggtttgtttactgtgcatccctggtgcccagaacagggcatggcatattgttggtgcataataaatattgtggaaataaaaaaaaaaaaaaaaaaa

SEQ ID NO: 60532 - protein, 140 aa, Homo sapiens
MLSSTQNAGGSYQRVRGALDTQKCSPEKSASFFSKVTYSWFSRVITLGYKRPLEREDLFELKESDSFCTACPIFEKQWRKEVLRNQERQKVKVSCYKEAHIKKPSLLYALWNTFKSILIQVALFKVFADILSFTSPLIMK

SEQ ID NO: 60533 - protein, 245 aa, Homo sapiens
MLSSTQNAGRLIHRVITLGYKRPLEREDLFELKESDSFCTACPIFEKQWRKEVLRNQERQKVKVSCYKEAHIKKPSLLYALWNTFKSILIQVALFKVFADILSFTSPLIMKQIIIFCEHSSDFGWNGYGYAVALLVVVFLQTLILQQYQRFNMLTSAKVKTAVNGLIYKKALLLSNVSRQKFSTGEIINLMSATHGLDSKPQSPLVCPFSNPNGRISPLARAGSSSVSRGGSPCVCYTNKCFSCN

SEQ ID NO: 60534 - protein, 655 aa, Homo sapiens
MSSSNVEVFIPVSQGNTNGFPATASNDLKAFTEGAVLSFHNICYRVKLKSGFLPCRKPVEKEILSNINGIMKPGLNAILGPTGGGKSSLLDVLAARKDPSGLSGDVLINGAPRPANFKCNSGYVVQDDVVMGTLTVRENLQFSAALRLATTMTNHEKNERINRVIQELGLDKVADSKVGTQFIRGVSGGERKRTSIGMELITDPSILFLDEPTTGLDSSTANAVLLLLKRMSKQGRTIIFSIHQPRYSIFKLFDSLTLLASGRLMFHGPAQEALGYFESAGYHCEAYNNPADFFLDIINGDSTAVALNREEDFKATEIIEPSKQDKPLIEKLAEIYVNSSFYKETKAELHQLSGGEKKKKITVFKEISYTTSFCHQLRWVSKRSFKNLLGNPQASIAQIIVTVVLGLVIGAIYFGLKNDSTGIQNRAGVLFFLTTNQCFSSVSAVELFVVEKKLFIHEYISGYYRVSSYFLGKLLSDLLPMRMLPSIIFTCIVYFMLGLKPKADAFFVMMFTLMMVAYSASSMALAIAAGQSVVSVATLLMTICFVFMMIFSGLLVNLTTIASWLSWLQYFSIPRYGFTALQHNEFLGQNFCPGLNATGNNPCNYATCTGEEYLVKQGIDLSPWGLWKNHVALACMIVIFLTIAYLKLLFLKKYS

SEQ ID NO: 60535 - protein, 673 aa, Homo sapiens
MAGKAAEERGLPKGATPQDTSGLQDRLFSSESDNSLYFTYSGQPNTLEVRDLNYQVDLASQVPWFEQLAQFKMPWTSPSCQNSCELGIQNLSFKVRSGQMLAIIGSSGCGRASLLDVITGRGHGGKIKSGQIWINGQPSSPQLVRKCVAHVRQHNQLLPNLTVRETLAFIAQMRLPRTFSQAQRDKRVEDVIAELRLRQCADTRVGNMYVRGLSGGERRRVSIGVQLLWNPGILILDEPTSGLDSFTAHNLVKTLSRLAKGNRLVLISLHQPRSDIFRLFDLVLLMTSGTPIYLGAAQHMVQYFTAIGYPCPRYSNPADFYVDLTSIDRRSREQELATREKAQSLAALFLEKVRDLDDFLWKAETKDLDEDTCVESSVTPLDTNCLPSPTKMPGAVQQFTTLIRRQISNDFRDLPTLLIHGAEACLMSMTIGFLYFGHGSIQLSFMDTAALLFMIGALIPFNVILDVISKCYSERAMLYYELEDGLYTTGPYFFAKILGELPEHCAYIIIYGMPTYWLANLRPGLQPFLLHFLLVWLVVFCCRIMALAAAALLPTFHMASFFSNALYNSFYLAGGFMINLSSLWTVPAWISKVSFLRWCFEGLMKIQFSRRTYKMPLGNLTIAVSGDKILSVMELDSYPLYAIYLIVIGLSGGFMVLYYVSLRFIKQKPSQDW

SEQ ID NO: 60536 - protein, 1306 aa, Homo sapiens
MGAASGRRGPGLLLPLPLLLLLPPQPALALDPGLQPGNFSADEAGAQLFAQSYNSSAEQVLFQSVAASWAHDTNITAENARRQEEAALLSQEFAEAWGQKAKELYEPIWQNFTDPQLRRIIGAVRTLGSANLPLAKRQQYNALLSNMSRIYSTAKVCLPNKTATCWSLDPDLTNILASSRSYAMLLFAWEGWHNAAGIPLKPLYEDFTALSNEAYKQDGFTDTGAYWRSWYNSPTFEDDLEHLYQQLEPLYLNLHAFVRRALHRRYGDRYINLRGPIPAHLLGDMWAQSWENIYDMVVPFPDKPNLDVTSTMLQQGWNATHMFRVAEEFFTSLELSPMPPEFWEGSMLEKPADGREVVCHASAWDFYNRKDFRIKQCTRVTMDQLSTVHHEMGHIQYYLQYKDLPVSLRRGANPGFHEAIGDVLALSVSTPEHLHKIGLLDRVTNDTESDINYLLKMALEKIAFLPFGYLVDQWRWGVFSGRTPPSRYNFDWWYLRTKYQGICPPVTRNETHFDAGAKFHVPNVTPYIRYFVSFVLQFQFHEALCKEAGYEGPLHQCDIYRSTKAGAKLRKVLQAGSSRPWQEVLKDMVGLDALDAQPLLKYFQPVTQWLQEQNQQNGEVLGWPEYQWHPPLPDNYPEGIDLVTDEAEASKFVEEYDRTSQVVWNEYAEANWNYNTNITTETSKILLQKNMQIANHTLKYGTQARKFDVNQLQNTTIKRIIKKVQDLERAALPAQELEEYNKILLDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRYFVSFIIQFQFHEALCQAAGHTGPLHKCDIYQSKEAGQRLATAMKLGFSRPWPEAMQLITGQPNMSASAMLSYFKPLLDWLRTENELHGEKLGWPQYNWTPNSARSEGPLPDSGRVSFLGLDLDAQQARVGQWLLLFLGIALLVATLGLSQRLFSIRHRSLHRHSHGPQFGSEVELRHS

SEQ ID NO: 60537 - protein, 732 aa, Homo sapiens
MGQGWATAGLPSLLFLLLCYGHPLLVPSQEASQQVTVTHGTSSQATTSSQTTTHQATAHQTSAQSPNLVTDEAEASKFVEEYDRTSQVVWNEYAEANWNYNTNITTETSKILLQKNMQIANHTLKYGTQARKFDVNQLQNTTIKRIIKKVQDLERAALPAQELEEYNKILLDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRYFVSFIIQFQFHEALCQAAGHTGPLHKCDIYQSKEAGQRLATAMKLGFSRPWPEAMQLITGQPNMSASAMLSYFKPLLDWLRTENELHGEKLGWPQYNWTPNSARSEGPLPDSGRVSFLGLDLDAQQARVGQWLLLFLGIALLVATLGLSQRLFSIRHRSLHRHSHGPQFGSEVELRHS

SEQ ID NO: 60538 - protein, 739 aa, Homo sapiens
MGQGWATAGLPSLLFLLLCYGHPLLVPSQEASQQVTVTHGTSSQATTSSQTTTHQATAHQTSAQSPNLVTDEAEASKFVEEYDRTSQVVWNEYAEANWNYNTNITTETSKILLQKNMQIANHTLKYGTQARKFDVNQLQNTTIKRIIKKVQDLERAALPAQELEEYNKILLDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRYFVSFIIQFQFHEALCQAAGHTGPLHKCDIYQSKEAGQRLATAMKLGFSRPWPEAMQLITGQPNMSASAMLSYFKPLLDWLRTENELHGEKLGWPQYNWTPNSDDFYNETETKIFLQFYDQTGIWDHGAPHLLPPSQARGTREAPVYMSKRAASSGPPGSPKLPPAAQGHGEVPVHDLLWHPGPPV

SEQ ID NO: 60539 - protein, 805 aa, Homo sapiens [sequence omitted]

SEQ ID NO: 60540 - protein, 319 aa, Homo sapiens
MCSLPVPREPLRRVAVTGGTHGNEMSGVYLARHWLHAPAELQRASFSAVPVLANPAATSGCRRYVDHDLNRTFTSSFLNSRPTPDDPYEVTRARELNQLLGPKASGQAFDFVLDLHNTTANMGTCLIAKSSHEVFAMHLCRHLQLQYPELSCQVFLYQRSGEESYNLDSVAKNGLGLELGPQPQGVLRADIFSRMRTLVATVLDFIELFNQGTAFPAFEMEAYRPVGVVDFPRTEAGHLAGTVHPQLQDRDFQPLQPGAPIFQMFSGEDLLYEGESTVYPVFINEAAYYEKGVAFVQTEKFTFTVPAMPALTPAPSPAS

SEQ ID NO: 60541 - protein, 153 aa, Homo sapiens
MHLTTAPRWKRHCVPATSCTRRASSWSLASPTMPPGKWPRSVPSARATAGSCPLCTSFWKEHHFEGIALVEKALQAAYGASAPSMTSAALRWMYHHSQLQGAHGDAVILGMSSLEQLEQNLAAAEEGPLEPAVVDAFNQAWHLFAHECPNYFI

SEQ ID NO: 60542 - protein, 331 aa, Homo sapiens
MSRQLSRARPATVLGAMEMGRRMDAPTSAAVTRAFLERGHTEIDTAFVYSEGQSETILGGLGLRLGGSDCRVKIDTKAIPLFGNSLKPDSLRFQLETSLKRLQCPRVDLFYLHMPDHSTPVEETLRACHQLHQEGKFVELGLSNYAAWEVAEICTLCKSNGWILPTVYQGMYNAITRQVETELFPCLRHFGLRFYAFNPLAGGLLTGKYKYEDKNGKQPVGRFFGNTWAEMYRNRYWKEHHFEGIALVEKALQAAYGASAPSMTSATLRWMYHHSQLQGAHGDAVILGMSSLEQLEQNLAAAEEGPLEPAVVDAFNQAWHLVTHECPNYFR

SEQ ID NO: 60543 - protein, 460 aa, Homo sapiens
MSTRYHQAASDSYLELLKEATKRDLNLSDEDGMTPTLLAAYHGNLEALEIICSRGGDPDRCDIWGNTPLHFAASNGHAHCVSFLVNFGANIFALDNDLQTPLDAAASREQNECVALLDKAATAQNIMNPKKVTRLKEQAQKNARRQIKECERLQEKHQNKMAHTYSKEESGTLSSSKGTFSRSSPSNASAPGTFGSLSKGIKDTFKIKFKKNKDTAEQVGKEGRSGQRNVMEVFREEEEDSFSGDFKEKLQLSAEEDGSVHHESILNRPGLGSIVFRRNRISSPEDISDSKREFGFKLPSELLQRQGASEADEGAADEEGEENGLKDDLPWDDDEVEWEEDVVDATPLEVFLLSQHLEEFLPIFKREQIDLEALLLCSDEDLQSIQMQLGPRKKVLNAINRRKQVLQQPGQLVDTSLRWRVLAWSIGVMLWPAGSTPGGTPSLPNARPLGMDSRASEMPT

SEQ ID NO: 60544 - protein, 967 aa, Homo sapiens
MAKGFYISKSLGILGILLGVAAVCTIIALSVVYSQEKNKNANSSPVASTTPSASATTNPASATTLDQSKAWNRYRLPNTLKPDSYQVTLRPYLTPNDRGLYVFKGSSTVRFTCKEATDVIIIHSKKLNYTLSQGHRVVLRGVGGSQPPDIDKTELVEPTEYLVVHLKGSLVKDSQYEMDSEFEGELADDLAGFYRSEYMEGNVRKVVATTQMQAADARKSFPCFDEPAMKAEFNITLIHPKDLTALSNMLPKGPSTPLPEDPNWNVTEFHTTPKMSTYLLAFIVSEFDYVEKQASNGVLIRIWARPSAIAAGHGDYALNVTGPILNFFAGHYDTPYPLPKSDQIGLPDFNAGAMENWGLVTYRENSLLFDPLSSSSSNKERVVTVIAHELAHQWFGNLVTIEWWNDLWLNEGFASYVEYLGADYAEPTWNLKDLMVLNDVYRVMAVDALASSHPLSTPASEINTPAQISELFDAISYSKGASVLRMLSSFLSEDVFKQGLASYLHTFAYQNTIYLNLWDHLQEAVNNRSIQLPTTVRDIMNRWTLQMGFPVITVDTSTGTLSQEHFLLDPDSNVTRPSEFNYVWIVPITSIRDGRQQQDYWLIDVRAQNDLFSTSGNEWVLLNLNVTGYYRVNYDEENWRKIQTQLQRDHSAIPVINRAQIINDAFNLASAHKVPVTLALNNTLFLIEERQYMPWEAALSSLSYFKLMFDRSEVYGPMKNYLKKQVTPLFIHFRNNTNNWREIPENLMDQYSEVNAISTACSNGVPECEEMVSGLFKQWMENPNNNPIHPNLRSTVYCNAIAQGGEEEWDFAWEQFRNATLVNEADKLRAALACSKELWILNRYLSYTLNPDLIRKQDATSTIISITNNVIGQGLVWDFVQSNWKKLFNDYGGGSFSFSNLIQAVTRRFSTEYELQQLEQFKKDNEETGFGSGTRALEQALEKTKANIKWVKENKEVVLQWFTENSK

SEQ ID NO: 60545 - protein, 396 aa, Homo sapiens
MFLKAVVLTLALVAVAGARAEVSADQVATVMWDYFSQLSNNAKEAVEHLQKSELTQQLNALFQDKLGEVNTYAGDLQKKLVPFATELHERLAKDSEKLKEEIGKELEELRARLLPHANEVSQKIGDNLRELQQRLEPYADQLRTQVSTQAEQLRRQLTPYAQRMERVLRENADSLQASLRPHADELKAKIDQNVEELKGRLTPYADEFKVKIDQTVEELRRSLAPYAQDTQEKLNHQLEGLTFQMKKNAEELKARISASAEELRQRLAPLAEDVRGNLRGNTEGLQKSLAELGGHLDQQVEEFRRRVEPYGENFNKALVQQMEQLRQKLGPHAGDVEGHLSFLEKDLRDKVNSFFSTFKEKESQDKTLSLPELEQQQEQQQEQQQEQVQMLAPLES

SEQ ID NO: 60546 - protein, 236 aa, Homo sapiens
MTSEKGPSTGDPTLRRRIEPWEFDVFYDPRELRKEACLLYEIKWGMSRKIWRSSGKNTTNHVEVNFIKKFTSERDFHPSMSCSITWFLSWSPCWECSQAIREFLSRHPGVTLVIYVARLFWHMDQQNRQGLRDLVNSGVTIQIMRASEYYHCWRNFVNYPPGDEAHWPQYPPLWMMLYALELHCIILSLPPCLKISRRWQNHLTFFRLHLQNCHYQTIPPHILLATGLIHPSVAWR

SEQ ID NO: 60547 - protein, 36 aa, Homo sapiens
MTSEKGEESNPGSLTSSMTPENFVKRPVCSTKSSGA

SEQ ID NO: 60548 - protein, 301 aa, Homo sapiens
MVFTQAPAEIMGHLRIRSLLARQCLAEFLGVFVLMLLTQGAVAQAVTSGETKGNFFTMFLAGSLAVTIAIYVGGNVSGAHLNPAFSLAMCIVGRLPWVKLPIYILVQLLSAFCASGATYVLYHDALQNYTGGNLTVTGPKETASIFATYPAPYLSLNNGFLDQVLGTGMLIVGLLAILDRRNKGVPAGLEPVVVGMLILALGLSMGANCGIPLNPARDLGPRLFTYVAGWGPEVFSAGNGWWWVPVVAPLVGATVGTATYQLLVALHHPEGPEPAQDLVSAQHKASELETPASAQMLECKL

SEQ ID NO: 60549 - protein, 192 aa, Homo sapiens
MGSLGSKNPQTKQAQVLLLGLDSAGKSTLLYKLKLAKDITTIPTIGFNVEMIELERNLSLTVWDVGGQEKMRTVWGCYCENTDGLVYVVDSTDKQRLEESQRQFEHILKNEHIKNVPVVLLANKQDMPGALTAEDITRMFKVKKLCSDRNWYVQPCCALTGEGLAQGFRKLTGFVKSHMKSRGDTLAFFKQN

SEQ ID NO: 60550 - protein, 761 aa, Homo sapiens
MSAITVALLSLLFITSGTIENHKDLGGHFFSTTQSPPATQGSTAAQRSTATQHSTATQSSTATQTSPVPLTPESPLFQNFSGYHIGVGRADCTGQVADINLMGYGKSGQNAQGILTRLYSRAFIMAEPDGSNRTVFVSIDIGMVSQRLRLEVLNRLQSKYGSLYRRDNVILSGTHTHSGPAGYFQYTVFVIASEGFSNQTFQHMVTGILKSIDIAHTNMKPGKIFINKGNVDGVQINRSPYSYLQNPQSERARYPSNTDKEMIVLKMVDLNGDDLGLISWFAIHPVSMNNSNHLVNSDNVGYASYLLEQEKNKGYLPGQGPFVAAFASSNLGDVSPNILGPRCINTGESCDNANSTCPIGGPSMCIAKGPGQDMFDSTQIIGRAMYQRAKELYASASQEVTGPLASAHQWVDMTDVTVWLNSTHASKTCKPALGYSFAAGTIDGVGGLNFTQGKTEGDPFWDTIRDQILGKPSEEIKECHKPKPILLHTGELSKPHPWHPDIVDVQIITLGSLAITAIPGEFTTMSGRRLREAVQAEFASHGMQNMTVVISGLCNVYTHYITTYEEYQAQRYEAASTIYGPHALSAYIQLFRNLAKAIATDTVANLSRGPEPPFFKQLIVPLIPSIVDRAPKGRTFGDVLQPAKPEYRVGEVAEVIFVGANPKNSVQNQTHQTFLTVEKYEATSTSWQIVCNDASWETRFYWHKGLLGLSNATVEWHIPDTAQPGIYRIRYFGHNRKQDILKPAVILSFEGTSPAFEVVTI

SEQ ID NO: 60551 - protein, 103 aa, Homo sapiens
MTTEIGWWKLTFLRKKKSTPKVLYEIPDTYAQTEGDAEPPRPDAGGPNSDFNTRLEKIVDKSTKGKHVKVSNSGRFKEKKKVRATLAENPNLFDDHEEGRSSK

SEQ ID NO: 60552 - protein, 547 aa, Homo sapiens
MDIIFGRNRKEQLEPVRAKVTGKIPAWLQGTLLRNGPGMHTVGESRYNHWFDGLALLHSFTIRDGEVYYRSKYLRSDTYNTNIEANRIVVSEFGTMAYPDPCKNIFSKAFSYLSHTIPDFTDNCLINIMKCGEDFYATSETNYIRKINPQTLETLEKVDYRKYVAVNLATSHPHYDEAGNVLNMGTSIVEKGKTKYVIFKIPATVPEGKKQGKSPWKHTEVFCSIPSRSLLSPSYYHSFGVTENYVIFLEQPFRLDILKMATAYIRRMSWASCLAFHREEKTYIHIIDQRTRQPVQTKFYTDAMVVFHHVNAYEEDGCIVFDVIAYEDNSLYQLFYLANLNQDFKENSRLTSVPTLRRFAVPLHVDKNAEVGTNLIKVASTTATALKEEDGQVYCQPEFLYEGLELPRVNYAHNGKQYRYVFATGVQWSPIPTKIIKYDILTKSSLKWREDDCWPAEPLFVPAPGAKDEDDGVILSAIVSTDPQKLPFLLILDAKSFTELARASVDVDMHMDLHGLFITDMDWDTKKQAASEEQRDRASDCHGAPLT

SEQ ID NO: 60553 - protein, 347 aa, Homo sapiens; identical to SEQ ID NO: 16323

SEQ ID NO: 60554 - protein, 1986 aa, Homo sapiens
MPRTGAQDGAWIQKQVVFEGQMASTYEQDEVIAIDDISFSSGCLPANDGILLCQEALNAERELCHPDTDLCRFDATDEELRLCQACGFEFDMCEWTSEASAGQISWMRTKAREIPAFESTPQQDQGGDDEGYYVWVGAKHGFTLNHLDSRAYLNSSVCHCLGKSCHLQFYYAMESSVLRVRLYNNKMRSKVVKLNNIDFGTLDFFTGREKHRLASLRDRVLINMLNIFLESFFNFTTKTLDFLVLYIIQEEEIFWTYNISTHSQWVKADVLIPEDLKTFKIIFEGTLLSQRSFIALDHLWVYACGQTQSRKLCSADEFPCTSGQCIAKESVCDSRQDCSDESDEDPATCSKHLTCDFESGFCGWEPFLTEDSHWKLMKGLNNGEHHFPAADHTANINHGSFIYLEAQRSPGVAKLGSPVLTKLLTASTPCQVQFWYHLSQHSNLSVFTRTSLDGNLQKQGKIIRFSESQWSHAKIDLIAEAGESTLPFQLILEATVLSSNATVALDDISVSQECEISYKSLPRTSTQSKFSKCDFEANSCDWFEAISGDHFDWIRSSQSELSADFEHQAPPRDHSLNASQGHFMFILKKSSSLWQVAKLQSPTFSQTGPGCILSFWFYNYGLSVGAAELQLHMENSHDSTVIWRVLYNQGKQWLEATIQLGRLSQPFHLSLDKVSLGIYDGVSAIDDIRFENCTLPLPAESCEGLDHFWCRHTRACIEKLRLCDLVDDCGDRTDEVNCAPELQCNFETGICNWEQDAKDDFDWTRSQGPTPTLNTGPMKDNTLGTAKGHYLYIESSEPQAFQDSAALLSPILNATDTKGCTFRFYYHMFGKRIYRLAIYQRIWSDSRGQLLWQIFGNQGNRWIRKHLNISSRQPFQILVEASVGDGFTGDIAIDDLSFMDCTLYPGNLPADLPTPPETSVPVTLPPHNCTDNEFICRSDGHCIEKMQKCDFKYDCPDKSDEASCVMEVCSFEKRSLCKWYQPIPVHLLQDSNTFRWGLGNGISIHHGEENHRPSVDHTQNTTDGWYLYADSSNGKFGDTADILTPIISLTGPKCTLVFWTHMNGATVGSLQVLIKKDNVTSKLWAQTGQQGAQWKRAEVFLGIRSHTQIVFRAKRGISYIGDVAVDDISFQDCSPLLSPERKCTDHEFMCANKHCIAKDKLCDFVNDCADNSDETTFICRTSSGRCDFEFDLCSWKQEKDEDFDWNLKASSIPAAGTEPAADHTLGNSSGHYIFIKSLFPQQPMRAARISSPVISKRSKNCKIIFHYHMYGNGIGALTLMQVSVTNQTKVLLNLTVEQGNFWRREELSLFGDEDFQLKFEGRVGKGQRGDIALDDIVLTENCLSLHDSVQEELAVPLPTGFCPLGYRECHNGKCYRLEQSCNFVDNCGDNTDENECGSSCTFEKGWCGWQNSQADNFDWVLGVGSHQSLRPPKDHTLGNENGHFMYLEATAVGLRGDKAHFRSTMWRESSAACTMSFWYFVSAKATGSIQILIKTEKGLSKVWQESKQNPGNHWQKADILLGKLRNFEVIFQGIRTRDLGGGAAIDDIEFKNCTTVGEISELCPEITDFLCRDKKCIASHLLCDYKPDCSDRSDEAHCAHYTSTTGSCNFETSSGNWTTACSLTQDSEDDLDWAIGSRIPAKALIPDSDHTPGSGQHFLYVNSSGSKEGSVARITTSKSFPASLGMCTVRFWFYMIDPRSMGILKVYTIEESGLNILVWSVIGNKRTGWTYGSVPLSSNSPFKVAFEADLDGNEDIFIALDDISFTPECVTGGPVPVQPSPCEADQFSCIYTLQCVPLSGKCDGHEDCIDGSDEMDCPLSPTPPLCSNMEFPCSTDECIPSLLLCDGVPDCHFNEDELICSNKSCSNGALVCASSNSCIPAHQRCDGFADCMDFQLDESSCSDTWTLLGIGLAFLMTHITVAVLCFLANRKVPIRKTEGSGNCAFVNPVYGNWSNPEKTESSVYSFSNPLYGTTSGSLETLSHHLK

SEQ ID NO: 60555 - protein, 83 aa, Homo sapiens
MSFFQLLMKRKELIPLVVFMTVAAGGASSFAVYSLWKTDVILDRKKNPEPWETVDPTVPQKLITINQQWKPIEELQNVQRVTK

SEQ ID NO: 60556 - protein, 83 aa, Homo sapiens; identical to SEQ ID NO: 60555

SEQ ID NO: 60557 - protein, 154 aa, Homo sapiens
MGRRSPFKPRNKVFGFSYPWCRSYQPFPRKRAWPPSRVWLGACCASLASPPKGTIPSGEYYRPAPSSSGDSLRRESGALLQYLPSLASPCANHATRCSLLFPIYKIKMTLLYLTGLARTHCCCLADRCAEAVESAFYLVGSLCINARGAAHLTD

SEQ ID NO: 60558 - protein, 275 aa, Homo sapiens
MDTILVFSLIIASYDANKKDLRDSSCRLEQLPGIFPKDVRSIRELQMQETHTETKRTTFIQNRTIATLQCLGSDSKVKVNLVYLERRPKVKHILKNLRIIAAPRRNSSASSSCHLIPTSKFQTGSLLKGKAFLPGISQCKVLGASSETFPTTAPSITPGNKEGEKTTSTDTDENLEKRQKWSIVVKILIAVTLLLSGVAIIVFVIFEVPCPYQCLGARKLCQCQWLWRWQKKGGQPPGTAESKPDSQPQKVGQDAANSSNPKKAAEITVIHQTYF

SEQ ID NO: 60559 - protein, 679 aa, Homo sapiens
MDRVTRYPILGIPQAHRGTGLVLDGDTSYTYHLVCMGPEASGWGQDEPQTWPTDHRAQQGVQRQGVSYSVHAYTGQPSPRGLHSENREDEGWQVYRLGARDAHQGRPTWALRPEDGEDKEMKTYRLDAGDADPRRLCDLERERWAVIQGQAVRKSSTVATLQGTPDHGDPRTPGPPRSTPLEENVVDREQIDFLAARQQFLSLEQANKGAPHSSPARGTPAGTTPGASQAPKAFNKPHLANGHVVPIKPQVKGVVREENKVRAVPTWASVQVVDDPGSLASVESPGTPKETPIEREIRLAQEREADLREQRGLRQATDHQELVEIPTRPLLTKLSLITAPRRERGRPSLYVQRDIVQETQREEDHRREGLHVGRASTPDWVSEGPQPGLRRALSSDSILSPAPDARAADPAPEVRKVNRIPPDAYQPYLSPGTPQLEFSAFGAFGKPSSLSTAEAKAATSPKATMSPRHLSESSGKPLSTKQEASKPPRGCPQANRGVVRWEYFRLRPLRFRAPDEPQQAQVPHVWGWEVAGAPALRLQKSQSSDLLERERESVLRREQEVAEERRNALFPEVFSPTPDENSDQNSRSSSQASGITGSYSVSESPFFSPIHLHSNVAWTVEDPVDSAPPGQRKKEQWYAGINPSDGINSEVLEAIRVTRHKNAMAERWESRIYASEEDD

SEQ ID NO: 60560 - protein, 140 aa, Homo sapiens
MGSLLHAWPQAPPPQPQQPLLGLSWDVCPEAPPHQPPPRPPCTTLPRALSADHSELQGKARLRARDVVCVLICIESLCQRHTCLEAVSGLESNSRVFTLQVQGLLQLQAGQYASVFVDNGSGAVLTIQAGSSFSGLLLGT

SEQ ID NO: 60561 - protein, 302 aa, Homo sapiens
MRRWAWAAVVVLLGPQLVLLGGVGARREAQRTQQPGQRADPPNATASASSREGLPEAPKPSQASGPEFSDAHMTWLNFVRRPDDGALRKRCGSRDKKPRDLFGPPGPPGAEVTAETLLHEFQELLKEATERRFSGLLDPLLPQGAGLRLVGEAFHCRLQGPRRVDKRTLVELHGFQAPAAQGAFLRGSGLSLASGRFTAPVSGIFQFSASLHVDHSELQGKARLRARDVVCVLICIESLCQRHTCLEAVSGLESNSRVFTLQVQGLLQLQAGQYASVFVDNGSGAVLTIQAGSSFSGLLLGT

SEQ ID NO: 60562 - protein, 302 aa, Homo sapiens; identical to SEQ ID NO: 60561

SEQ ID NO: 60563 - protein, 147 aa, Homo sapiens [sequence omitted]

SEQ ID NO: 60564 - protein, 163 aa, Homo sapiens
MKSSQTFEEQTECIVNTLLMDFLSPTLQVASRNLCCVDEVDSGEPCSFDVAIIAGRLRMLGDQFNGELEASAKNVIAETIKGQTGAILQDTVESLSKTWCAQDSSLAYERAFLAVSVKLLEYMAHIAPEVVGQVAIPMTGMINGNQAIREFIQGQGGWENLES

SEQ ID NO: 60565 - protein, 585 aa, Homo sapiens
MVCREQLSKNQVKWVFAGITCVSVVVIAAIVLAITLRRPGCELEACSPDADMLDYLLSLGQISRRDALEVTWYHAANSKKAMTAALDSNITVLEADVNVEGLGTANETGVPIMAHPPTTYSDNTLEQWLDAVLGSSQKGIKLDFKNIKAVGPSLDLLRQLTEEGKVRRPIWINADILKGPNMLISTEVNATQFLALVQEKYPKATLSPGWTTFYMSTSPNRTYTQAMVEKMHELVGGVPQRVTFPVRSSMVRAAWPHFSWLLSQSERYSLTLWQAASDPMSVEDLLYVRDNTAVHQVYYDIFEPLLSQFKQLALNATRKPMYYTGGSLIPLLQLPGDDGLNVEWLVPDVQGSGKTATMTLPDTEGMILLNTGLEGTVAENPVPIVHTPSGNILTLESCLQQLATHPGHWGIHLQIVEPAALRPSLALLARLSSLGLLHWPVWVGAKISHGSFSVPGHVAGRELLTAVAEVFPHVTVAPGWPEEVLGSGYREQLLTDMLELCQGLWQPVSFQMQAMLLGHSTAGAIGRLLASSPRATVTVEHNPAGGDYASVRTALLAARAVDRTRVYYRLPQGYHKDLLAHVGRN

SEQ ID NO: 60566 - protein, 215 aa, Homo sapiens
MRGLRWRYTRLPSQVEDTLSGEEGNEEEEEEEAAPDPAAAPEDPTVPQLTEASQVLSASEIRQLSFHFPPRVTGHPWSLVFCTSRDGFSLQSLYRRMEGCSGPVLLVLRDQDGQIFGAFSSSAIRLSKGFYGTGETFLFSFSPQLKVFKWTGSNSFFVKGDLDSLMMGSGSGRFGLWLDGDLFRGGSSPCPTFNNEVLARQEQFCIQELEAWLLS

SEQ ID NO: 60567 - protein, 142 aa, Homo sapiens
MDGGSLRASPAAMDGGALEPAQQLSSLEGWTGQDRLLIPRWREARSLSWMQSPDLESSKCLTQGRCYPQAWILACSAALLQALASSDLQGSLDRVNYSRGLGPRVRLFVFPDTVGSTRKSGSTGNICSVMLNVATGCVRIEK

SEQ ID NO: 60568 - protein, 150 aa, Homo sapiens
MNLWLLACLVAGFLGAWAPAVHTQGVFEDCCLAYHYPIGWAVLRRAWTYRIQEVSGSCNLPAAIFYLPKRHRKVCGNPKSREVQRAMKLLDARNKVFAKLHHNTQTFQAGPHAVKKLSSGNSKLSSSKFSNPISSSKRNVSLLISANSGL

SEQ ID NO: 60569 - protein, 832 aa, Homo sapiens
MILQAHLHSLCLLMLYLATGYGQEGKFSGPLKPMTFSIYEGQEPSQIIFQFKANPPAVTFELTGETDNIFVIEREGLLYYNRALDRETRSTHNLQVAALDANGIIVEGPVPITIEVKDINDNRPTFLQSKYEGSVRQNSRPGKPFLYVNATDLDDPATPNGQLYYQIVIQLPMINNVMYFQINNKTGAISLTREGSQELNPAKNPSYNLVISVKDMGGQSENSFSDTTSVDIIVTENIWKAPKPVEMVENSTDPHPIKITQVRWNDPGAQYSLVDKEKLPRFPFSIDQEGDIYVTQPLDREEKDAYVFYAVAKDEYGKPLSYPLEIHVKVKDINDNPPTCPSPVTVFEVQENERLGNSIGTLTAHDRDEENTANSFLNYRIVEQTPKLPMDGLFLIQTYAGMLQLAKQSLKKQDTPQYNLTIEVSDKDFKTLCFVQINVIDINDQIPIFEKSDYGNLTLAEDTNIGSTILTIQATDADEPFTGSSKILYHIIKGDSEGRLGVDTDPHTNTGYVIIKKPLDFETAAVSNIVFKAENPEPLVFGVKYNASSFAKFTLIVTDVNEAPQFSQHVFQAKVSEDVAIGTKVGNVTAKDPEGLDISYSLRGDTRGWLKIDHVTGEIFSVAPLDREAGSPYRVQVVATEVGGSSLSSVSEFHLILMDVNDNPPRLAKDYTGLFFCHPLSAPGSLIFEATDDDQHLFRGPHFTFSLGSGSLQNDWEVSKINGTHARLSTRHTEFEEREYVVLIRINDGGRPPLEGIVSLPVTFCSCVEGSCFRPAGHQTGIPTVGMAVGILLTTLLVIGIILAVVFIRIKKDKGKDNVESAQASEVKPLRS

SEQ ID NO: 60570 - protein, 585 aa, Homo sapiens
MGPADSWGHHWMGILLSASLCTVWSPPAAAQLTLNANPLDATQSEDVVLPVFGTPRTPQIHGRSRELAKPSIAVSPGTAIEQKDMVTFYCTTKDVNITIHWVSNNLSIVFHERMQLSKDGKILTILIVQREDSGTYQCEARDALLSQRSDPIFLDVKYGPDPVEIKLESGVASGEVVEVMEGSSMTFLAETKSHPPCAYTWFLLDSILSHTTRTFTIHAVSREHEGLYRCLVSNSATHLSSLGTLKVRVLETLTMPQVVPSSLNLVENARSVDLTCQTVNQSVNVQWFLSGQPLLPSEHLQLSADNRTLIIHGLQRNDTGPYACEVWNWGSRARSEPLELTINYGPDQVHITRESASEMISTIEAELNSSLTLQCWAESKPGAEYRWTLEHSTGEHLGEQLIIRALTWEHDGIYNCTASNSLTGLARSTSVLVKVVGPQSSSLSSGAIAGIVIGILAVIAVASELGYFLCIRNARRPSRKTTEDPSHETSQPIPKEEHPTEPSSESLSPEYCNISQLQGRIRVELMQPPDLPEETYETKLPSASRRGNSFSPWKPPPKPLMPPLRLVSTVPKNMESIYEVLGMQQ

SEQ ID NO: 60571 - protein, 623 aa, Homo sapiens
MTAQSRSPTTPTFPGPSQRTPLTPCPVQTPRLGKALIHCWTDPGQPLGEQQRVRRQRTETSEPTMRLHRLRARLSAVACGLLLLLVRGQGQDSASPIRTTHTGQVLGSLVHVKGANAGVQTFLGIPFAKPPLGPLRFAPPEPPESWSGVRDGTTHPAMCLQDLTAVESEFLSQFNMTFPSDSMSEDCLYLSIYTPAHSHEGSNLPVMVWIHGGALVFGMASLYDGSMLAALENVVVVIIQYRLGVLGFFSTGDKHATGNWGYLDQVAALRWVQQNIAHFGGNPDRVTIFGESAGGTSVSSLVVSPISQGLFHGAIMESGVALLPGLIASSADVISTVVANLSACDQVDSEALVGCLRGKSKEEILAINKPFKMIPGVVDGVFLPRHPQELLASADFQPVPSIVGVNNNEFGWLIPKVMRIYDTQKEMDREASQAALQKMLTLLMLPPTFGDLLREEYIGDNGDPQTLQAQFQEMMADSMFVIPALQVAHFQCSRAPVYFYEFQHQPSWLKNIRPPHMKADHGDELPFVFRSFFGGNYIKFTEEEEQLSRKMMKYWANFARNGNPNGEGLPHWPLFDQEEQYLQLNLQPAVGRALKAHRLQFWKKALPQKIQELEEPEERHTEL

SEQ ID NO: 60572 - protein, 607 aa, Homo sapiens
MTAQSRSPTTPTFPGPSQRTPLTPCPVQTPRLGKALIHCWTDPGQPLGEQQRVRRQRTETSEPTMRLHRLRARLSAVACGLLLLLVRGQGQDSASPIRTTHTGQVLGSLVHVKGANAGVQTFLGIPFAKPPLGPLRFAPPEPPESWSGVRDGTTHPAMCLQDLTAVESEFLSQFNMTFPSDSMSEDCLYLSIYTPAHSHEGSNLPVMVWIHGGALVFGMASLYDGSMLAALENVVVVIIQYRLGVLGFFSTGDKHATGNWGYLDQVAALRWVQQNIAHFGGNPDRVTIFGESAGGTSVSSLVVSPISQGLFHGAIMESGVALLPGLIASSADVISTVVANLSACDQVDSEALVGCLRGKSKEEILAINKPFKMIPGVVDGVFLPRHPQELLASADFQPVPSIVGVNNNEFGWLIPKVMRIYDTQKEMDREASQAALQKMLTLLMLPPTFGDLLREEYIGDNGDPQTLQAQFQEMMADSMFVIPALQVAHFQCSRAPVYFYEFQHQPSWLKNIRPPHMKADHVKFTEEEEQLSRKMMKYWANFARNGNPNGEGLPHWPLFDQEEQYLQLNLQPAVGRALKAHRLQFWKKALPQKIQELEEPEERHTEL

SEQ ID NO: 60573 - protein, 374 aa, Homo sapiens
MKPLLETLYLLGMLVPGGLGYDRSLAQHRQEIVDKSVSPWSLETYSYNIYHPMGEIYEWMREISEKYKEVVTQHFLGVTYETHPMYYLKISQPSGNPKKIIWMDCGIHAREWIAPAFCQWFVKEILQNHKDNSSIRKLLRNLDFYVLPVLNIDGYIYTWTTDRLWRKSRSPHNNGTCFGTDLNRNFNASWCSIGASRNCQDQTFCGTGPVSEPETKAVASFIESKKDDILCFLTMHSYGQLILTPYGYTKNKSSNHPEMIQVGQKAANALKAKYGTNYRVGSSADILYASSGSSRDWARDIGIPFSYTFELRDSGTYGFVLPEAQIQPTCEETMEAVLSVLDDVYAKHWHSDSAGRVTSATMLLGLLVSCMSLL

SEQ ID NO: 60574 - protein, 3623 aa, Homo sapiens
MMNMSLPFLWSLLTLLIFAEVNGERGELELQRQKRSINLQQPRMATERGNLVFLTGSAQNIEFRTGSLGKIKLNDEDLSECLHQIQKNKEDIIELKGSAIGLPQNISSQIYQLNSKLVDLERKFQGLQQTVDKKVCSSNPCQNGGNCLNLHDSFFCICPPQWKGPLCSADVNECEIYSGTPLSCQNGGTCVNTMGSYSCHCPPETYGPQCASKYDDCEGGSVARCVHGICEDLMREQAGEPKYSCVCDAGWMSSPNSPACTLDRDECSFQPGPCSTLVQCFNTQGSFYCGACPTGWQGNGYICEDINECEINNGGCSVAPPVECVNTPGSSHCQACPPGYQGDGRVCTLTDICSVSNGGCHPDASCSSTLGSLPLCTCLPGYTGNGYGPNGCVQLSNICLSHPCLNGQCIDTVSGYFCKCDSGWTGVNCTENINECLSNPCLNGGTCVDGVDSFSCECTRLWTGALCQVPQQVCGESLSGINGSFSYRSPDVGYVHDVNCFWVIKTEMGKVLRITFTFFRLESMDNCPHEFLQVYDGDSSSAFQLGRFCGSSLPHELLSSDNALYFHLYSEHLRNGRGFTVRWETQQPECGGILTGPYGSIKSPGYPGNYPPGRDCVWIVVTSPDLLVTFTFGTLSLEHHDDCNKDYLEIRDGPLYQDPLLGKFCTTFSVPPLQTTGPFARIHFHSDSQISDQGFHITYLTSPSDLRCGGNYTDPEGELFLPELSGPFTHTRQCVYMMKQPQGEQIQINFTHVELQCQSDSSQNYIEVRDGETLLGKVCGNGTISHIKSITNSVWIRFKIDASVEKASFRAVYQVACGDELTGEGVIRSPFFPNVYPGERTCRWTIHQPQSQVILLNFTVFEIGSSAHCETDYVEIGSSSILGSPENKKYCGTDIPSFITSVYNFLYVTFVKSSSTENHGFMAKFSAEDLACGEILTESTGTIQSPGHPNVYPHGINCTWHILVQPNHLIHLMFETFHLEFHYNCTNDYLEVYDTDSETSLGRYCGKSIPPSLTSSGNSLMLVFVTDSDLAYEGFLINYEAISAATACLQDYTDDLGTFTSPNFPNNYPNNWECIYRITVRTGQLIAVHFTNFSLEEAIGNYYTDFLEIRDGGYEKSPLLGIFYGSNLPPTIISHSNKLWLKFKSDQIDTRSGFSAYWDGSSTGCGGNLTTSSGTFISPNYPMPYYHSSECYWWLKSSHGSAFELEFKDFHLEHHPNCTLDYLAVYDGPSSNSHLLTQLCGDEKPPLIRSSGDSMFIKLRTDEGQQGRGFKAEYRQTCENVVIVNQTYGILESIGYPNPYSENQHCNWTIRATTGNTVNYTFLAFDLEHHINCSTDYLELYDGPRQMGRYCGVDLPPPGSTTSSKLQVLLLTDGVGRREKGFQMQWFVYGCGGELSGATGSFSSPGFPNRYPPNKECIWYIRTDPGSSIQLTIHDFDVEYHSRCNFDVLEIYGGPDFHSPRIAQLCTQRSPENPMQVSSTGNELAIRFKTDLSINGRGFNASWQAVTGGCGGIFQAPSGEIHSPNYPSPYRSNTDCSWVIRVDRYHRVLLNFTDFDLEPQDSCIMAYDGLSSTMSRLARTCGREQLANPIVSSGNSLFLRFQSGPSRQNRGFRAQFRQACGGHILTSSFDTVSSPRFPANYPNNQNCSWIIQAQPPLNHITLSFTHFELERSTTCARDFVEILDGGHEDAPLRGRYCGTDMPHPITSFSSALTLRFVSDSSISAGGFHTTVTASVSACGGTFYMAEGIFNSPGYPDIYPPNVECVWNIISSPGNRLQLSFISFQLEDSQDCSRDFVEIREGNATGHLVGRYCGNSFPLNYSSIVGHTLWVRFISDGSGSGTGFQATFMKIFGNDNIVGTHGKVASPFWPENYPHNSNYQWTVNVNASHVVHGRILEMDIEEIQNCYYDKLRIYDGPSIHARLIGAYCGTQTESFSSTGNSLTFHFYSDSSISGKGFLLEWFAVDAPDGVLPTIAPGACGGFLRTGDAPVFLFSPGWPDSYSNRVDCTWLIQAPDSTVELNILSLDIESHRTCAYDSLVIRDGDNNLAQQLAVLCGREIPGPIRSTGEYMFIRFTSDSSVTRAGFNASFHKSCGGYLHADRGIITSPKYPETYPSNLNCSWHVLVQSGLTIAVHFEQPFQIPNGDSSCNQGDYLVLRNGPDIYSPPLGPPGGNGHFCGSHASSTLFTSDNQMFVQFISDHSNEGQGFKIKYEAKSLACGGNVYIHDADSAGYVTSPNHPHNYPPHADCIWILAAPPETRIQLQFEDRFDIEVTPNCTSNYLELRDGVDSDAPILSKFCGTSLPSSQWSSGEVMYLRFRSDNSPTHVGFKAKYSIAQCGGRVPGQSGVVESIGHPTLPYRDNLFCEWHLQGLSGHYLTISFEDFNLQNSSGCEKDFVEIWDNHTSGNILGRYCGNTIPDSIDTSSNTAVVRFVTDGSVTASGFRLRFESSMEECGGDLQGSIGTFTSPNYPNPNPHGRICEWRITAPEGRRITLMFNNLRLATHPSCNNEHVIVFNGIRSNSPQLEKLCSSVNVSNEIKSSGNTMKVIFFTDGSRPYGGFTASYTSSEDAVCGGSLPNTPEGNFTSPGYDGVRNYSRNLNCEWTLSNPNQGNSSISIHFEDFYLESHQDCQFDVLEFRVGDADGPLMWRLCGPSKPTLPLVIPYSQVWIHFVTNERVEHIGFHAKYSFTDCGGIQIGDSGVITSPNYPNAYDSLTHCSWLLEAPQGHTITLTFSDFDIEPHTTCAWDSVTVRNGGSPESPIIGQYCGNSNPRTIQSGSNQLVVTFNSDHSLQGGGFYATWNTQTLGCGGIFHSDNGTIRSPHWPQNFPENSRCSWTAITHKSKHLEISFDNNFLIPSGDGQCQNSFVKVWAGTEEVDKALLATGCGNVAPGPVITPSNTFTAVFQSQEAPAQGFSASFVSRCGSNFTGPSGYIISPNYPKQYDNNMNCTYVIEANPLSVVLLTFVSFHLEARSAVTGSCVNDGVHIIRGYSVMSTPFATVCGDEMPAPLTIAGPVLLNFYSNEQITDFGFKFSYRIISCGGVFNFSSGIITSPAYSYADYPNDMHCLYTITVSDDKVIELKFSDFDVVPSTSCSHDYLAIYDGANTSDPLLGKFCGSKRPPNVKSSNNSMLLVFKTDSFQTAKGWKMSFRQTLGPQQGCGGYLTGSNNTFASPDSDSNGMYDKNLNCVWIIIAPVNKVIHLTFNTFALEAASTRQRCLYDYVKLYDGDSENANLAGTFCGSTVPAPFISSGNFLTVQFISDLTLEREGFNATYTIMDMPCGGTYNATWTPQNISSPNSSDPDVPFSICTWVIDSPPHQQVKITVWALQLTSQDCTQNYLQLQDSPQGHGNSRFQFCGRNASAVPVFYSSMSTAMVIFKSGVVNRNSRMSFTYQIADCNRDYHKAFGNLRSPGWPDNYDNDKDCTVTLTAPQNHTISLFFHSLGIENSVECRNDFLEVRNGSNSNSPLLGKYCGTLLPNPVFSQNNELYLRFKSDSVTSDRGYEIIWTSSPSGCGGTLYGDRGSFTSPGYPGTYPNNTYCEWVLVAPAGRLVTINFYFISIDDPGDCVQNYLTLYDGPNASSPSSGPYCGGDTSIAPFVASSNQVFIKFHADYARRPSAFRLTWDS

SEQ ID NO: 60575 - protein, 480 aa, Homo sapiens
MNASEFRRRGKEMVDYVANYMEGIEGRQVYPDVEPGYLRPLIPAAAPQEPDTFEDIINDVEKIIMPGVTHWHSPYFFAYFPTASSYPAMLADMLCGAIGCIGFSWAASPACTELETVMMDWLGKMLELPKAFLNEKAGEGGGVIQGSASEATLVALLAARTKVIHRLQAASPELTQAAIMEKLVAYSSDQAHSSVERAGLIGGVKLKAIPSDGNFAMRASALQEALERDKAAGLIPFFMVATLGTTTCCSFDNLLEVGPICNKEDIWLHVDAAYAGSAFICPEFRHLLNGVEFADSFNFNPHKWLLVNFDCSAMWVKKRTDLTGAFRLDPTYLKHSHQDSGLITDYRHWQIPLGRRFRSLKMWFVFRMYGVKGLQAYIRKHVQLSHEFESLVRQDPRFEICVEVILGLVCFRLKGSNKVNEALLQRINSAKKIHLVPCHLRDKFVLRFAICSRTVESAHVQRAWEHIKELAADVLRAERE

SEQ ID NO: 60576 - protein, 282 aa, Homo sapiens [sequence omitted]

SEQ ID NO: 60577 - protein, 411 aa, Homo sapiens
MWSGWWLWPLVAVCTADFFRDEAERIMRDSPVIDGHNDLPWQLLDMFNNRLQDERANLTTLAGTHTNIPKLRAGFVGGQFWSVYTPCDTQNKDAVRRTLEQMDVVHRMCRMYPETFLYVTSSAGIRQAFREGKVASLIGVEGGHSIDSSLGVLRALYQLGMRYLTLTHSCNTPWADNWLVDTGDSEPQSQGLSPFGQRVVKELNRLGVLIDLAHVSVATMKATLQLSRAPVIFSHSSAYSVCASRRNVPDDVLRLVKQTDSLVMVNFYNNYISCTNKANLSQVADHLDHIKEVAGARAVGFGGDFDGVPRVPEGLEDVSKYPDLIAELLRRNWTEAEVKGALADNLLRVFEAVEQASNLTQAPEEEPIPLDQLGGSCRTHYGYSSGASSLHRHWGLLLASLAPLVLCLSLL

SEQ ID NO: 60578 - protein, 766 aa, Homo sapiens
MKTPWKVLLGLLGAAALVTIITVPVVLLNKGTDDATADSRKTYTLTDYLKNTYRLKLYSLRWISDHEYLYKQENNILVFNAEYGNSSVFLENSTFDEFGHSINDYSISPDGQFILLEYNYVKQWRHSYTASYDIYDLNKRQLITEERIPNNTQWVTWSPVGHKLAYVWNNDIYVKIEPNLPSYRITWTGKEDIIYNGITDWVYEEEVFSAYSALWWSPNGTFLAYAQFNDTEVPLIEYSFYSDESLQYPKTVRVPYPKAGAVNPTVKFFVVNTDSLSSVTNATSIQITAPASMLIGDHYLCDVTWATQERISLQWLRRIQNYSVMDICDYDESSGRWNCLVARQHIEMSTTGWVGRFRPSEPHFTLDGNSFYKIISNEEGYRHICYFQIDKKDCTFITKGTWEVIGIEALTSDYLYYISNEYKGMPGGRNLYKIQLSDYTKVTCLSCELNPERCQYYSVSFSKEAKYYQLRCSGPGLPLYTLHSSVNDKGLRVLEDNSALDKMLQNVQMPSKKLDFIILNETKFWYQMILPPHFDKSKKYPLLLDVYAGPCSQKADTVFRLNWATYLASTENIIVASFDGRGSGYQGDKIMHAINRRLGTFEVEDQIEAARQFSKMGFVDNKRIAIWGWSYGGYVTSMVLGSGSGVFKCGIAVAPVSRWEYYDSVYTERYMGLPTPEDNLDHYRNSTVMSRAENFKQVEYLLIHGTADDNVHFQQSAQISKALVDVGVDFQAMWYTDEDHGIASSTAHQHIYTHMSHFIKQCFSLP

SEQ ID NO: 60579 - protein, 957 aa, Homo sapiens
MNFAEREGSKRYCIQTKHVAILCAVVVGVGLIVGLAVGLTRSCDSSGDGGPGTAPAPSHLPSSTASPSGPPAQDQDICPASEDESGQWKNFRLPDFVNPVHYDLHVKPLLEEDTYTGTVSISINLSAPTRYLWLHLRETRITRLPELKRPSGDQVQVRRCFEYKKQEYVVVEAEEELTPSSGDGLYLLTMEFAGWLNGSLVGFYRTTYTENGRVKSIVATDHEPTDARKSFPCFDEPNKKATYTISITHPKEYGALSNMPVAKEESVDDKWTRTTFEKSVPMSTYLVCFAVHQFDSVKRISNSGKPLTIYVQPEQKHTAEYAANITKSVFDYFEEYFAMNYSLPKLDKIAIPDFGTGAMENWGLITYRETNLLYDPKESASSNQQRVATVVAHELVHQWFGNIVTMDWWEDLWLNEGFASFFEFLGVNHAETDWQMRDQMLLEDVLPVQEDDSLMSSHPIIVTVTTPDEITSVFDGISYSKGSSILRMLEDWIKPENFQKGCQMYLEKYQFKNAKTSDFWAALEEASRLPVKEVMDTWTRQMGYPVLNVNGVKNITQKRFLLDPRANPSQPPSDLGYTWNIPVKWTEDNITSSVLFNRSEKEGITLNSSNPSGNAFLKINPDHIGFYRVNYEVATWDSIATALSLNHKTFSSADRASLIDDAFALARAQLLDYKVALNLTKYLKREENFLPWQRVISAVTYIISMFEDDKELYPMIEEYFQGQVKPIADSLGWNDAGDHVTKLLRSSVLGFACKMGDREALNNASSLFEQWLNGTVSLPVNLRLLVYRYGMQNSGNEISWNYTLEQYQKTSLAQEKEKLLYGLASVKNVTLLSRYLDLLKDTNLIKTQDVFTVIRYISYNSYGKNMAWNWIQLNWDYLVNRYTLNNRNLGRIVTIAEPFNTELQLWQMESFFAKYPQAGAGEKPREQVLETVKNNIEWLKQHRNTIREWFFNLLESG

SEQ ID NO: 60580 - protein, 458 aa, Homo sapiens
MRGLAVLLTVALATLLAPGAGAPVQSQGSQNKLLLVSFDGFRWNYDQDVDTPNLDAMARDGVKARYMTPAFVTMTSPCHFTLVTGKYIENHGVVHNMYYNTTSKVKLPYHATLGIQRWWDNGSVPIWITAQRQGLRAGSFFYPGGNVTYQGVAVTRSRKEGIAHNYKNETEWRANIDTVMAWFTEEDLDLVTLYFGEPDSTGHRYGPESPERREMVRQVDRTVGYLRESIARNHLTDRLNLIITSDHGMTTVDKRAGDLVEFHKFPNFTFRDIEFELLDYGPNGMLLPKEGRLEKVYDALKDAHPKLHVYKKEAFPEAFHYANNPRVTPLLMYSDLGYVIHGRINVQFNNGEHGFDNKDMDMKTIFRAVGPSFRAGLEVEPFESVHVYELMCRLLGIVPEANDGHLATLLPMLHTESALPPDGRPTLLPKGRSALPPSSRPLLVMGLLGTVILLSEVA

SEQ ID NO: 60581 - protein, 458 aa, Homo sapiens
MGLSRKEQVFLALLGASGVSGLTALILLLVEATSVLLPTDIKFGIVFDAGSSHTSLFLYQWPANKENGTGVVSQALACQVEGPGISSYTSNAAQAGESLQGCLEEALVLIPEAQHRKTPTFLGATAGMRLLSRKNSSQARDIFAAVTQVLGRSPVDFWGAELLAGQAEGAFGWITVNYGLGTLVKYSFTGEWIQPPEEMLVGALDMGGASTQITFVPGGPILDKSTQADFRLYGSDYSVYTHSYLCFGRDQMLSRLLVGLVQSRPAALLRHPCYLSGYQTTLALGPLYESPCVHATPPLSLPQNLTVEGTGNPGACVSAIRELFNFSSCQGQEDCAFDGVYQPPLRGQFYVEASYPGQDRWLRDYCASGLYILTLLHEGYGFSEETWPSLEFRKQAGGVDIGWTLGYMLNLTGMIPADAPAQWRAESYGVWVAKVVFMVLALVAVVGAALVQLFWLQD

SEQ ID NO: 60582 - protein, 563 aa, Homo sapiens
MSRPSSRAIYLHRKEYSQNLTSEPTLLQHRVEHLMTCKQGSQRVQGPEDALQKLFEMDAQGRVWSQDLILQVRDGWLQLLDIETKEELDSYRLDSIQAMNVALNTCSYNSILSITVQEPGLPGTSTLLFQCQEVGAERLKTSLQKALEEELEQRPRLGGLQPGQDRWRGPAMERPLPMEQARYLEPGIPPEQPHQRTLEHSLPPSPRPLPRHTSAREPSAFTLPPPRRSSSPEDPERDEEVLNHVLRDIELFMGKLEKAQAKTSRKKKFGKKNKDQGGLTQAQYIDCFQKIKHSFNLLGRLATWLKETSAPELVHILFKSLNFILARCPEAGLAAQVISPLLTPKAINLLQSCLSPPESNLWMGLGPAWTTSRADWTGDEPLPYQPTFSDDWQLPEPSSQAPLGYQDPVSLRPSSPKPAQPALKMQVLYEFEARNPRELTVVQGEKLEVLDHSKRWWLVKNEAGRSGYIPSNILEPLQPGTPGTQGQSPSRVPMLRLSSRPEEVTDWLQAENFSTATVRTLGSLTGSQLLRIRPGELQMLCPQEAPRILSRLEAVRRMLGISP

SEQ ID NO: 60583 - protein, 593 aa, Homo sapiens
MSRPSSRAIYLHRKEYSQNLTSEPTLLQHRVEHLMTCKQGSQRVQGPEDALQKLFEMDAQGRVWSQDLILQVRDGWLQLLDIETKEELDSYRLDSIQAMNVALNTCSYNSILSITVQEPGLPGTSTLLFQCQEVGAERLKTSLQKALEEELEQRPRLGGLQPGQDRWRGPAMERPLPMEQARYLEPGIPPEQPHQRTLEHSLPPSPRPLPRHTSAREPSAFTLPPPRRSSSPEDPERDEEVLNHVLRDIELFMGKLEKAQAKTSRKKKFGKKNKDQGGLTQAQYIDCFQKIKHSFNLLGRLATWLKETSAPELVHILFKSLNFILARCPEAGLAAQVISPLLTPKAINLLQSCLSPPESNLWMGLGPAWTTSRADWTGDEPLPYQPTFSDDWQLPEPSSQAPLGYQDPVSLRRGSHRLGSTSHFPQEKTHNHDPQPGDPNSRPSSPKPAQPALKMQVLYEFEARNPRELTVVQGEKLEVLDHSKRWWLVKNEAGRSGYIPSNILEPLQPGTPGTQGQSPSRVPMLRLSSRPEEVTDWLQAENFSTATVRTLGSLTGSQLLRIRPGELQMLCPQEAPRILSRLEAVRRMLGISP

SEQ ID NO: 60584 - protein, 594 aa, Homo sapiens
MSRPSSRAIYLHRKEYSQNLTSEPTLLQHRVEHLMTCKQGSQRVQGPEDALQKLFEMDAQGRVWSQDLILQVRDGWLQLLDIETKEELDSYRLDSIQAMNVALNTCSYNSILSITVQEPGLPGTSTLLFQCQEVGAERLKTSLQKALEEELEQSRPRLGGLQPGQDRWRGPAMERPLPMEQARYLEPGIPPEQPHQRTLEHSLPPSPRPLPRHTSAREPSAFTLPPPRRSSSPEDPERDEEVLNHVLRDIELFMGKLEKAQAKTSRKKKFGKKNKDQGGLTQAQYIDCFQKIKHSFNLLGRLATWLKETSAPELVHILFKSLNFILARCPEAGLAAQVISPLLTPKAINLLQSCLSPPESNLWMGLGPAWTTSRADWTGDEPLPYQPTFSDDWQLPEPSSQAPLGYQDPVSLRRGSHRLGSTSHFPQEKTHNHDPQPGDPNSRPSSPKPAQPALKMQVLYEFEARNPRELTVVQGEKLEVLDHSKRWWLVKNEAGRSGYIPSNILEPLQPGTPGTQGQSPSRVPMLRLSSRPEEVTDWLQAENFSTATVRTLGSLTGSQLLRIRPGELQMLCPQEAPRILSRLEAVRRMLGISP

SEQ ID NO: 60585 - protein, 128 aa, Homo sapiens
MAFTGKFEMESEKNYDEFMKLLGISSDVIEKARNFKIVTEVQQDGQDFTWSQHYSGGHTMTNKFTVGKESNIQTMGGKTFKATVQMEGGKLVVNFPNYHQTSEIVGDKLVEVSTIGGVTYERVSKRLA

SEQ ID NO: 60586 - protein, 374 aa, Homo sapiens
MEPTEPMEPTEPMEPTEPMEPTEPMEPTEPMEPTEPMEPARSAHRGGEALLRELEVLVQDVVRTSSWWERHGVDCAILALSLFALPAGFLCLRWENALVFASGITILGVCHYTLTVKGSHLATHGALTESKRWSKIWLLFFVEVCTAFTAEHATHGHVKMHHAYTNVVGLGDSSTWRLPCLNRYVYMFLAPFLLPIATPLVAVERLRKVELGTALRTLALISLGLYSHYWLLLNVSGFKNPSSALGCMFLTRSLLAHPYLHVNIFQHIGLPMFSRDNKPRRIHMMSLGVLNLARLPVLDWAFGHSIISCHVEHHLFPRLSDNMCLKVEPVVSQFLREKQLPYNEDSYLARFQLFLRRYEEFMVQAPPITELVGL

SEQ ID NO: 60587 - protein, 175 aa, Homo sapiens
MRLPGAPALPDADFLVHLHFLVQTSWFICNFLVRIPWASALPDAPALLVILEKTFPEHATCRGCWVSGYLCWTAPGNCICSANVGFLKIENTYRQIHHTHMHRHTHTHTDKSITHTCTDTHTQSQRHRLTSRALRLFILNAITDTSKFGAAVFFYVYCLFADSVYKFFPFLPPFR

SEQ ID NO: 60588 - protein, 797 aa, Homo sapiens
MASCRAWNLRVLVAVVCGLLTGIILGLGIWRIVIRIQRGKSTSSSSTPTEFCRNGGTWENGRCICTEEWKGLRCTIANFCENSTYMGFTFARIPVGRYGPSLQTCGKDTPNAGNPMAVRLCSLSLYGEIELQKVTIGNCNENLETLEKQVEDVTAPLNNISSEVQILTSDANKLTAENITSATRVVGQIFNTSRNASPEAKKVAIVTVSQLLDASEDAFQRVAATANDDALTTLIEQMETYSLSLGNQSVVEPNIAIQSANFSSENAVGPSNVRFSVQKGASSSLVSSSTFIHTNVDGLNPDAQTELQVLLNMTKNYTKTCGFVVYQNDKLFQSKTFTAKSDFSQKIISSKTDENEQDQSASVDMVFSPKYNQKEFQLYSYACVYWNLSAKDWDTYGCQKDKGTDGFLRCRCNHTTNFAVLMTFKKDYQYPKSLDILSNVGCALSVTGLALTVIFQIVTRKVRKTSVTWVLVNLCISMLIFNLLFVFGIENSNKNLQTSDGDINNIDFDNNDIPRTDTINIPNPMCTAIAALLHYFLLVTFTWNALSAAQLYYLLIRTMKPLPRHFILFISLIGWGVPAIVVAITVGVIYSQNGNNPQWELDYRQEKICWLAIPEPNGVIKSPLLWSFIVPVTIILISNVVMFITISIKVLWKNNQNLTSTKKVSSMKKIVSTLSVAVVFGITWILAYLMLVNDDSIRIVFSYIFCLFNTTQGLQIFILYTVRTKVFQSEASKVLMLLSSIGRRKSLPSVTRPRLRVKMYNFLRSLPTLHERFRLLETSPSTEEITLSESDNAKESI

SEQ ID NO: 60589 - protein, 448 aa, Homo sapiens
MAAPTLGRLVLTHLLVALFGMGSWAAVNGIWVELPVVVKDLPEGWSLPSYLSVVVALGNLGLLVVTLWRRLAPGKGEQVPIQVVQVLSVVGTALLAPLWHHVAPVAGQLHSVAFLTLALVLAMACCTSNVTFLPFLSHLPPPFLRSFFLGQGLSALLPCVLALVQGVGRLECPPAPTNGTSGPPLDFPERFPASTFFWALTALLVTSAAAFRGLLLLLPSLPSVTTGGSGPELQLGSPGAEEEEKEEEEALPLQEPPSQAAGTIPGPDPEVHQLFSAHGAFLLGLMAFTSAVTNGVLPSVQSFSCLPYGRLAYHLAVVLGSAANPLACFLAMGVLCRSLAGLVGLSLLGMLFGAYLMALAILSPCPPLVGTTAGVVLVVLSWVLCLCVFSYVKVAASSLLHGGGRPALLAAGVAIQVGSLLGAGAMFPPTSIYHVFQSRKDCVDPCGP

SEQ ID NO: 60590 - protein, 1073 aa, Homo sapiens
MKTLLLDLALWSLLFQPGWLSFSSQVSQNCHNGSYEISVLMMGNSAFAEPLKNLEDAVNEGLEIVRGRLQNAGLNVTVNATFMYSDGLIHNSGDCRSSTCEGLDLLRKISNAQRMGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELGFKVVLRQDKEFQDILMDHNRKSNVIIMCGGPEFLYKLKGDRAVAEDIVIILVDLFNDQYLEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQILMIAVFTLTGAVVLLLLVALLMLRKYRKDYELRQKKWSHIPPENIFPLETNETNHVSLKIDDDKRRDTIQRLRQCKYDKKRVILKDLKHNDGNFTEKQKIELNKLLQIDYYNLTKFYGTVKLDTMIFGVIEYCERGSLREVLNDTISYPDGTFMDWEFKISVLYDIAKGMSYLHSSKTEVHGRLKSTNCVVDSRMVVKITDFGCNSILPPKKDLWTAPEHLRQANISQKGDVYSYGIIAQEIILRKETFYTLSCRDRNEKIFRVENSNGMKPFRPDLFLETAEEKELEVYLLVKNCWEEDPEKRPDFKKIETTLAKIFGLFHDQKNESYMDTLIRRLQLYSRNLEHLVEERTQLYKAERDRADRLNFMLLPRLVVKSLKEKGFVEPELYEEVTIYFSDIVGFTTICKYSTPMEVVDMLNDIYKSFDHIVDHHDVYKVETIGDAYMVASGLPKRNGNRHAIDIAKMALEILSFMGTFELEHLPGLPIWIRIGVHSGPCAAGVVGIKMPRYCLFGDTVNTASRMESTGLPLRIHVSGSTIAILKRTECQFLYEVRGETYLKGRGNETTYWLTGMKDQKFNLPTPPTVENQQRLQAEFSDMIANSLQKRQAAGIRSQKPRRVASYKKGTLEYLQLNTTDKESTYF

SEQ ID NO: 60591 - protein, 408 aa, Homo sapiens
MNTTDNGVNCLCAICGDRATGKHYGASSCDGCKGFFRRSIRKSHVYSCRFSRQCVVDKDKRNQCRYCRLRKCFRAGMKKEAVQNERDRISTRRSTFDGSNIPSINTLAQAEVRSRQISVSSPGSSTDINVKKIASIGDVCESMKQQLLVLVEWAKYIPAFCELPLDDQVALLRAHAGEHLLLGATKRSMMYKDILLLGNNYVIHRNSCEVEISRVANRVLDELVRPFQEIQIDDNEYACLKAIVFFDPDAKGLSDPVKIKNMRFQVQIGLEDYINDRQYDSRGRFGELLLLLPTLQSITWQMIEQIQFVKLFGMVKIDNLLQEMLLGGASNDGSHLHHPMHPHLSQDPLTGQTILLGPMSTLVHADQISTPETPLPSPPQGSGQEQYKIAANQASVISHQHLSKQKQL

SEQ ID NO: 60592 - protein, 387 aa, Homo sapiens
MSTFFSDTAWICLAVPTVLCGTVFCKYKKSSGQLWSWMVCLAGLCAVCLLILSPFWGLILFSVSCFLMYTYLSGQELLPVDQKAVLVTGGDCGLGHALCKYLDELGFTVFAGVLNENGPGAEELRRTCSPRLSVLQMDITKPVQIKDAYSKVAAMLQDRGLWAVINNAGVLGFPTDGELLLMTDYKQCMAVNFFGTVEVTKTFLPLLRKSKGRLVNVSSMGGGAPMERLASYGSSKAAVTMFSSVMRLELSKWGIKVASIQPGGFLTNIAGTSDKWEKLEKDILDHLPAEVQEDYGQDYILAQRNFLLLINSLASKDFSPVLRDIQHAILAKSPFAYYTPGKGAYLWICLAHYLPIGIYDYFAKRHFGQDKPMPRALRMPNYKKKAT

SEQ ID NO: 60593 - protein, 298 aa, Homo sapiens
MEEKQILCVGLVVLDVISLVDKYPKEDSEIRCLSQRWQRGGNASNSCTVLSLLGAPCAFMGSMAPGHVADFVLDDLRRYSVDLRYTVFQTTGSVPIATVIINEASGSRTILYYDRSLPDVSATDFEKVDLTQFKWIHIEGRNASEQVKMLQRIDAHNTRQPPEQKIRVSVEVEKPREELFQLFGYGDVVFVSKDVAKHLGFQSAEEALRGLYGRVRKGAVLVCAWAEEGADALGPDGKLLHSDAFPPPRVVDTLGAGDTFNASVIFSLSQGRSVQEALRFGCQVAGKKCGLQGFDGIV

SEQ ID NO: 60594 - protein, 298 aa, Homo sapiens
MEEKQILCVGLVVLDVISLVDKYPKEDSEIRCLSQRWQRGGNASNSCTVLSLLGAPCAFMGSMAPGHVADFLVADFRRRGVDVSQVAWQSKGDTPSSCCIINNSNGNRTIVLHDTSLPDVSATDFEKVDLTQFKWIHIEGRNASEQVKMLQRIDAHNTRQPPEQKIRVSVEVEKPREELFQLFGYGDVVFVSKDVAKHLGFQSAEEALRGLYGRVRKGAVLVCAWAEEGADALGPDGKLLHSDAFPPPRVVDTLGAGDTFNASVIFSLSQGRSVQEALRFGCQVAGKKCGLQGFDGIV

SEQ ID NO: 60595 - protein, 424 aa, Homo sapiens
MDFSRRSFHRSLSSSLQAPVVSTVGMQRLGTTPSVYGGAGGRGIRISNSRHTVNYGSDLTGGGDLFVGNEKMAMQNLNDRLASYLEKVRTLEQSNSKLEVQIKQWYETNAPRAGRDYSAYYRQIEELRSQIKDAQLQNARCVLQIDNAKLAAEDFRLKYETERGIRLTVEADLQGLNKVFDDLTLHKTDLEIQIEELNKDLALLKKEHQEEVDGLHKHLGNTVNVEVDAAPGLNLGVIMNEMRQKYEVMAQKNLQEAKEQFERQTAVLQQQVTVNTEELKGTEVQLTELRRTSQSLEIELQSHLSMKESLEHTLEETKARYSSQLANLQSLLSSLEAQLMQIRSNMERQNNEYHILLDIKTRLEQEIATYRRLLEGEDVKTTEYQLSTLEERDIKKTRKIKTVVQEVVDGKVVSSEVKEVEENI

SEQ ID NO: 60596 - protein, 1927 aa, Homo sapiens
MELSWHVVFIALLSFSCWGSDWESDRNFISTAGPLTNDLLHNLSGLLGDQSSNFVAGDKDMYVCHQPLPTFLPEYFSSLHASQITHYKVFLSWAQLLPAGSTQNPDEKTVQCYRRLLKALKTARLQPMVILHHQTLPASTLRRTEAFADLFADYATFAFHSFGDLVGIWFTFSDLEEVIKELPHQESRASQLQTLSDAHRKAYEIYHESYAFQGGKLSVVLRAEDIPELLLEPPISALAQDTVDFLSLDLSYECQNEASLRQKLSKLQTIEPKVKVFIFNLKLPDCPSTMKNPASLLFSLFEAINKDQVLTIGFDINEFLSCSSSSKKSMSCSLTGSLALQPDQQQDHETTDSSPASAYQRIWEAFANQSRAERDAFLQDTFPEGFLWGASTGAFNVEGGWAEGGRGVSIWDPRRPLNTTEGQATLEVASDSYHKVASDVALLCGLRAQVYKFSISWSRIFPMGHGSSPSLPGVAYYNKLIDRLQDAGIEPMATLFHWDLPQALQDHGGWQNESVVDAFLDYAAFCFSTFGDRVKLWVTFHEPWVMSYAGYGTGQHPPGISDPGVASFKVAHLVLKAHARTWHHYNSHHRPQQQGHVGIVLNSDWAEPLSPERPEDLRASERFLHFMLGWFAHPVFVDGDYPATLRTQIQQMNRQCSHPVAQLPEFTEAEKQLLKGSADFLGLSHYTSRLISNAPQNTCIPSYDTIGGFSQHVNHVWPQTSSSWIRVVPWGIRRLLQFVSLEYTRGKVPIYLAGNGMPIGESENLFDDSLRVDYFNQYINEVLKAIKEDSVDVRSYIARSLIDGFEGPSGYSQRFGLHHVNFSDSSKSRTPRKSAYFFTSIIEKNGFLTKGAKRLLPPNTVNLPSKVRAFTFPSEVPSKAKVVWEKFSSQPKFERDLFYHGTFRDDFLWGVSSSAYQIEGAWDADGKGPSIWDNFTHTPGSNVKDNATGDIACDSYHQLDADLNMLRALKVKAYRFSISWSRIFPTGRNSSINSHGVDYYNRLINGLVASNIFPMVTLFHWDLPQALQDIGGWENPALIDLFDSYADFCFQTFGDRVKFWMTFNEPMYLAWLGYGSGEFPPGVKDPGWAPYRIAHAVIKAHARVYHTYDEKYRQEQKGVISLSLSTHWAEPKSPGVPRDVEAADRMLQFSLGWFAHPIFRNGDYPDTMKWKVGNRSELQHLATSRLPSFTEEEKRFIRATADVFCLNTYYSRIVQHKTPRLNPPSYEDDQEMAEEEDPSWPSTAMNRAAPWGTRRLLNWIKEEYGDIPIYITENGVGLTNPNTEDTDRIFYHKTYINEALKAYRLDGIDLRGYVAWSLMDNFEWLNGYTVKFGLYHVDFNNTNRPRTARASARYYTEVITNNGMPLAREDEFLYGRFPEGFIWSAASAAYQIEGAWRADGKGLSIWDTFSHTPLRVENDAIGDVACDSYHKIAEDLVTLQNLGVSHYRFSISWSRILPDGTTRYINEAGLNYYVRLIDTLLAASIQPQVTIYHWDLPQTLQDVGGWENETIVQRFKEYADVLFQRLGDKVKFWITLNEPFVIAYQGYGYGTAAPGVSNRPGTAPYIVGHNLIKAHAEAWHLYNDVYRASQGGVISITISSDWAEPRDPSNQEDVEAARRYVQFMGGWFAHPIFKNGDYNEVMKTRIRDRSLAAGLNKSRLPEFTESEKRRINGTYDFFGFNHYTTVLAYNLNYATAISSFDADRGVASIADRSWPDSGSFWLKMTPFGFRRILNWLKEEYNDPPIYVTENGVSQREETDLNDTARIYYLRTYINEALKAVQDKVDLRGYTVWSAMDNFEWATGFSERFGLHFVNYSDPSLPRIPKASAKFYASVVRCNGFPDPATGPHACLHQPDAGPTISPVRQEEVQFLGLMLGTTEAQTALYVLFSLVLLGVCGLAFLSYKYCKRSKQGKTQRSQQELSPVSSF

SEQ ID NO: 60597 - protein, 129 aa, Homo sapiens
MADSGDAGSSGPWWKSLTNSRKKSKEAAVGVPPPAQPAPGEPTPPAPPSPDWTSSSRENQHPNLLGGAGEPPKPDKLYGDKSGSSRRNLKISRSGRFKEKRKVRATLLPEAGRSPEEAGFPGDPHEDKQ

SEQ ID NO: 60598 - protein, 880 aa, Homo sapiens
MKNLYFRVITIVIGLYFTGIMTNASRKSNILFNSECQWNEYILTNCSFTGKCDIPVDISQTAATVDVSFNFFRVLLQSHTKKEEWKIKHLDLSNNLISKITLSPFAYLHALEVLNLSNNAIHSLSLDLLSPKSSWVKRHRSSFRNRFPLLKVLILQRNKLSDTPKGLWKLKSLQSLDLSFNGILQIGWSDFHNCLQLENLCLKSNKIFKIPPQAFKDLKKLQVIDLSNNALITILPMMIIALEFPHLVVDLADNNWQCDDSVAVFQNFISESWRKKWNVICNRSIGSEEANGGTPQSRISRETRLPPIHLHRMKSLIRSKAERPQGGRHTGISTLGKKAKAGSGLRKKQRRLPRSVRSTRDVQAAGKKEDAPQDLALAVCLSVFITFLVAFSLGAFTRPYVDRLWQKKCQSKSPGLDNAYSNEGFYDDMEAAGHTPHPETHLRQVFPHLSLYENQTPFWVTQPHPHATVIPDRTLGRSRKDPGSSQSPGQCGDNTGAGSGNDGAVYSILQRHPHAGNRELMSAAQDHIHRNDILGEWTYETVAQEEPLSAHSVGVSSVAGTSHAVSGSSRYDSNELDPSLSGEITASLCKMLTHAEAQRTGDSKERGGTEQSLWDSQMEFSKERQVSSSIDLLSIQQPRLSGARAEEALSAHYSEVPYGDPRDTGPSVFPPRWDSGLDVTPANKEPVQKSTPSDTCCELESDCDSDEGSLFTLSSISSESARSKTEEAVPDEESLQDESSGASKDNVTAVDSLEENVTFQTIPGKCKNQEDPFEKPLISAPDSGMYKTHLENASDTDRSEGLSPWPRSPGNSPLGDEFPGMFTYDYDTALQSKAAEWHCSLRDLEFSNVDVLQQTPPCSAEVPSDPDKAAFHERDSDILK

SEQ ID NO: 60599 - protein, 2116 aa, Homo sapiens
MSGFRLGDHVWLEPPSTHKTSVAIGGIIKEAKPGKVLVEDDEGKEHWIRAEDFGVLSPMHPNSVQGVDDMIRLGDLNEAGMVHNLLIRYQQHKIYTYTGSILVAVNPFQVLPLYTLEQVQLYYSRHMGELPPHVFAIANNCYFSMKRNKRDQCCIISGESGAGKTETTKLILQFLATISGQHSWIEQQVLEANPILEAFGNAKTIRNDNSSRFGKYIDIYFNPSGVIEGARIEQFLLEKSRVCRQAPEERNYHIFYCMLMGVSAEDKQLLSLGTPSEYHYLTMGNCTSCEGLNDAKDYAHIRSAMKILQFSDSESWDVIKLLAAILHLGNVGFMASVFENLDASDVMETPAFPTVMKLLEVQHQELRDCLIKHTILIRGEFVTRSLNIAQAADRRDAFVKGIYGHLFLWIVKKINAAIFTPPAQDPKNVRRAIGLLDIFGFENFENNSFEQLCINFANEHLQQFFVQHVFTMEQEEYRSENISWDYIHYTDNRPTLDLLALKPMSIISLLDEESRFPQGTDLTMLQKLNSVHANNKAFLQPKNIHDARFGIAHFAGEVYYQAEGFLEKNRDVLSTDILTLVYSSKNKFLREIFNLELAETKLGHGTIRQAKAGNHLFKSADSNKRPSTLGSQFKQSLDQLMKILTNCQPYFIRCIKPNEYKKPLLFDRELCLRQLRYSGMMETVHIRKSGFPIRYTFEEFSQRFGVLLPNAMRMQLQGKLRQMTLGITDVWLRTDKDWKAGKTKIFLRDHQDTLLEVQRSQVLDRAALSIQKVLRGYRYRKEFLRQRRAAVTLQAWWRGYCNRRNFKLILVGFERLQAIARSQPLARQYQAMRQRTVQLQALCRGYLVRQQVQAKRRAVVVIQAHARGMAARRNFQQRKANAPLVIPAEGQKSQGALPAKKRRSIYDTVTDTEMVEKVFGFLPAMIGGQEGQASPHFEDLESKTQKLLEVDLDTVPMAEEPEEDVDGLAEYTFPKFAVTYFQKSASHTHIRRPLRYPLLYHEDDTDCLAALVIWNVILRFMGDLPEPVLYARSSQQGSSVMRQIHDTLGREHGAQVPQHSRSAQVASQLNIGEEALEPDGLGADRPMSNLEKVHFIVGYAILRPSLRDEIYCQICKQLSENFKTSSLARGWILLSLCLGCFPPSERFMKYLLNFIGQGPATYGPFCAERLRRTYANGVRAEPPTWLELQAVKSKKHIPIQVILATGESLTVPVDSASTSREMCMHIAHKQGLSDHLGFSLQVAVYDKFWSLGSGRDHMMDAIARCEQMAQERGESQRQSPWRIYFRKEFFTPWHDSREDPVSTELIYRQVLRGVWSGEYSFEKEEELVELLARHCYVQLGASAESKAVQELLPSCIPHKLYRTKPPDRWASLVTAACAKAPYTQKQVTPLAVREQVVDAARLQWPLLFSRLFEVITLSGPRLPKTQLILAVNWKGLCFLDQQEKMLLELSFPEVMGLATNREAQGGQRLLLSTMHEEYEFVSPSSVAIAELVALFLEGLKERSIFAMALQDRKATDDTTLLAFKKGDLLVLTKKQGLLASENWTLGQNDRTGKTGLVPMACLYTIPTVTKPSAQLLSLLAMSPEKRKLAAQEGQFTEPRPEEPPKEKLHTLEEFSYEFFRAPEKDMVSMAVLPLARARGHLWAYSCEPLRQPLLKRVHANVDLWDIACQIFVAILRYMGDYPSRQAWPTLELTDQIFTLALQHPALQDEVYCQILKQLTHNSNRHSEERGWQLLWLCTGLFPPSKGLLPHAQKFIDTRRGKLLAPDCSRRIQKVLRTGPRKQPPHQVEVEAAEQNVSRICHKIYFPNDTSEMLEVVANTRVRDVCDSIATRLQLASWEGCSLFIKISDKVISQKEGDFFFDSLREVSDWVKKNKPQKEGAPVTLPYQVYFMRKLWLNISPGKDVNADTILHYHQELPKYLRGFHKCSREDAIHLAGLIYKAQFNNDRSQLASVPKILRELVPENLTRLMSSEEWKKSILLAYDKHKDKTVEEAKVAFLKWICRWPTFGSAFFEVKQTSEPSYPDVILIAINRHGVLLIHPKTKDLLTTYPFTKISSWSSGSTYFHMALGSLGRGSRLLCETSLGYKMDDLLTSYVQQLLSAMNKQRGSKAPALAST

SEQ ID NO: 60600 - protein, 157 aa, Homo sapiens; identical to SEQ ID NO: 13662

SEQ ID NO: 60601 - protein, 452 aa, Homo sapiens
MCPLDFGAAICTTDAQAVSLALTSVCPGAGRREEEGRGGAVQSPLPAGPMQLLGLLGLLWMLKASPWATVSSNTSTTPTSKFAFKVETTPPTVLVYSATTECVYPTSFIITISHPTSICVTTTQVAFTSSYTSTPVTQKPVTTVTSTYSMTTTEKGTHLTQYSQIHFFNHHYRDPLTQYSQIHFFIHQYQDHLTQISQLHFFDHHHGDHLTQYSQLHFFDHHHRDHLTQCSQLHFFDHHHRDHLTQYSELHFFDHHHRDQLSQYYQLHFFDHHHRDHLTHQHIHNCHHLTFYYLRDCGDSHTCNPIFSEYRHPDHKPTNSHPFVYPSCTDVSHWDPNISCTYYCHLWKYGFLHVHSSYSYSINSLEHDRVNITGTCDNGGTWEQGQCACLPGFSGDRCQLQTRCQNGGQWDGLKCQCPSTFYGSSCEFAVEQVDLASGASHSKAASLCVFLP

SEQ ID NO: 60602 - protein, 1543 aa, Homo sapiens
MVPYWSLGFQLCRYGYQNDSEIASLYDEMVAAQIPYDVQYSDIDYMERQLDFTLSPKFAGFPALINRMKADGMRVILILDPAISGNETQPYPAFTRGVEDDVFIKYPNDGDIVWGKVWPDFPDVVVNGSLDWDSQVELYRAYVAFPDFFRNSTAKWWKREIEELYNNPQNPERSLKFDGMWIDMNEPSSFVNGAVSPGCRDASLNHPPYMPHLESRDRGLSSKTLCMESQQILPDGSLVQHYNVHNLYGWSQTRPTYEAVQEVTGQRGVVITRSTFPSSGRWAGHWLGDNTAAWDQLKKSIIGMMEFSLFGISYTGADICGFFQDAEYEMCVRWMQLGAFYPFSRNHNTIGTRRQDPVSWDAAFVNISRNVLQTRYTLLPYLYTLMQKAHTEGVTVVRPLLHEFVSDQVTWDIDSQFLLGPAFLVSPVLERVSMEASDEGRIPAVRLGEKDEEKRPELNARNVTAYFPRARWYDYYTGVDINARGEWKTLPAPLDHINLHVRGGYILPWQEPALNTHLSRKNPLGLIIALDENKEAKGELFWDDGQTKDTVAKKVYLLCEFSVTQNHLEVTISQSTYKDPNNLAFNEIKILGMEEPSNVTVKHNGVPSQTSPTVTYDSNLKVAIITDINLFLGEAYTVEWSIKIRDEEKIDCYPDENGDSAENCTARGCIWEASNSSGVPFCYFVNDLYSVSDVQYNSHGATADISLKSSVHANAFPSTPVNPLRLDVTYHKNEMLQFKIYDPNNNRYEVPVPLNIPSVPSSTPEGQLYDVLIKKNPFGIEIRRKSTGTIIWDSQLLGFTFNDMFIRISTRLPSKYLYGFGETEHTSYRRDLEWHTWGMFSRDQPPGYKKNSYGVHPYYMGLEEDGSAHGVLLLNSNAMDVTFQPLPALTYRTTGGVLDFYVFLGPTPELVTQQYTELIGRPVMVPYWSLGFQLCRYGYQNDSEISSLYDEMVAAQIPYDVQYSDIDYMERQLDFTLSPKFAGFPALINRMKADGMRVILILDPAISGNETQPYPAFTRGVEDDVFIKYPNDGDIVWGKVWPDFPDVVVNGSLDWDSQVELYRAYVAFPDFFRNSTAKWWKREIEELYNNPQNPERSLKFDGMWIDMNEPSSFVNGAVSPGCRDASLNHPPYMPYLESRDRGLSSKTLCMESQQILPDGSPVQHYNVHNLYGWSQTRPTYEAVQEVTGQRGVVITRSTFPSSGRWAGHWLGDNTAAWDQLKKSIIGMMEFSLFGISYTGADICGFFQDAEYEMCVRWMQLGAFYPFSRNHNTIGTRRQDPVSWDVAFVNISRTVLQTRYTLLPYLYTLMHKAHTEGVTVVRPLLHEFVSDQVTWDIDSQFLLGPAFLVSPVLERNARNVTAYFPRARWYDYYTGVDINARGEWKTLPAPLDHINLHVRGGYILPWQEPALNTHLSRQKFMGFKIALDDEGTAGGWLFWDDGQSIDTYGKGLYYLASFSASQNTMQSHIIFNNYITGTNPLKLGYIEIWGVGSVPVTSVSISVSGMVITPSFNNDPTTQVLSIDVTDRNISLHNFTSLTWISTL

SEQ ID NO: 60603 - protein, 260 aa, Homo sapiens
MQGFTFKGVEILSLRNGSIVVDYLVLLEMPFSPQLESEYEQVKTTLKEGLQNASQDANSCQDSQTLCFKPDSIKVNNNSKTELTPEAICRRAAPTGYEEFYFPLVEATRLRCVTKCTSGVDNAIDCHQGQCVLETSGPACRCYSTDTHWFSGPRCEVAVHWRALVGGLTAGAALLVLLLLALGVRAVRSGWWGGQRRGRSWDQDRKWFETWDEEVVGTFSNWGFEDDGTDKDTNFHVALENVDTTMKVHIKRPEMTSSSV

SEQ ID NO: 60604 - protein, 2817 aa, Homo sapiens
MGLPLARLAAVCLALSLAGGSELQTEGRTRNHGHNVCSTWGNFHYKTFDGDVFRFPGLCDYNFASDCRGSYKEFAVHLKRGPGQAEAPAGVESILLTIKDDTIYLTRHLAVLNGAVVSTPHYSPGLLIEKSDAYTKVYSRAGLTLMWNREDALMLELDTKFRNHTCGLCGDYNGLQSYSEFLSDGVLFSPLEFGNMQKINQPDVVCEDPEEEVAPASCSEHRAECERLLTAEAFADCQDLVPLEPYLRACQQDRCRCPGGDTCVCSTVAEFSRQCSHAGGRPGNWRTATLCPKTCPGNLVYLESGSPCMDTCSHLEVSSLCEEHRMDGCFCPEGTVYDDIGDSGCVPVSQCHCRLHGHLYTPGQEITNDCEQCVCNAGRWVCKDLPCPGTCALEGGSHITTFDGKTYTFHGDCYYVLAKGDHNDSYALLGELAPCGSTDKQTCLKTVVLLADKKKNVVVFKSDGSVLLNELQVNLPHVTASFSVFRPSSYHIMVSMAIGVRLQVQLAPVMQLFVTLDQASQGQVQGLCGNFNGLEGDDFKTASGLVEATGAGFANTWKAQSSCHDKLDWLDDPCSLNIESANYAEHWCSLLKKTETPFGRCHSAVDPAEYYKRCKYDTCNCQNNEDCLCAALSSYARACTAKGVMLWGWREHVCNKDVGSCPNSQVFLYNLTTCQQTCRSLSEADSHCLEGFAPVDGCGCPDHTFLDEKGRCVPLAKCSCYHRGLYLEAGDVVVRQEERCVCRDGRLHCRQIRLIGQSCTAPKIHMDCSNLTALATSKPRALSCQTLAAGYYHTECVSGCVCPDGLMDDGRGGCVVEKECPCVHNNDLYSSGAKIKVDCNTCTCKRGRWVCTQAVCHGTCSIYGSGHYITFDGKYYDFDGHCSYVAVQDYCGQNSSLGSFSIITENVPCGTTGVTCSKAIKIFMGRTELKLEDKHRVVIQRDEGHHVAYTTREVGQYLVVESSTGIIVIWDKRTTVFIKLAPSYKGTVCGLCGNFDHRSNNDFTTRDHMVVSSELDFGNSWKEAPTCPDVSTNPEPCSLNPHRRSWAEKQCSILKSSVFSICHSKVDPKPFYEACVHDSCSCDTGGDCECFCSAVASYAQECTKEGACVFWRTPDLCPIFCDYYNPPHECEWHYEPCGNRSFETCRTINGIHSNISVSYLEGCYPRCPKDRPIYEEDLKKCVTADKCGCYVEDTHYPPGASVPTEETCKSCVCTNSSQVVCRPEEGKILNQTQDGAFCYWEICGPNGTVEKHFNICSITTRPSTLTTFTTITLPTTPTTFTTTTTTTTPTSSTVLSTTPKLCCLWSDWINEDHPSSGSDDGDRETFDGVCGAPEDIECRSVKDPHLSLEQLGQKVQCDVSVGFICKNEDQFGNGPFGLCYDYKIRVNCCWPMDKCITTPSPPTTTPSPPPTSTTTLPPTTTPSPPTTTTTTPPPTTTPSPPITTTTTPPPTTTPSPPISTTTTPPPTTTPSPPTTTPSPPTTTPSPPTTTTTTPPPTTTPSPPTTTPITPPASTTTLPPTTTPSPPTTTTTTPPPTTTPITTTTTVTPTPTPTGTQTPTTTPITTTTTVTPTPTPTGTQTPTSTPITTTTTVTPTPTPTGTQTPTTTPITTTTTVTPTPTPTGTQTPTPTAITTTTTVTPTPTPTGTQTPTTTPITTTTTVTPTPTPTGTQSPTPTAITTTTTVTPTPTPTGTQTPTSTPITTTTTVTPTPTPTGTQTPTPTPISTTTTVTPTPTPTGTQTPTTTPITTTTTVTPTPTPTGTQTPTTVLITTTTTMTPTPTPTSTKSTTVTPITTTTTVTATPTPTGTQTPTMIPISTTTTVTPTPTPTTGSTGPPTHTSTAPIAELTTSNPPPESSTPQTSRSTSSPLTESTTLLSTLPPAIEMTSTAPPSTPTAPTTTSGGHTLSPPPSTTTSPPGTPTRGTTTGSSSAPTPSTVQTTTTSAWTPTPTPLSTPSIIRTTGLRPYPSSVLICCVLNDTYYAPGEEVYNGTYGDTCYFVNCSLSCTLEFYNWSCPSTPSPTPTPSKSTPTPSKPSSTPSKPTPGTKPPECPDFDPPRQENETWWLCDCFMATCKYNNTVEIVKVECEPPPMPTCSNGLQPVRVEDPDGCCWHWECDCYCTGWGDPHYVTFDGLYYSYQGNCTYVLVEEISPSVDNFGVYIDNYHCDPNDKVSCPRTLIVRHETQEVLIKTVHMMPMQVQVQVNRQAVALPYKKYGLEVYQSGINYVVDIPELGVLVSYNGLSFSVRLPYHRFGNNTKGQCGTCTNTTSDDCILPSGEIVSNCEAAADQWLVNDPSKPHCPHSSSTTKRPAVTVPGGGKTTPHKDCTPSPLCQLIKDSLFAQCHALVPPQHYYDACVFDSCFMPGSSLECASLQAYAALCAQQNICLDWRNHTHGACLVECPSHREYQACGPAEEPTCKSSSSQQNNTVLVEGCFCPEGTMNYAPGFDVCVKTCGCVGPDNVPREFGEHFEFDCKNCVCLEGGSGIICQPKRCSQKPVTHCVEDGTYLATEVNPADTCCNITVCKCNTSLCKEKPSVCPLGFEVKSKMVPGRCCPFYWCESKGVCVHGNAEYQPGSPVYSSKCQDCVCTDKVDNNTLLNVIACTHVPCNTSCSPGFELMEAPGECCKKCEQTHCIIKRPDNQHVILKPGDFKSDPKNNCTFFSCVKIHNQLISSVSNITCPNFDASICIPGSITFMPNGCCKTCTPRNETRVPCSTVPVTTEVSYAGCTKTVLMNHCSGSCGTFVMYSAKAQALDHSCSCCKEEKTSQREVVLSCPNGGSLTHTYTHIESCQCQDTVCGLPTGTSRRARRSPRHLGSG

SEQ ID NO: 60605 - protein, 419 aa, Homo sapiens [sequence omitted]

SEQ ID NO: 60606 - protein, 133 aa, Homo sapiens
MDMRVPAQRLGLLLLWFPGARCAIRMTQSPFSLSASVGDRVTITCWASQGISSYLAWYQQKPAKAPKLFIYYASSLQSGVPSRFSGSGSGTDYTLTISSLQPEDFATYYCQQYYSTPPTVLHTQTKTPRERDV

SEQ ID NO: 60607 - protein, 419 aa, Homo sapiens [sequence omitted]

SEQ ID NO: 60608 - protein, 121 aa, Homo sapiens [sequence omitted]

SEQ ID NO: 60609 - protein, 1986 aa, Homo sapiens
MPRTGAQDGAWIQKQVVFEGQMASTYEQDEVIAIDDISFSSGCLPANDGILLCQEALNAERELCHPDTDLCRFDATDEELRLCQACGFEFDMCEWTSEASAGQISWMRTKAREIPAFESTPQQDQGGDDEGYYVWVGAKHGFTLNHLDSRAYLNSSVCHCLGKSCHLQFYYAMESSVLRVRLYNNKMRSKVVKLNNIDFGTLDFFTGREKHRLASLRDRVLINMLNIFLESFFNFTTKTLDFLVLYIIQEEEIFWTYNISTHSQWVKADVLIPEDLKTFKIIFEGTLLSQRSFIALDHLWVYACGQTQSRKLCSADEFPCTSGQCIAKESVCDSRQDCSDESDEDPATCSKHLTCDFESGFCGWEPFLTEDSHWKLMKGLNNGEHHFPAADHTANINHGSFIYLEAQRSPGVAKLGSPVLTKLLTASTPCQVQFWYHLSQHSNLSVFTRTSLDGNLQKQGKIIRFSESQWSHAKIDLIAEAGESTLPFQLILEATVLSSNATVALDDISVSQECEISYKSLPRTSTQSKFSKCDFEANSCDWFEAISGDHFDWIRSSQSELSADFEHQAPPRDHSLNASQGHFMFILKKSSSLWQVAKLQSPTFSQTGPGCILSFWFYNYGLSVGAAELQLHMENSHDSTVIWRVLYNQGKQWLEATIQLGRLSQPFHLSLDKVSLGIYDGVSAIDDIRFENCTLPLPAESCEGLDHFWCRHTRACIEKLRLCDLVDDCGDRTDEVNCAPELQCNFETGICNWEQDAKDDFDWTRNQGPTPTLNTGPMKDNTLGTAKGHYLYIESSEPQAFQDSAALLSPILNATDTKGCTFRFYYHMFGKRIYRLAIYQRIWSDSRGQLLWQIFGNQGNRWIRKHLNISSRQPFQILVEASVGDGFTGDIAIDDLSFMDCTLYPGNLPADLPTPPETSVPVTLPPHNCTDNEFICRSDGHCIEKMQKCDFKYDCPDKSDEASCVMEVCSFEKRSLCKWYQPIPVHLLQDSNTFRWGLGNGISIHHGEENHRPSVDHTQNTTDGWYLYADSSNGKFGDTADILTPIISLTGPKCTLVFWTHMNGATVGSLQVLIKKDNVTSKLWAQTGQQGAQWKRAEVFLGIRSHTQIVFRAKRGISYIGDVAVDDISFQDCSPLLSPERKCTDHEFMCANKHCIAKDKLCDFVNDCADNSDETTFICRTSSGRCDFEFDLCSWKQEKDEDFDWNLKASSIPAAGTEPAADHTLGNSSGHYIFIKSLFPQQPMRAARISSPVISKRSKNCKIIFHYHMYGNGIGALTLMQVSVTNQTKVLLNLTVEQGNFWRREELSLFGDEDFQLKFEGRVGKGQRGDIALDDIVLTENCLSLHDSVQEELAVPLPTGFCPLGYRECHNGKCYRLEQSCNFVDNCGDNTGENKCGSSCTFEKGWCGWQNSQADNFDWVLGVGSHQSLRPPKDHTLGNENGHFMYLEATAVGLRGDKAHFRSTMWRESSAACTMSFWYFISAKATGSIQILIKTEKGLSKVWQESKQNPGNHWQKADILLGKLRNFEVIFQGIRTRDLGGGAAIDDIEFKNCTTVGEISELCPEITDFLCRDKKCIASHLLCDYKPDCSDRSDEAHCAHYTSTTGSCNFETSSGNWTTACSLTQDSEDDLDWAIGSRIPAKALIPDSDHTPGSGQHFLYVNSSGSKEGSVARITTSKSFPASLGMCTVRFWFYMIDPRSMGILKVYTIEESGLNILVWSVIGNKRTGWTYGSVPLSSNSPFKVAFEADLDGNEDIFIALDDISFTPECVTGGPVPVQPSPCEADQFSCIYTLQCVPLSGKCDGHEDCIDGSDEMDCPLNPTPPLCSNMEFPCSTDECIPSLLLCDGVPDCHFNEDELICSNKSCSNGALVCASSNSCIPAHQRCDGFADCMDFQLDESSCSDTWTLLGIGLAFLMTHITVAVLCFLANRKVPIRKTEGSGNCAFVNPVYGNWSNPEKTESSVYSFSNPLYGTTSGSLETLSHHLK

SEQ ID NO: 60610 - protein, 1632 aa, Homo sapiens
MGISTVILEMCLLWGQVLSTGGWIPRTTDYASLIPSEVPLDTTVAEGSPFPSELTLESTVAEGSPISLESTLESTVAEGSLIPSESTLESTVAEGSDSGLALRLVNGDGRCQGRVEILYRGSWGTVCDDSWDTNDANVVCRQLGCGWAMSAPGNAWFGQGSGPIALDDVRCSGHESYLWSCPHNGWLSHNCGHGEDAGVICSAAQPQSTLRPESWPVRISPPVPTEGSESSLALRLVNGGDRCRGRVEVLYRGSWGTVCDDYWDTNDANVVCRQLGCGWAMSAPGNAQFGQGSGPIVLDDVRCSGHESYLWSCPHNGWLTHNCGHSEDAGVICSAPQSRPTPSPDTWPTSHASTAGSESSLALRLVNGGDRCQGRVEVLYRGSWGTVCDDSWDTSDANVVCRQLGCGWATSAPGNARFGQGSGPIVLDDVRCSGYESYLWSCPHNGWLSHNCQHSEDAGVICSAAHSWSTPSPDTLPTITLPASTVGSESSLALRLVNGGDRCQGRVEVLYQGSWGTVCDDSWDTNDANVVCRQLGCGWAMSAPGNARFGQGSGPIVLDDVRCSGHESYLWSCPHNGWLSHNCGHSEDAGVICSASQSRPTPSPGSESSLALRLVNGGDRCQGRVEVLYRGSWGTVCDDYWDTNDANVVCRQLGCGWATSAPGNARFGQGSGPIVLDDVRCSGHESYLWSCPHNGWLSHNCGHHEDAGVICSASQSQPTPSPDTWPTSRASTAGSESTLALRLVNGGDRCRGRVEVLYQGSWGTVCDDYWDTNDANVVCRQLGCGWAMSAPGNAQFGQGSGPIVLDDVRCSGHESYLWSCPHNGWLSHNCGHHEDAGVICSAAQSQSTPRPGSESSLALRLVNGGDRCRGRVEVLYRGSWGTVCDDSWDTNDANVVCRQLGCGWAMSAPGNARFGQGSGPIVLDDVRCSGNESYLWSCPHKGWLTHNCGHHEDAGVICSATQINSTTTDWWHPTTTTTARPSSNCGGFLFYASGTFSSPSYPAYYPNNAKCVWEIEVNSGYRINLGFSNLKLEAHHNCSFDYVEIFDGSLNSSLLLGKICNDTRQIFTSSYNRMTIHFRSDISFQNTGFLAWYNSFPSDATLRLVNLNSSYGLCAGRVEIYHGGTWGTVCDDSWTIQEAEVVCRQLGCGRAVSALGNAYFGSGSGPITLDDVECSGTESTLWQCRNRGWFSHNCNHREDAGVICSGNHLSTPAPFLNITRPNTDYSCGGFLSQPSGDFSSPFYPGNYPNNAKCVWDIEVQNNYRVTVIFRDVQLEGGCNYDYIEVFDGPYRSSPLIARVCDGARGSFTSSSNFMSIRFISDHSITRRGFRAEYYSSPSNDSTNLLCLPNHMQASVSRSYLQSLGFSASDLVISTWNGYYECRPQITPNLVIFTIPYSGCGTFKQADNDTIDYSNFLTAAVSGGIIKRRTDLRIHVSCRMLQNTWVDTMYIANDTIHVANNTIQVEEVQYGNFDVNISFYTSSSFLYPVTSRPYYVDLNQDLYVQAEILHSDAVLTLFVDTCVASPYSNDFTSLTYDLIRSGCVRDDTYGPYSSPSLRIARFRFRAFHFLNRFPSVYLRCKMVVCRAYDPSSRCYRGCVLRSKRDVGSYQEKVDVVLGPIQLQTPPRREEEPR

SEQ ID NO: 60611 - protein, 182 aa, Homo sapiens
MEFGLSWVFLVAIFKGVQCEVQLVESGEGLVQPGGSLRLSCAASGFTFSSYAMHWVRQAPGKGLEYVSAISSNGGSTYYADSVKGRFTISRDNSKNTLYLQMGSLRAEDMAVYYCARDTEDVFAVVKIPDLKPFSWRSGGSQAVAAAVTQESLVGLSSLFVTQDPPLCCMETHLEMQVASGN

SEQ ID NO: 60612 - protein, 81 aa, Homo sapiens
MLRGKPKNLDEILTHFHTSFYWHKGLLGLSNATVEWHIPDTAQPGIYRIRYFGHNRKQDILKPAVILSFEGTSPAFEVVTI

SEQ ID NO: 60613 - protein, 500 aa, Homo sapiens
MALMLSLVLSLLKLGSGQWQVFGPDKPVQALVGEDAAFSCFLSPKTNAEAMEVRFFRGQFSSVVHLYRDGKDQPFMQMPQYQGRTKLVKDSIAEGRISLRLENITVLDAGLYGCRISSQSYYQKAIWELQVSALGSVPLISITGYVDRDIQLLCQSSGWFPRPTAKWKGPQGQDLSTDSRTNRDMHGLFDVEISLTVQENAGSISCSMRHAHLSREVESRVQIGDTFFEPISWHLATKVLGILCCGLFFGIVGLKIFFSKFQWKIQAELDWRRKHGQAELRDARKHAVEVTLDPETAHPKLCVSDLKTVTERKAPQEVPHSEKRFKRKSVVASQSFQAGKHYWEVDGGHNKRWRVGVCRDDVDRRKEYVTLSPDHGYWVLRLNGEHLYFTLNPRFISVFPRTPPTKIGVFLDYECGTISFFNINDQSLIYTLTCRFEGLLRPYIEYPSYNEQNGTPIVICPVTQESEKEASWQRASAIPETSNSESSSQATTPFLPRGEM

SEQ ID NO: 60614 - protein, 140 aa, Homo sapiens
MRHAHLSREVESRVQIGDTFFEPISWHLATKVLGILCCGLFFGIVGLKIFFSKFQCKREREAWAGALFMVPAGTGSEMLPHPAASLLLVLASRGPGPKKENPGGTGLEKKARTGRIERRPETRSGGDSGSRDGSPEALRF

SEQ ID NO: 60615 - protein, 160 aa, Homo sapiens
MVANLSRGPEPPFFKQLIVPLIPSIVDRAPKGRTFGDVLQPAKPEYRVGEVAEVIFVGANPKNSVQNQTHQTFLTVEKYEATSTSWQIVCNDASWETRFYWHKGLLGLSNATVEWHIPDTAQPGIYRIRYFGHNRKQDILKPAVILSFEGTSPAFEVVTI

SEQ ID NO: 60616 - protein, 165 aa, Homo sapiens
MRQHRQFMDRTHYLLTFSSSETLLRLLLRIVDRAPKGRTFGDVLQPAKPEYRVGEVAEVIFVGANPKNSVQNQTHQTFLTVEKYEATSTSWQIVCNDASWETRFYWHKGLLGLSNATVEWHIPDTAQPGIYRIRYFGHNRKQDILKPAVILSFEGTSPAFEVVTI

SEQ ID NO: 60617 - protein, 160 aa, Homo sapiens; identical to SEQ ID NO: 60615

SEQ ID NO: 60618 - protein, 622 aa, Homo sapiens
MDSEKSSEWRSDVLNRLQSKYGSLYRRDNVILSGTHTHSGPAGYFQYTVFVIASEGFSNQTFQHMVTGILKSIDIAHTNMKPGKIFINKGNVDGVQINRSPYSYLQNPQSERARYSSNTDKEMIVLKMVDLNGDDLGLISWFAIHPVSMNNSNHLVNSDNVGYASYLLEQEKNKGYLPGQGPFVAAFSSSNLGDVSPNILGPRCINTGESCDNANSTCPIGGPSMCIAKGPGQDMFDSTQIIGRAMYQRAKELYASASQEVTGPLASAHQWVDMTDVTVWLNSTHASKTCKPALGYSFAAGTIDGVGGLNFTQGKTEGDPFWDTIRDQILGKPSEEIKECHKPKPILLHTGELSKPHPWHPDIVDVQIITLGSLAITAIPGEFTTMSGRRLREAVQAEFASHGMQNMTVVISGLCNVYTHYITTYEEYQAQRYEAASTIYGPHTLSAYIQLFRNLAKAIATDTVANLSRGPEPPFFKQLIVPLIPSIVDRAPKGRTFGDVLQPAKPEYRVGEVAEVIFVGANPKNSVQNQNHQTFLTVEKYEATSTSWQIVCNDASWETRFYWHKGLLGLSNATVEWHIPDTAQPGIYRIRYFGHNRKQDILKPAVILSFEGTSPAFEVVTI

SEQ ID NO: 60619 - protein, 444 aa, Homo sapiens
MANAMGHHSLLTLRHAFAGRLSLEADPSQDEPPEENPALANTLIAALKRTQLSPVQIPGPQKLGRAEGINPQGHTRSLRCTLEVQQRRAPSAGGLEREKPREIQVCISVTAGTGKATEGTGLNVCCCVASLITPAPFVLARGLLPLAQAPLWFPASKRESQVLGSLLFLRMASGRLIKFVVFELLEFAAFSIPTLVITEQFATAYQGTRARSDNTHYWLIISCSIAYVALVTLLIWVPVKVILHKKRYIYRKIKGWRPVLMMCVVLTTLPCLTFSIAVTEVQKSINGSADVLPDMLPDLPVSLVLLSLIMVDIIEKLRIYPLRGSQKSSENGHIHSTSLQHIKTVTEQVRQSPENAASPQATNSTQVSQPSGAMTRSQESVFMGPQEPSCDSGILRMMSRRDVRAELFLWSFLLWSDTIEMDFSHTVKEDLLTVVKSLPSSFLI

SEQ ID NO: 60620 - protein, 167 aa, Homo sapiens
MLTVALLALLCASASGNAIQARSSSYSGEYGGGGGKRFSHSGNQLDGPITALRVRVNTYYIVGLQVRYGKVWSDYVGGRNGDLEEIFLHPGESVIQVSGKYKWYLKKLLFVTDKGRYLSFGKDSGTSFNAVPLHPNTVLRFISGRSGSLIDAIGLHWDVYPSSCSRC

SEQ ID NO: 60621 - protein, 277 aa, Homo sapiens
MLLSLKPSEAPELDEDEGFGDWSQRPEQRQQHEGAQGALDSGEPPQCRSPEGEQEDRPGLHAYEKEDSDEVHLEELSLSKEGPGPEDTVQDNLGAAGAEEEQEEHQKCQQPRTPSPLVLEGTIEQSSPPLSPTTKLIDRTESLNRSIEKSNSVKKSQPDLPISKIDQWLEQYTQAIETAGRTPKLARQASIELPSMAVASTKSRWETGEVQAQSAAKTPSCKDIVAGDMSKKSLWEQKGGSKTSSTIKSTPSGKRYKFVATGHGKYEKVLVEGGPAP

SEQ ID NO: 60622 - protein, 277 aa, Homo sapiens; identical to SEQ ID NO: 60621

SEQ ID NO: 60623 - protein, 277 aa, Homo sapiens; identical to SEQ ID NO: 60621

SEQ ID NO: 60624 - protein, 339 aa, Homo sapiens
MAEASSDPGAEEREELLGPTAQWSVEDEEEAVHEQCQHERDRQLQAQDEEGGGHVPERPKQEMLLSLKPSEAPELDEDEGFGDWSQRPEQRQQHEGAQGALDSGEPPQCRSPEGEQEDRPGLHAYEKEDSDEVHLEELSLSKEGPGPEDTVQDNLGAAGAEEEQEEHQKCQQPRTPSPLVLEGTIEQSSPPLSPTTKLIDRTESLNRSIEKSNSVKKSQPDLPISKIDQWLEQYTQAIETAGRTPKLARQASIELPSMAVASTKSRWETGEVQAQSAAKTPSCKDIVAGDMSKKSLWEQKGGSKTSSTIKSTPSGKRYKFVATGHGKYEKVLVEGGPAP

SEQ ID NO: 60625 - protein, 359 aa, Homo sapiens
MIAAQAKLVYQLNKYYTERCQARKAAIAKTIREVCKVVSDVLKEVEVQEPRFISSLSEIDARYEGLEVISPTEFEVVLYLNQMGVFNFVDDGSLPGCAVLKLSDGRKRSMSLWVEFITASGYLSARKIRSRFQTLVAQAVDKCSYRDVVKMIADTSEVKLRIRERYVVQITPAFKCTGIWPRSAAQWPMPHIPWPGPNRVAEVKAEGFNLLSKECYSLTGKQSSAESDAWVLQFGEAENRLLMGGCRNKCLSVLKTLRDRHLELPGQPLNNYHMKTLLLYECEKHPRETDWDESCLGDRLNGILLQLISCLQCRRCPHYFLPNLDLFQGKPHSALESAAKQTWRLAREILTNPKSLDKL

SEQ ID NO: 60626 - protein, 153 aa, Homo sapiens
MASPDPPATSYAPSDVPSGVALFLTIPFAFFLPELIFGFLVWTMVAATHIVYPLLQGWVMYVSLTSFLISLMFLLSYLFGFYKRFESWRVLDSLYHGTTGILYMSAAVLQVHATIVSEKLLDPRIYYINSAASFFAFIATLLYILHAFSIYYH

SEQ ID NO: 60627 - protein, 700 aa, Homo sapiens
MDLWNLSWFLFLDALLVISGLATPENFDVDGGMDQDIFDINEGLGLDLFEGDIRLDRAQIRNSIIGEKYRWPHTIPYVLEDSLEMNAKGVILNAFERYRLKTCIDFKPWAGETNYISVFKGSGCWSSVGNRRVGKQELSIGANCDRIATVQHEFLHALGFWHEQSRSDRDDYVRIMWDRILSGREHNFNTYSDDISDSLNVPYDYTSVMHYSKTAFQNGTEPTIVTRISDFEDVIGQRMDFSDSDLLKLNQLYNCSSSLSFMDSCSFELENVCGMIQSSGDNADWQRVSQVPRGPESDHSNMGQCQGSGFFMHFDSSSVNVGATAVLESRTLYPKRGFQCLQFYLYNSGSESDQLNIYIREYSADNVDGNLTLVEEIKEIPTGSWQLYHVTLKVTKKFRVVFEGRKGSGASLGGLSIDDINLSETRCPHHIWHIRNFTQFIGSPNGTLYSPPFYSSKGYAFQIYLNLAHVTNAGIYFHLISGANDDQLQWPCPWQQATMTLLDQNPDIRQRMSNQRSITTDPFMTTDNGNYFWDRPSKVGTVALFSNGTQFRRGGGYGTSAFITHERLKSRDFIKGDDVYILLTVEDISHLNSTQIQLTPAPSVQDLCSKTTCKNDGVCTVRDGKAECRCQSGEDWWYMGERCEKRGSTRDTIVIAVSSTVAVFALMLIITLVSVYCTRKKYRERMSSNRPNLTLQNHAF

SEQ ID NO: 60628 - protein, 181 aa, Homo sapiens
MFSAIRSQHSGVDICINNAGLARPDTLLSGSTSGWKDMFNVNVLALSICTREAYQSMKERNVDDGHIININSMSGHRVLPLSVTHFYSATKYAVTALTEGLRQELREAQTHIRATCISPGVVETQFAFKLHDKDPEKAAATYEQMKCLKPEDVAEAVIYVLSTPAHIQIGDIQMRPTEQVT

SEQ ID NO: 60629 - protein, 115 aa, Homo sapiens
MVSRKAVAALLVVHVAAMLASQTEAFVPIFTYGELQRMQEKERNKGQKKSLSVWQRSGEEGPVDPAEPIREEENEMIKLTAPLEIGMRMNSRQLEKYPATLEGLLSEMLPQHAAK

SEQ ID NO: 60630 - protein, 635 aa, Homo sapiens
MPSWALFMVTSCLLLAPQNLAQVSSQDVSLLASDSEPLKCFSRTFEDLTCFWDEEEAAPSGTYQLLYAYPREKPRACPLSSQSMPHFGTRYVCQFPDQEEVRLFFPLHLWVKNVFLNQTRTQRVLFVDSVGLPAPPSIIKAMGGSQPGELQISWEEPAPEISDFLRYELRYGPRDPKNSTGPTVIQLIATETCCPALQRPHSASALDQSPCAQPTMPWQDGPKQTSPSREASALTAEGGSCLISGLQPGNSYWLQLRSEPDGISLGGSWGSWSLPVTVDLPGDAVALGLQCFTLDLKNVTCQWQQQDHASSQGFFYHSRARCCPRDRYPIWENCEEEEKTNPGLQTPQFSRCHFKSRNDSIIHILVEVTTAPGTVHSYLGSPFWIHQAVRLPTPNLHWREISSGHLELEWQHPSSWAAQETCYQLRYTGEGHQDWKVLEPPLGARGGTLELRPRSRYRLQLRARLNGPTYQGPWSSWSDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLCSSQAQMDYRRLQPSCLGTMPLSVCPPMAESGSCCTTHIANHSYLPLSYWQQP

SEQ ID NO: 60631 - protein, 267 aa, Homo sapiens
MKAEATVIPSRCARGLPSWQVLSPVQPWQTSAPQNTTQPKLLAPHQHDKSQKKSSLLKELGAFHITIALLHLVFGGYLASIVKNLHLVVLKSWYPFWGAASFLISGILAITMKTFSKTYLKMLCLMTNLISLFCVLSGLFVISKDLFLESPFESPIWRMYPNSTVHIQRLELALLCFTVLELFLPVPTAVTAWRGDCPSAKNDDACLVPNTPLHLKGLPVEPPPSYQSVIQGDAQHKQHQRLREVKQVAPDTWIVTDGAAIWAQTAN

SEQ ID NO: 60632 - protein, 250 aa, Homo sapiens
MNSMTSAVPVANSVLVVAPHNGYPVTPGIMSHVPLYPNSQPQVHLVPGNPPSLVSNVNGQPVQKALKEGKTLGAIQIIIGLAHIGLGSIMATVLVGEYLSISFYGGFPFWGGLWFIISGSLSVAAENQPYSYCLLSGSLGLNIVSAICSAVGVILFITDLSIPHPYAYPDYYPYAWGVNPGMAISGVLLVFCLLEFGIACASSHFGCQLVCCQSSNVSVIYPNIYAANPVITPEPVTSPPSYSSEIQANK

SEQ ID NO: 60633 - protein, 894 aa, Homo sapiens
MILLAVLFLCFISSYSASVKGHTTGLSLNNDRLYKLTYSTEVLLDRGKGKLQDSVGYRISSNVDVALLWRNPDGDDDQLIQITMKDVNVENVNQQRGEKSIFKGKSPSKIMGKENLEALQRPTLLHLIHGKVKEFYSYQNEAVAIENIKRGLASLFQTQLSSGTTNEVDISGNCKVTYQAHQDKVIKIKALDSCKIARSGFTTPNQVLGVSSKATSVTTYKIEDSFVIAVLAEETHNFGLNFLQTIKGKIVSKQKLELKTTEAGPRLMSGKQAAAIIKAVDSKYTAIPIVGQVFQSHCKGCPSLSELWRSTRKYLQPDNLSKAEAVRNFLAFIQHLRTAKKEEILQILKMENKEVLPQLVDAVTSAQTSDSLEAILDFLDFKSDSSIILQERFLYACGFASHPNEELLRALISKFKGSIGSSDIRETVMIITGTLVRKLCQNEGCKLKAVVEAKKLILGGLEKAEKKEDTRMYLLALKNALLPEGIPSLLKYAEAGEGPISHLATTALQRYDLPFITDEVKKTLNRIYHQNRKVHEKTVRTAAAAIILNNNPSYMDVKNILLSIGELPQEMNKYMLAIVQDILRLEMPASKIVRRVLKEMVAHNYDRFSRSGSSSAYTGYIERSPRSASTYSLDILYSGSGILRRSNLNIFQYIGKAGLHGSQVVIEAQGLEALIAATPDEGEENLDSYAGMSAILFDVQLRPVTFFNGYSDLMSKMLSASGDPISVVKGLILLIDHSQELQLQSGLKANIEVQGGLAIDISGAMEFSLWYRESKTRVKNRVTVVITTDITVDSSFVKAGLETSTETEAGLEFISTVQFSQYPFLVCMQMDKDEAPFRQFEKKYERLSTGRGYVSQKRKESVLAGCEFPLHQENSEMCKVVFAPQPDSTSSGWF

SEQ ID NO: 60634 - protein, 5179 aa, Homo sapiens
MGLPLARLAAVCLALSLAGGSELQTEGRTRYHGRNVCSTWGNFHYKTFDGDVFRFPGLCDYNFASDCRGSYKEFAVHLKRGPGQAEAPAGVESILLTIKDDTIYLTRHLAVLNGAVVSTPHYSPGLLIEKSDAYTKVYSRAGLTLMWNREDALMLELDTKFRNHTCGLCGDYNGLQSYSEFLSDGVLFSPLEFGNMQKINQPDVVCEDPEEEVAPASCSEHRAECERLLTAEAFADCQDLVPLEPYLRACQQDRCRCPGGDTCVCSTVAEFSRQCSHAGGRPGNWRTATLCPKTCPGNLVYLESGSPCMDTCSHLEVSSLCEEHRMDGCFCPEGTVYDDIGDSGCVPVSQCHCRLHGHLYTPGQEITNDCEQCVCNAGRWVCKDLPCPGTCALEGGSHITTFDGKTYTFHGDCYYVLAKGDHNDSYALLGELAPCGSTDKQTCLKTVVLLADKKKNAVVFKSDGSVLLNQLQVNLPHVTASFSVFRPSSYHIMVSMAIGVRLQVQLAPVMQLFVTLDQASQGQVQGLCGNFNGLEGDDFKTASGLVEATGAGFANTWKAQSTCHDKLDWLDDPCSLNIESANYAEHWCSLLKKTETPFGRCHSAVDPAEYYKRCKYDTCNCQNNEDCLCAALSSYARACTAKGVMLWGWREHVCNKDVGSCPNSQVFLYNLTTCQQTCRSLSEADSHCLEGFAPVDGCGCPDHTFLDEKGRCVPLAKCSCYHRGLYLEAGDVVVRQEERCVCRDGRLHCRQIRLIGQSCTAPKIHMDCSNLTALATSKPRALSCQTLAAGYYHTECVSGCVCPDGLMDDGRGGCVVEKECPCVHNNDLYSSGAKIKVDCNTCTCKRGRWVCTQAVCHGTCSIYGSGHYITFDGKYYDFDGHCSYVAVQDYCGQNSSLGSFSIITENVPCGTTGVTCSKAIKIFMGRTELKLEDKHRVVIQRDEGHHVAYTTREVGQYLVVESSTGIIVIWDKRTTVFIKLAPSYKGTVCGLCGNFDHRSNNDFTTRDHMVVSSELDFGNSWKEAPTCPDVSTNPEPCSLNPHRRSWAEKQCSILKSSVFSICHSKVDPKPFYEACVHDSCSCDTGGDCECFCSAVASYAQECTKEGACVFWRTPDLCPIFCDYYNPPHECEWHYEPCGNRSFETCRTINGIHSNISVSYLEGCYPRCPKDRPIYEEDLKKCVTADKCGCYVEDTHYPPGASVPTEETCKSCVCTNSSQVVCRPEEGKILNQTQDGAFCYWEICGPNGTVEKHFNICSITTRPSTLTTFTTITLPTTPTSFTTTTTTTTPTSSTVLSTTPKLCCLWSDWINEDHPSSGSDDGDREPFDGVCGAPEDIECRSVKDPHLSLEQHGQKVQCDVSVGFICKNEDQFGNGPFGLCYDYKIRVNCCWPMDKCITTPSPPTTTPSPPPTTTTTLPPTTTPSPPTTTTTTPPPTTTPSPPITTTTTPLPTTTPSPPISTTTTPPPTTTPSPPTTTPSPPTTTPSPPTTTTTTPPPTTTPSPPMTTPITPPASTTTLPPTTTPSPPTTTTTTPPPTTTPSPPTTTPITPPTSTTTLPPTTTPSPPPTTTTTPPPTTTPSPPTTTTPSPPTITTTTPPPTTTPSPPTTTTTTPPPTTTPSPPTTTPITPPTSTTTLPPTTTPSPPPTTTTTPPPTTTPSPPTTTTPSPPITTTTTPPPTTTPSSPITTTPSPPTTTMTTPSPTTTPSSPITTTTTPSSTTTPSPPPTTMTTPSPTTTPSPPTTTMTTLPPTTTSSPLTTTPLPPSITPPTFSPFSTTTPTTPCVPLCNWTGWLDSGKPNFHKPGGDTELIGDVCGPGWAANISCRATMYPDVPIGQLGQTVVCDVSVGLICKNEDQKPGGVIPMAFCLNYEINVQCCECVTQPTTMTTTTTENPTPPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTGPPTHTSTAPIAELTTSNPPPESSTPQTSRSTSSPLTESTTLLSTLPPAIEMTSTAPPSTPTAPTTTSGGHTLSPPPSTTTSPPGTPTRGTTTGSSSAPTPSTVQTTTTSAWTPTPTPLSTPSIIRTTGLRPYPSSVLICCVLNDTYYAPGEEVYNGTYGDTCYFVNCSLSCTLEFYNWSCPSTPSPTPTPSKSTPTPSKPSSTPSKPTPGTKPPECPDFDPPRQENETWWLCDCFMATCKYNNTVEIVKVECEPPPMPTCSNGLQPVRVEDPDGCCWHWECDCYCTGWGDPHYVTFDGLYYSYQGNCTYVLVEEISPSVDNFGVYIDNYHCDPNDKVSCPRTLIVRHETQEVLIKTVHMMPMQVQVQVNRQAVALPYKKYGLEVYQSGINYVVDIPELGVLVSYNGLSFSVRLPYHRFGNNTKGQCGTCTNTTSDDCILPSGEIVSNCEAAADQWLVNDPSKPHCPHSSSTTKRPAVTVPGGGKTTPHKDCTPSPLCQLIKDSLFAQCHALVPPQHYYDACVFDSCFMPGSSLECASLQAYAALCAQQNICLDWRNHTHGACLVECPSHREYQACGPAEEPTCKSSSSQQNNTVLVEGCFCPEGTMNYAPGFDVCVKTCGCVGPDNVPREFGEHFEFDCKNCVCLEGGSGIICQPKRCSQKPVTHCVEDGTYLATEVNPADTCCNITVCKCNTSLCKEKPSVCPLGFEVKSKMVPGRCCPFYWCESKGVCVHGNAEYQPGSPVYSSKCQDCVCTDKVDNNTLLNVIACTHVPCNTSCSPGFELMEAPGECCKKCEQTHCIIKRPDNQHVILKPGDFKSDPKNNCTFFSCVKIHNQLISSVSNITCPNFDASICIPGSITFMPNGCCKTCTPRNETRVPCSTVPVTTEVSYAGCTKTVLMNHCSGSCGTFVMYSAKAQALDHSCSCCKEEKTSQREVVLSCPNGGSLTHTYTHIESCQCQDTVCGLPTGTSRRARRSPRHLGSG

SEQ ID NO: 60635 - protein, 683 aa, Homo sapiens [sequence omitted]

SEQ ID NO: 60636 - protein, 310 aa, Homo sapiens
MLCADVVETEVGMEVSVDQQFSPDLNDNTSQAYRDFNKTFWNQMQKIFADMQGFTFKGVEILSLRNGSIVVDYLVLLEMPFSPQLESEYEQVKTTLKEGLQNASQDANSCQDSQTLCFKPDSIKVNNNSKTELTPEAICRRAAPTGYEEFYFPLVEATRLRCVTKCTSGVDNAIDCHQGQCVLETSGPACRCYSTDTHWFSGPRCEVAVHWRALVGGLTAGAALLVLLLLALGVRAVRSGWWGGQRRGRSWDQDRKWFETWDEEVVGTFSNWGFEDDGTDKDTNFHVALENVDTTMKVHIKRPEMTSSSV

SEQ ID NO: 60637 - protein, 487 aa, Homo sapiens
MGSWALLWPPLLFTGLLVRPPGTMAQAQYCSVNKDIFEVEENTNVTEPLVDIHVPEGQEVTLGALSTPFAFRIQGNQLFLNVTPDYEEKSLLEAQLLCQSGGTLVTQLRVFVSVLDVNDNAPEFPFKTKEIRVEEDTKVNSTVIPETQLQAEDRDKDDILFYTLQEMTAGASDYFSLVSVNRPALRLDRPLDFYERPNMTFWLLVRDTPGENVEPSHTATATLVLNVVPADLRPPWFLPCTFSDGYVCIQAQYHGAVPTGHILPSPLVLRPGPIYAEDGDRGINQPIIYSIFRGNVNGTFIIHPDSGNLTVARSVPSPMTFLLLVKGQQADLARYSVTQVTVEAVAAAGSPPRFPQSLYRGTVARGAGAGVVVKDAAAPSQPLRIQAQDPEFSDLNSAITYRITNHSHFRMEGEVVLTTTTLAQAGAFYAEVEACTGDLRHPAQLRPPAPDPTQRLPGEAEEPMQTPKATHLGAGGLKHLPGVLVPF

SEQ ID NO: 60638 - protein, 845 aa, Homo sapiens
MGSWALLWPPLLFTGLLVRPPGTMAQAQYCSVNKDIFEVEENTNVTEPLVDIHVPEGQEVTLGALSTPFAFRIQGNQLFLNVTPDYEEKSLLEAQLLCQSGGTLVTQLRVFVSVLDVNDNAPEFPFKTKEIRVEEDTKVNSTVIPETQLQAEDRDKDDILFYTLQEMTAGASDYFSLVSVNRPALRLDRPLDFYERPNMTFWLLVRDTPGENVEPSHTATATLVLNVVPADLRPPWFLPCTFSDGYVCIQAQYHGAVPTGHILPSPLVLRPGPIYAEDGDRGINQPIIYSIFRGNVNGTFIIHPDSGNLTVARSVPSPMTFLLLVKGQQADLARYSVTQVTVEAVAAAGSPPRFPQSLYRGTVARGAGAGVVVKDAAAPSQPLRIQAQDPEFSDLNSAITYRITNHSHFRMEGEVVLTTTTLAQAGAFYAEVEAHNTVTSGTATTVIEIQVSEQEPPSTDVPPSPEAGGTTGPWTSTTSEVPRPPEPSQGPSTTSSGGGTGPHPPSGTTLRPPTSSTPGGSPGAENSTSHQPATPGGDTAQTPKPGTSQPMPPGVGTSTSHQPATPSGGTVQTPEPGTSQPMPPSMGTSTSHQPATPGGGTAQTPEAGTSQPMPPGMGTSTSHQPTTPGGGTAQTPEPGTSQPMPLSKSTPSSGGGPSEDKRFSVVDMAALGGVLGALLLLALLGLAVLVHKHYGPRLKCCSGKAPEPQPQGFDNQAFLPDHKANWAPVPSPTHDPKPAEAPMPAEPAPPGPASPGGAPEPPAAARAGGSPTAVRSILTKERRPEGGYKAVWFGEDIGTEADVVVLNAPTLDVDGASDSGSGDEGEGAGRGGGPYDAPGGDDSYI

SEQ ID NO: 60639 - protein, 651 aa, Homo sapiens
MGSWALLWPPLLFTGLLVRPPGTMAQAQYCSVNKDIFEVEENTNVTEPLVDIHVPEGQEVTLGALSTPFAFRIQGNQLFLNVTPDYEEKSLLEAQLLCQSGGTLVTQLRVFVSVLDVNDNAPEFPFKTKEIRVEEDTKVNSTVIPETQLQAEDRDKDDILFYTLQEMTAGASDYFSLVSVNRPALRLDRPLDFYERPNMTFWLLVRDTPGENVEPSHTATATLVLNVVPADLRPPWFLPCTFSDGYVCIQAQYHGAVPTGHILPSPLVLRPGPIYAEDGDRGINQPIIYSIFRGNVNGTFIIHPDSGNLTVARSVPSPMTFLLLVKGQQADLARYSVTQVTVEAVAAAGSPPRFPQSLYRGTVARGAGAGVVVKDAAAPSQPLRIQAQDPEFSDLNSAITYRITNHSHFRMEGEVVLTTTTLAQAGAFYAEVEAHNTVTSGTATTVIEIQVSEQEPPSTGGGPSEDKRFSVVDMAALGGVLGALLLLALLGLAVLVHKHYGPRLKCCSGKAPEPQPQGFDNQAFLPDHKANWAPVPSPTHDPKPAEAPMPAEPAPPGPASPGGAPEPPAAARAGGSPTAVRSILTKERRPEGGYKAVWFGEDIGTEADVVVLNAPTLDVDGASDSGSGDEGEGAGRGGGPYDAPGGDDSYI

SEQ ID NO: 60640 - protein, 106 aa, Homo sapiens
MGSWALLWPPLLFTGLLVRPPGTMAQAQYCSVNKDIFEVEENTNVTEPLVDIHVPEGQEVTLGALSTPFAFRIQGNQLFLNVTPDYEKAGPFRDEAAWAHTLSTDH

SEQ ID NO: 60641 - protein, 2116 aa, Homo sapiens
MSGFRLGDHVWLEPPSTHKTGVAIGGIIKEAKPGKVLVEDDEGKEHWIRAEDFGVLSPMHPNSVQGVDDMIRLGDLNEAGMVHNLLIRYQQHKIYTYTGSILVAVNPFQVLPLYTLEQVQLYYSRHMGELPPHVFAIANNCYFSMKRNKRDQCCIISGESGAGKTETTKLILQFLATISGQHSWIEQQVLEANPILEAFGNAKTIRNDNSSRFGKYIDIYFNPSGVIEGARIEQFLLEKSRVCRQAPEERNYHIFYCMLMGVSAEDKQLLSLGTPSEYHYLTMGNCTSCEGLNDAKDYAHIRSAMKILQFSDSESWDVIKLLAAILHLGNVGFMASVFENLDASDVMETPAFPTVMKLLEVQHQELRDCLIKHTILIRGEFVTRSLNIAQAADRRDAFVKGIYGHLFLWIVKKINAAIFTPPAQDPKNVRRAIGLLDIFGFENFENNSFEQLCINFANEHLQQFFVQHVFTMEQEEYRSENISWDYIHYTDNRPTLDLLALKPMSIISLLDEESRFPQGTDLTMLQKLNSVHANNKAFLQPKNIHDARFGIAHFAGEVYYQAEGFLEKNRDVLSTDILTLVYSSKNKFLREIFNLELAETKLGHGTIRQAKAGNHLFKSADSNKRPSTLGSQFKQSLDQLMKILTNCQPYFIRCIKPNEYKKPLLFDRELCLRQLRYSGMMETVHIRKSGFPIRYTFEEFSQRFGVLLPNAMRMQLQGKLRQMTLGITDVWLRTDKDWKAGKTKIFLRDHQDTLLEVQRSQVLDRAALSIQKVLRGYRYRKEFLRQRRAAVTLQAWWRGYCNRRNFKLILVGFERLQAIARSQPLARQYQAMRQRTVQLQALCRGYLVRQQVQAKRRAVVVIQAHARGMAARRNFQQRKANAPLVIPAEGQKSQGALPAKKRRSIYDTVTDTEMVEKVFGFLPAMIGGQEGQASPHFEDLESKTQKLLEVDLDTVPMAEEPEEDVDGLAEYTFPKFAVTYFQKSASHTHIRRPLRYPLLYHEDDTDCLAALVIWNVILRFMGDLPEPVLYARSSQQGSSVMRQIHDTLGREHGAQVPQHSRSAQVASQLNIGEEALEPDGLGADRPMSNLEKVHFIVGYAILRPSLRDEIYCQICKQLSENFKTSSLARGWILLSLCLGCFPPSERFMKYLLNFIGQGPATYGPFCAERLRRTYANGVRAEPPTWLELQAVKSKKHIPIQVILATGESLTVPVDSASTSREMCMHIAHKQGLSDHLGFSLQVAVYDKFWSLGSGRDHMMDAIARCEQMAQERGESQRQSPWRIYFRKEFFTPWHDSREDPVSTELIYRQVLRGVWSGEYSFEKEEELVELLARHCYVQLGASAESKAVQELLPSCIPHKLYRTKPPDRWASLVTAACAKAPYTQKQVTPLAVREQVVDAARLQWPLLFSRLFEVITLSGPRLPKTQLILAVNWKGLCFLDQQEKMLLELSFPEVMGLATNREAQGGQRLLLSTMHEEYEFVSPSSVAIAELVALFLEGLKERSIFAMALQDRKATDDTTLLAFKKGDLLVLTKKQGLLASENWTLGQNDRTGKTGLVPMACLYTIPTVTKPSAQLLSLLAMSPEKRKLAAQEGQFTEPRPEEPPKEKLHTLEEFSYEFFRAPEKDMVSMAVLPLARARGHLWAYSCEPLRQPLLKRVHANVDLWDIACQIFVAILRYMGDYPSRQAWPTLELTDQIFTLALQHPALQDEVYCQILKQLTHNSNRHSEERGWQLLWLCTGLFPPSKGLLPHAQKFIDTRRGKLLAPDCSRRIQKVLRTGPRKQPPHQVEVEAAEQNVSRICHKIYFPNDTSEMLEVVANTRVRDVCDSIATRLQLASWEGCSLFIKISDKVISQKEGDFFFDSLREVSDWVKKNKPQKEGAPVTLPYQVYFMRKLWLNISPGKDVNADTILHYHQELPKYLRGFHKCSREDAIHLAGLIYKAQFNNDRSQLASVPKILRELVPENLTRLMSSEEWKKSILLAYDKHKDKTVEEAKVAFLKWICRWPTFGSAFFEVKQTSEPSYPDVILIAINRHGVLLIHPKTKDLLTTYPFTKISSWSSGSTYFHMALGSLGRGSRLLCETSLGYKMDDLLTSYVQQLLSAMNKQRGSKAPALAST

SEQ ID NO: 60642 - protein, 892 aa, Homo sapiens
MDQPEAPCSSTGPRLAVARELLLAALEELSQEQLKRFRHKLRDVGPDGRSIPWGRLERADAVDLAEQLAQFYGPEPALEVARKTLKRADARDVAAQLQERRLQRLGLGSGTLLSVSEYKKKYREHVLQLHARVKERNARSVKITKRFTKLLIAPESAAPEEALGPAEEPEPGRARRSDTHTFNRLFRRDEEGRRPLTVVLQGPAGIGKTMAAKKILYDWAAGKLYQGQVDFAFFMPCGELLERPGTRSLADLILDQCPDRGAPVPQMLAQPQRLLFILDGADELPALGGPEAAPCTDPFEAASGARVLGGLLSKALLPTALLLVTTRAAAPGRLQGRLCSPQCAEVRGFSDKDKKKYFYKFFRDERRAERAYRFVKENETLFALCFVPFVCWIVCTVLRQQLELGRDLSRTSKTTTSVYLLFITSVLSSAPVADGPRLQGDLRNLCRLAREGVLGRRAQFAEKELEQLELRGSKVQTLFLSKKELPGVLETEVTYQFIDQSFQEFLAALSYLLEDGGVPRTAAGGVGTLLRGDAQPHSHLVLTTRFLFGLLSAERMRDIERHFGCMVSERVKQEALRWVQGQGQGCPGVAPEVTEGAKGLEDTEEPEEEEEGEEPNYPLELLYCLYETQEDAFVRQALCRFPELALQRVRFCRMDVAVLSYCVRCCPAGQALRLISCRLVAAQEKKKKSLGKRLQASLGGGSSSQGTTKQLPASLLHPLFQAMTDPLCHLSSLTLSHCKLPDAVCRDLSEALRAAPALTELGLLHNRLSEAGLRMLSEGLAWPQCRVQTVRVQLPDPQRGLQYLVGMLRQSPALTTLDLSGCQLPAPMVTYLCAVLQHQGCGLQTLSLASVELSEQSLQELQAVKRAKPDLVITHPALDGHPQPPKELISTF

SEQ ID NO: 60643 - protein, 1359 aa, Homo sapiens
MAEAGLRGWLLWALLLRLAQSEPYTTIHQPGYCAFYDECGKNPELSGSLMTLSNVSCLSNTPARKITGDHLILLQKICPRLYTGPNTQACCSAKQLVSLEASLSITKALLTRCPACSDNFVNLHCHNTCSPNQSLFINVTRVAQLGAGQLPAVVAYEAFYQHSFAEQSYDSCSRVRVPAAATLAVGTMCGVYGSALCNAQRWLNFQGDTGNGLAPLDITFHLLEPGQAVGSGIQPLNEGVARCNESQGDDVATCSCQDCAASCPAIARPQALDSTFYLGQMPGSLVLIIILCSVFAVVTILLVGFRVAPARDKSKMVDPKKGTSLSDKLSFSTHTLLGQFFQGWGTWVASWPLTILVLSVIPVVALAAGLVFTELTTDPVELWSAPNSQARSEKAFHDQHFGPFFRTNQVILTAPNRSSYRYDSLLLGPKNFSGILDLDLLLELLELQERLRHLQVWSPEAQRNISLQDICYAPLNPDNTSLYDCCINSLLQYFQNNRTLLLLTANQTLMGQTSQVDWKDHFLYCANAPLTFKDGTALALSCMADYGAPVFPFLAIGGYKGKDYSEAEALIMTFSLNNYPAGDPRLAQAKLWEEAFLEEMRAFQRRMAGMFQVTFMAERSLEDEINRTTAEDLPIFATSYIVIFLYISLALGSYSSWSRVMVDSKATLGLGGVAVVLGAVMAAMGFFSYLGIRSSLVILQVVPFLVLSVGADNIFIFVLEYQRLPRRPGEPREVHIGRALGRVAPSMLLCSLSEAICFFLGALTPMPAVRTFALTSGLAVILDFLLQMSAFVALLSLDSKRQEASRLDVCCCVKPQELPPPGQGEGLLLGFFQKAYAPFLLHWITRGVVLLLFLALFGVSLYSMCHISVGLDQELALPKDSYLLDYFLFLNRYFEVGAPVYFVTTLGYNFSSEAGMNAICSSAGCNNFSFTQKIQYATEFPEQSYLAIPASSWVDDFIDWLTPSSCCRLYISGPNKDKFCPSTVNSLNCLKNCMSITMGSVRPSVEQFHKYLPWFLNDRPNIKCPKGGLAAYSTSVNLTSDGQVLDTVAILSPRLEYSGTISAHCNLYLLDSASRFMAYHKPLKNSQDYTEALRAARELAANITADLRKVPGTDPAFEVFPYTITNVFYEQYLTILPEGLFMLSLCLVPTFAVSCLLLGLDLRSGLLNLLSIVMILVDTVGFMALWGISYNAVSLINLVSAVGMSVEFVSHITRSFAISTKPTWLERAKEATISMGSAVFAGVAMTNLPGILVLGLAKAQLIQIFFFRLNLLITLLGLLHGLVFLPVILSYVGPDVNPALALEQKRAEEAVAAVMVASCPNHPSRVSTADNIYVNHSFEGSIKGAGAISNFLPNNGRQF

SEQ ID NO: 60644 - protein, 439 aa, Homo sapiens
MFSKLAHLQRFAVLSRGVHSSVASATSVATKKTVQGPPTSDDIFEREYKYGAHNYHPLPVALERGKGIYLWDVEGRKYFDFLSSYSAVNQGHCHPKIVNALKSQVDKLTLTSRAFYNNVLGEYEEYITKLFNYHKVLPMNTGVEAGETACKLARKWGYTVKGIQKYKAKIVFAAGNFWGRTLSAISSSTDPTSYDGFGPFMPGFDIIPYNDLPALERALQDPNVAAFMVEPIQGEAGVVVPDPGYLMGVRELCTRHQVLFIADEIQTGLARTGRWLAVDYENVRPDIVLLGKALSGGLYPVSAVLCDDDIMLTIKPGEHGSTYGGNPLGCRVAIAALEVLEEENLAENADKLGIILRNELMKLPSDVVTAVRGKGLLNAIVIKETKDWDAWKVCLRLRDNGLLAKPTHGDIIRFAPPLVIKEDELRESIEIINKTILSF

SEQ ID NO: 60645 - protein, 596 aa, Homo sapiens
MGRGARAAAAQSRWGRASRASVSPGRTIRSAPAVGEAQETEAAPEKENRVDVGAEERAAATRPRQKSWLVRHFSLLLRRDRQAQKAGQLFSGLLALNVVFLGGAFICSMIFNKVAVTLGDVWILLATLKVLSLLWLLYYVASTTRRPHAVLYQDPHAGPLWVRGSLVLFGSCTFCLNIFRVGYDVSHIRCKSQLDLVFSVIEMVFIGVQTWVLWKHCKDCVRVQTNFTRCGLMLTLATNLLLWVLAVTNDSMHREIEAELGILMEKSTGNETNTCLCLNATACEAFRRGFLMLYPFSTEYCLICCAVLFVMWKNVGRHVAPHMGAHPATAPFHLHGAIFGPLLGLLVLLAGVCVFVLFQIEASGPAIACQYFTLYYAFYVAVLPTMSLACLAGTAIHGLEERELDTVKNPTRSLDVVLLMGAALGQMGIAYFSIVAIVAKRPHELLNRLILAYSLLLILQHIAQNLFIIEGLHRRPLWETVPEGLAGKQEAEPPRRGSLLELGQGLQRASLAYIHSYSHLNWKRRALKEISLFLILCNITLWMMPAFGIHPEFENGLEKDFYGYQIWFAIVNFGLPLGVFYRMHSVGGLVEVYLGA

SEQ ID NO: 60646 - protein, 491 aa, Homo sapiens
MEKAADLQDTASLTLKFKFNPKLGIDNPVLSLAEDHDPYDPWSLERPRFCLLSKEEGKSFGFHLQQELGRAGHVVCRVDPGTSAQRQGLQEGDRILAVNNDVVEHEDYAVVVRRIRASSPRVLLTVLARHAHDVARAQLGEDAHLCPTLGPGVRPRLCHIVKDEGGFGFSVTHGNQGPFWLVLSTGGAAERAGVPPGARLLEVNGLWQSGQQVTLLVAGPEVEEQCRQLGLPLAAPLAEGWALPTKPRCLHLEKGPQGFGFLLREEKGLDGRPGQFLWEVDPGLPAKKAGMQAGDRLVAVAGESVEGLGHEETVSRIQGQGSCVSLTVVDPEADRFFSMVRLSPLLFLENTEAPASPQGSSSASLVETEDPSLEDTSVPSVPLGSRQCFLYPGPGGSYGFRLSCVASGPRLFISQVTPGGSAARAGLQVGDVILEVNGYPVGGQNDLERLQQLPEAEPPLCLKLAARSLRGLEAWIPPGAAEDWALASDLL

SEQ ID NO: 60647 - protein, 195 aa, Homo sapiens
MKLASGFLVLWLSLGGGLAQSDTSPDTEESYSDWGLRHLRGSFESVNSYFDSFLELLGGKNGVCQYRCRYGKAPMPRPGYKPQEPNGCGSYFLGLKVPESMDLGIPAMTKCCNQLDVCYDTCGANKYRCDAKFRWCLHSICSDLKRSLGFVSKVEAACDSLVDTVFNTVWTLGCRPFMNSQRAACICAEEEKEEL

SEQ ID NO: 60648 - protein, 762 aa, Homo sapiens
MGNGSVKPKHSKHPDGHSGNLTTDALRNKVTELERELRRKDAEIQEREYHLKELREQLSKQTVAIAELTEELQNKCIQLNKLQDVVHMQGGSPLQASPDKVPLEVHRKTSGLVSLHSRRGAKAGVSAEPTTRTYDLNKPPEFSFEKARVRKDSSEKKLITDALNKNQFLKRLDPQQIKDMVECMYGRNYQQGSYIIKQGEPGNHIFVLAEGRLEVFQGEKLLSSIPMWTTFGELAILYNCTRTASVKAITNVKTWALDREVFQNIMRRTAQARDEQYRNFLRSVSLLKNLPEDKLTKIIDCLEVEYYDKGDYIIREGEEGSTFFILAKGKVKVTQSTEGHDQPQLIKTLQKGEYFGEKALISDDVRSANIIAEENDVACLVIDRETFNQTVGTFEELQKYLEGYVANLNRDDEKRHAKRSMSNWKLSKALSLEMIQLKEKVARFSSSSPFQNLEIIATLGVGGFGRVELVKVKNENVAFAMKCIRKKHIVDTKQQEHVYSEKRILEELCSPFIVKLYRTFKDNKYVYMLLEACLGGELWSILRDRGSFDEPTSKFCVACVTEAFDYLHRLGIIYRDLKPENLILDAEGYLKLVDFGFAKKIGSGQKTWTFCGTPEYVAPEVILNKGHDFSVDFWSLGILVYELLTGNPPFSGVDQMMTYNLILKGIEKMDFPRKITRRPEDLIRRLCRQNPTERLGNLKNGINDIKKHRWLNGFNWEGLKARSLPSPLQRELKGPIDHSYFDKYPPEKGMPPDELSGWDKDF

SEQ ID NO: 60649 - protein, 1019 aa, Homo sapiens
MGSKRGISSRHHSLSSYEIMFAALFAILVVLCAGLIAVSCLTIKESQRGAALGQSHEARATFKITSGVTYNPNLQDKLSVDFKVLAFDLQQMIDEIFLSSNLKNEYKNSRVLQFENGSIIVVFDLFFAQWVSDQNVKEELIQGLEANKSSQLVTFHIDLNSVDILDKLTTTSHLATPGNVSIECLPGSSPCTDALTCIKADLFCDGEVNCPDGSDEDNKMCATVCDGRFLLTGSSGSFQATHYPKPSETSVVCQWIIRVNQGLSIKLSFDDFNTYYTDILDIYEGVGSSKILRASIWETNPGTIRIFSNQVTATFLIESDESDYVGFNATYTAFNSSELNNYEKINCNFEDGFCFWVQDLNDDNEWERIQGSTFSPFTGPNFDHTFGNASGFYISTPTGPGGRQERVGLLSLPLDPTLEPACLSFWYHMYGENVHKLSINISNDQNMEKTVFQKEGNYGDNWNYGQVTLNETVKFKVAFNAFKNKILSDIALDDISLTYGICNGSLYPEPTLVPTPPPELPTDCGGPFELWEPNTTFSSTNFPNSYPNLAFCVWILNAQKGKNIQLHFQEFDLENINDVVEIRDGEEADSLLLAVYTGPGPVKDVFSTTNRMTVLLITNDVLARGGFKANFTTGYHLGIPEPCKADHFQCKNGECVPLVNLCDGHLHCEDGSDEADCVRFFNGTTNNNGLVRFRIQSIWHTACAENWTTQISNDVCQLLGLGSGNSSKPIFSTDGGPFVKLNTAPDGHLILTPSQQCLQDSLIRLQCNHKSCGKKLAAQDITPKIVGGSNAKEGAWPWVVGLYYGGRLLCGASLVSSDWLVSAAHCVYGRNLEPSKWTAILGLHMKSNLTSPQTVPRLIDEIVINPHYNRRRKDNDIAMMHLEFKVNYTDYIQPICLPEENQVFPPGRNCSIAGWGTVVYQGTTANILQEADVPLLSNERCQQQMPEYNITENMICAGYEEGGIDSCQGDSGGPLMCQENNRWFLAGVTSFGYKCALPNRPGVYARVSRFTEWIQSFLH

SEQ ID NO: 60650 - protein, 442 aa, Homo sapiens
MGGSAPPDSSWRGSLKVSYNVGPGFTGNFSTQKVKMHIHSTNEVTRIYNVIGTLRGAVEPDRYVILGGHRDSWVFGGIDPQSGAAVVHETVRSFGTLKKEGWRPRRTILFASWDAEEFGLLGSTEWAEDNSRLLQERGVAYINADSSIEGNYTLRVDCTPLMYSLVYNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYNISMKHPQEMKTYSLSFDSLFSAVKNFTEIASKFSERLQDFDKSNPILLRMMNDQLMFLERAFIDPLGLPDRPFYRHVIYAPSSHNKYAGESFPGIYDALFDIESKVDPSKAWGDVKRQISVAAFTVQAAAETLSEVA

SEQ ID NO: 60651 - protein, 97 aa, Homo sapiens
MVFVRRPWPALTTVLLALLVCLGALVDAYPIKPEAPREDASPEELNRYYASLRHYLNLVTRQRYGKRDGPDTLLSKTFFPDGEDRPVRSRSEGPDLW

SEQ ID NO: 60652 - protein, 111 aa, Homo sapiens
MGPSSCLLLILIPLLQLINPGSTQCSLDSVMDKKIKDVLNSLEYSPSPISKKLSCASVKSQGRPSSCPAGMAVTGCACGYGCGSWDVQLETTCHCQCSVVDWTTARCCHLT

SEQ ID NO: 60653 - protein, 227 aa, Homo sapiens
MACTKTLQQSQPISAGATTTTTAVAPAGGHSGSTECDLECLVCREPYSCPRLPKLLACQHAFCAICLKLLLCVQDNTWSITCPLCRKVTAVPGGLICSLRDHEAVVGQLAQPCTEVSLCPQGLVDPADLAAGHPSLVGEDGQDEVSANHVAARRLAAHLLLLALLIILIGPFIYPGVLRWVLTFIIALALLMSTLFCCLPSTRGSCWPSSRTLFCREQKHSHISSIA

SEQ ID NO: 60654 - protein, 274 aa, Homo sapiens
MASGRLIKFVVFELLEFAAFSIPTLVITEQFATAYQGTRARSDNTHYWLIISCSIAYVALVTLLIWVPVKVILHKKRYIYRKIKGWRPVLMMCVVLTTLPCLTFSIAVTEVQKSINGSADVLPDMLPDLPVSLVLLSLIMVDIIEKLRIYPLRGSQKSSENGHIHSTSLQHIKTVTEQVRQSPENAASPQATNSTQVSQPSGAMTRSQESVFMGPQEPSCDSGILRMMSRRDVRAELFLWSFLLWSDTIEMDFSHTVKEDLLTVVKSLPSSFLI

SEQ ID NO: 60655 - protein, 343 aa, Homo sapiens
MFSLPSLPSWLPGLPSLEWGSSLLDSLLQGLIGALGVLVLNSLLKVYFFVGCANDPQRRPEKERLRAQWASLETVHLAGLALFLTVVGSRVAALVVLEFSLRAVSTLLSLGKGSQGAAERLQLYLLCQYSLGCGLTCGLSFLQEGAPHRTLNLLLSLGLATLLGLGARRLHRHVCRLYELHSSQRYCGVCLGLLAHAHGLPQLLGRALAIAFAVGDLAAVALINQDFLTTSEAMRFWTPLTICYTLLVIYMQEEQRQHPGLQSQVQTVLVRMGGLFVLLLTVGRWLDLLGILVSLLGELWCLVGVRTLLDLCQIQDFPSQRPPVSTPSQPLPSAPQSQSSAPS

SEQ ID NO: 60656 - protein, 79 aa, Homo sapiens
MSTKKSPEELKRIFEKYAAKEGDPDQLSKDELKLLIQAEFPSLLKGPNTLDDLFQELDKNGDGEVSFEEFQVLVKKISQ

SEQ ID NO: 60657 - protein, 477 aa, Homo sapiens
MLLPLLWANEERDSGGWADPRFSTASQDLLSRYRLEVPESVTVQEGLCVSVPCSVLYPHYNWTASSPVYGSWFKEGADIPWDIPVATNTPSGKVQEDTHGRFLLLGDPQTNNCSLSIRDARKGDSGKYYFQVERGSRKWNYIYDKLSVHVTALTHMPTFSIPGTLESGHPRNLTCSVPWACEQGTPPTITWMGASVSSLDPTITRSSMLSLIPQPQDHGTSLTCQVTLPGAGVTMTRAVRLNISYPPQNLTMTVFQGDGTASTTLRNGSALSVLEGQSLHLVCAVDSNPPARLSWTWGSLTLSPSQSSNLGVLELPRVHVKDEGEFTCRAQNPLGSQHISLSLSLQNEYTGKMRPISGVTLGAFGGAGATALVFLYFCIIFVVVRSCRKKSARPAVGVGDTGMEDANAVRGSASQGPLIESPADDSPPHHAPPALATPSPEEGEIQYASLSFHKARPQYPQEQEAIGYEYSEINIPK

SEQ ID NO: 60658 - protein, 595 aa, Homo sapiens
MLLLLLLLPPLLCGRVGAKEQKDYLLTMQKSVTVQEGLCVSVLCSFSYPQNGWTASDPVHGYWFRAGDHVSRNIPVATNNPARAVQEETRDRFHLLGDPQNKDCTLSIRDTRESDAGTYVFCVERGNMKWNYKYDQLSVNVTASQDLLSRYRLEVPESVTVQEGLCVSVPCSVLYPHYNWTASSPVYGSWFKEGADIPWDIPVATNTPSGKVQEDTHGRFLLLGDPQTNNCSLSIRDARKGDSGKYYFQVERGSRKWNYIYDKLSVHVTALTHMPTFSIPGTLESGHPRNLTCSVPWACEQGTPPTITWMGASVSSLDPTITRSSMLSLIPQPQDHGTSLTCQVTLPGAGVTMTRAVRLNISYPPQNLTMTVFQGDGTASTTLRNGSALSVLEGQSLHLVCAVDSNPPARLSWTWGSLTLSPSQSSNLGVLELPRVHVKDEGEFTCRAQNPLGSQHISLSLSLQNEYTGKMRPISGVTLGAFGGAGATALVFLYFCIIFVVVRSCRKKSARPAVGVGDTGMEDANAVRGSASQGPLIESPADDSPPHHAPPALATPSPEEGEIQYASLSFHKARPQYPQEQEAIGYEYSEINIPK

SEQ ID NO: 60659 - protein, 348 aa, Homo sapiens
MNDPNSCVDNATVCSGASCVVPESNFNNILSVVLSTVLTILLALVMFSMGCNVEIKKFLGHIKRPWGICVGFLCQFGIMPLTGFILSVAFDILPLQAVVVLIIGCCPGGTASNILAYWVDGDMDLSVSMTTCSTLLALGMMPLCLLIYTKMWVDSGSIVIPYDNIGTSLVALVVPVSIGMFVNHKWPQKAKIILKIGSIAGAILIVLIAVVGGILYQSAWIIAPKLWIIGTIFPVAGYSLGFLLARIAGLPWYRCRTVAFETGMQNTQLCSTIVQLSFTPEELNVVFTFPLIYSIFQLAFAAIFLGFYVAYKKCHGKNKAEIPESKENGTEPESSFYKANGGFQPDEK

SEQ ID NO: 60660 - protein, 708 aa, Homo sapiens
MGMSKSHSFFGYPLSIFFIVVNEFCERFSYYGMRAILILYFTNFISWDDNLSTAIYHTFVALCYLTPILGALIADSWLGKFKTIVSLSIVYTIGQAVTSVSSINDLTDHNHDGTPDSLPVHVVLSLIGLALIALGTGGIKPCVSAFGGDQFEEGQEKQRNRFFSIFYLAINAGSLLSTIITPMLRVQQCGIHSKQACYPLAFGVPAALMAVALIVFVLGSGMYKKFKPQGNIMGKVAKCIGFAIKNRFRHRSKAFPKREHWLDWAKEKYDERLISQIKMVTRVMFLYIPLPMFWALFDQQGSRWTLQATTMSGKIGALEIQPDQMQTVNAILIVIMVPIFDAVLYPLIAKCGFNFTSLKKMAVGMVLASMAFVVAAIVQVEIDKTLPVFPKGNEVQIKVLNIGNNTMNISLPGEMVTLGPMSQTNAFMTFDVNKLTRINISSPGSPVTAVTDDFKQGQRHTLLVWAPNHYQVVKDGLNQKPEKGENGIRFVNTFNELITITMSGKVYANISSYNASTYQFFPSGIKGFTISSTEIPPQCQPNFNTFYLEFGSAYTYIVQRKNDSCPEVKVFEDISANTVNMALQIPQYFLLTCGEVVFSVTGLEFSYSQAPSNMKSVLQAGWLLTVAVGNIIVLIVAGAGQFSKQWAEYILFAALLLVVCVIFAIMARFYTYINPAEIEAQFDEDEKKNRLEKSNPYFMSGANSQKQM

SEQ ID NO: 60661 - protein, 589 aa, Homo sapiens
MPFKAFDTFKEKILKPGKEGVKNAVGDSLGILQRKIDGTTEEEDNIELNEEGRPVQTSRPSPPLCDCHCCGLPKRYIIAIMSGLGFCISFGIRCNLGVAIVEMVNNSTVYVDGKPEIQTAQFNWDPETVGLIHGSFFWGYIMTQIPGGFISNKFAANRVFGAAIFLTSTLNMFIPSAARVHYGCVMCVRILQGLVEGVTYPACHGMWSKWAPPLERSRLATTSFCGSYAGAVVAMPLAGVLVQYIGWSSVFYIYGMFGIIWYMFWLLQAYECPAAHPTISNEEKTYIETSIGEGANVVSLSKFSTPWKRFFTSLPVYAIIVANFCRSWTFYLLLISQPAYFEEVFGFAISKVGLLSAVPHMVMTIVVPIGGQLADYLRSRQILTTTAVRKIMNCGGFGMEATLLLVVGFSHTKGVAISFLVLAVGFSGFAISGFNVNHLDIAPRYASILMGISNGVGTLSGMVCPLIVGAMTRHKTREEWQNVFLIAALVHYSGVIFYGVFASGEKQEWADPENLSEEKCGIIDQDELAEEIELNHESFASPKKKMSYGATSQNCEVQKKEWKGQRGATLDEEELTSYQNEERNFSTIS

SEQ ID NO: 60662 - protein, 598 aa, Homo sapiens
MRAQEDLEGRTQHETTRDPSTPLPTEPKFDMLYKIEDVPPWYLCILLGFQHYLTCFSGTIAVPFLLAEALCVGHDQHMVSQLIGTIFTCVGITTLIQTTVGIRLPLFQASAFAFLVPAKAILALERWKCPPEEEIYGNWSLPLNTSHIWHPRIREVQGAIMVSSVVEVVIGLLGLPGALLNYIGPLTVTPTVSLIGLSVFQAAGDRAGSHWGISACSILLIILFSQYLRNLTFLLPVYRWGKGLTLLRIQIFKMFPIMLAIMTVWLLCYVLTLTDVLPTDPKAYGFQARTDARGDIMAIAPWIRIPYPCQWGLPTVTAAAVLGMFSATLAGIIESIGDYYACARLAGAPPPPVHAINRGIFTEGICCIIAGLLGTGNGSTSSSPNIGVLGITKVGSRRVVQYGAAIMLVLGTIGKFTALFASLPDPILGGMFCTLFGMITAVGLSNLQFVDMNSSRNLFVLGFSMFFGLTLPNYLESNPGAINTGILEVDQILIVLLTTEMFVGGCLAFILDNTVPGSPEERGLIQWKAGAHANSDMSSSLKSYDFPIGMGIVKRITFLKYIPICPVFKGFSSSSKDQIAIPEDTPENTETASVCTKV

SEQ ID NO: 60663 - protein, 602 aa, Homo sapiens
MRAQEDLEGRTQHETTRDPSTPLPTEPKFDMLYKIEDVPPWYLCILLGFQHYLTCFSGTIAVPFLLAEALCVGHDQHMVSQLIGTIFTCVGITTLIQTTVGIRLPLFQASAFAFLVPAKAILALERWKCPPEEEIYGNWSLPLNTSHIWHPRIREVGLHVQGAIMVSSVVEVVIGLLGLPGALLNYIGPLTVTPTVSLIGLSVFQAAGDRAGSHWGISACSILLIILFSQYLRNLTFLLPVYRWGKGLTLLRIQIFKMFPIMLAIMTVWLLCYVLTLTDVLPTDPKAYGFQARTDARGDIMAIAPWIRIPYPCQWGLPTVTAAAVLGMFSATLAGIIESIGDYYACARLAGAPPPPVHAINRGIFTEGICCIIAGLLGTGNGSTSSSPNIGVLGITKVGSRRVVQYGAAIMLVLGTIGKFTALFASLPDPILGGMFCTLFGMITAVGLSNLQFVDMNSSRNLFVLGFSMFFGLTLPNYLESNPGAINTGILEVDQILIVLLTTEMFVGGCLAFILDNTVPGSPEERGLIQWKAGAHANSDMSSSLKSYDFPIGMGIVKRITFLKYIPICPVFKGFSSSSKDQIAIPEDTPENTETASVCTKV

SEQ ID NO: 60664 - protein, 492 aa, Homo sapiens
MSRSPLNPSQLRSVGSQDALAPLPPPAPQNPSTHSWDPLCGSLPWGLSCLLALQHVLVMASLLCVSHLLLLCSLSPGGLSYSPSQLLASSFFSCGMSTILQTWMGSRLPLVQAPSLEFLIPALVLTSQKLPRAIQTPGNSSLMLHLCRGPSCHGLGHWNTSLQEVSGAVVVSGLLQGMMGLLGSPGHVFPHCGPLVLAPSLVVAGLSAHREVAQFCFTHWGLALLTWAPASFMCAPGGELQRHQLTLLSLSSGSFRNCLPPPRHHGFGCLTQAGSQQVAHLVGLLCVGLGLSPRLAQLLTTIPLPVVGGVLGVTQAVVLSAGFSSFYLADIDSGRNIFIVGFSIFMALLLPRWFREAPVLFSTGWSPLDVLLHSLLTQPIFLAGLSGFLLENTIPGTQLERGLGQGLPSPFTAQEARMPQKPREKAQVYRLPFPIQNLCPCIPQPLHCLCPLPEDPGDEEGGSSEPEEMADLLPGSGEPCPESSREGFRSQK

SEQ ID NO: 60665 - protein, 658 aa, Homo sapiens
MEKASGRQSIALSTVETGTVNPGLELMEKEVEPEGSKRTDAQGHSLGDGLGPSTYQRRSRWPFSKARSFCKTHARLFKKILLGLLCLAYAAYLLAACILNFQRALALFVITCLVIFVLVHSFLKKLLGKKLTRCLKPFENSRLRLWTKWVFAGVSLVGLILWLALDTAQRPEQLIPFAGICMFILILFACSKHHSAVSWRTVFSGLGLQFVFGILVIRTDLGYTVFQWLGEQVQIFLNYTVAGSSFVFGDTLVKDVFAFQALPIIIFFGCVVSILYYLGLVQWVVQKVAWFLQITMGTTATETLAVAGNIFVGMTEAPLLIRPYLGDMTLSEIHAVMTGGFATISGTVLGAFIAFGVDASSLISASVMAAPCALASSKLAYPEVEESKFKSEEGVKLPRGKERNVLEAASNGAVDAIGLATNVAANLIAFLAVLAFINAALSWLGELVDIQGLTFQVICSYLLRPMVFMMGVEWTDCPMVAEMVGIKFFINEFVAYQQLSQYKNKRLSGMEEWIEGEKQWISVRAEIITTFSLCGFANLSSIGITLGGLTSIVPHRKSDLSKVVVRALFTGACVSLISACMAGILYVPRGAEADCVSFPNTSFTNRTYETYMCCRGLFQSTSLNGTNPPSFSGPWEDKEFSAMALTNCCGFYNNTVCA

SEQ ID NO: 60666 - protein, 626 aa, Homo sapiens
MVDVVGLERETGPRGSPWPGLPLPSLVGPAPLLTCLCPQCLSVEDALGLGEPEGSGLPPGPVLEARYVARLSAAAVLYLSNPEGTCEDARAGLWASHADHLLALLESPKALTPGLSWLLQRMQARAAGQTPKTACVDIPQLLEEAVGAGAPGSAGGVLAALLDHVRSGSCFHALPSPQYFVDFVFQQHSSEVPMTLAELSALMQRLGVGREAHSDHSHRHRGASSRDPVPLISSSNSSSVWDTVCLSARDVMAAYGLSEQAGVTPEAWAQLSPALLQQQLSGAYTSQSRPPVQDQLSQSERYLYGSLATLLICLCAVFGLLLLTCTGCRGVAHYILQTFLSLAVGALTGDAVLHLTPKVLGLHTHSEEGLSPQPTWRLLAMLAGLYAFFLFENLFNLLLPRDPEDLEDGPCGHSSHSHGGHSHGVSLQLAPSELRQPKPPHEGSRADLVAEESPELLNPEPRRLSPELRLLPYMITLGDAVHNFADGLAVGAAFASSWKTGLATSLAVFCHELPHELGDFAALLHAGLSVRQALLLNLASALTAFAGLTWHSRLESARRARPGSWQWPPACSLRSTLRHAPGDVESTGPAAPGSSSCCTTWACWAAGPSCCCCPCTRMTSPSDTLP

SEQ ID NO: 60667 - protein, 647 aa, Homo sapiens
MASLVSLELGLLLAVLVVTATASPPAGLLSLLTSGQGALDQEALGGLLNTLADRVHCTNGPCGKCLSVEDALGLGEPEGSGLPPGPVLEARYVARLSAAAVLYLSNPEGTCEDTRAGLWASHADHLLALLESPKALTPGLSWLLQRMQARAAGQTPKTACVDIPQLLEEAVGAGAPGSAGGVLAALLDHVRSGSCFHALPSPQYFVDFVFQQHSSEVPMTLAELSALMQRLGVGREAHSDHSHRHRGASSRDPVPLISSSNSSSVWDTVCLSARDVMAAYGLSEQAGVTPEAWAQLSPALLQQQLSGACTSQSRPPVQDQLSQSERYLYGSLATLLICLCAVFGLLLLTCTGCRGVAHYILQTFLSLAVGALTGDAVLHLTPKVLGLHTHSEEGLSPQPTWRLLAMLAGLYAFFLFENLFNLLLPRDPEDLEDGPCGHSSHSHGGHSHGVSLQLAPSELRQPKPPHEGSRADLVAEESPELLNPEPRRLSPELRLLPYMITLGDAVHNFADGLAVGAAFASSWKTGLATSLAVFCHELPHELGDFAALLHAGLSVRQALLLNLASALTAFAGLYVALAVGVSEESEAWILAVATGLFLYVALCDMLPAMLKVRDPRPWLLFLLHNVGLLGGWTVLLLLSLYEDDITF

SEQ ID NO: 60668 - protein, 539 aa, Homo sapiens
MGSPVSHLLAGFCVWVVLGWVGGSVPNLGPAEQEQNHYLAQLFGLYGENGTLTAGGLARLLHSLGLGRVQGLRLGQHGPLTGRAASPAADNSTHRPQNPELSVDVWAGMPLGPSGWGDLEESKAPHLPRGPAPSGLDLLHRLLLLDHSLADHLNEDCLNGSQLLVNFGLSPAAPLTPRQFALLCPALLYQIDSRVCIGAPAPAPPGDLLSALLQSALAVLLLSLPSPLSLLLLRLLGPRLLRPLLGFLGALAVGTLCGDALLHLLPHAQEGRHAGPGGLPEKDLGPGLSVLGGLFLLFVLENMLGLLRHRGLRPRCCRRKRRNLETRNLDPENGSGMALQPLQAAPEPGAQGQREKNSQHPPALAPPGHQGHSHGHQGGTDITWMVLLGDGLHNLTDGLAIGAAFSDGFSSGLSTTLAVFCHELPHELGDFAMLLQSGLSFRRLLLLSLVSGALGLGGAVLGVGLSLGPVPLTPWVFGVTAGVFLYVALVDMLPALLRPPEPLPTPHVLLQGLGLLLGGGLMLAITLLEERLLPVTTEG

SEQ ID NO: 60669 - protein, 699 aa, Homo sapiens
MGPGASGDGVRTETAPHIALDSRVGLHAYDISVVVIYFVFVIAVGIWSSIRASRGTIGGYFLAGRSMSWWPIGASLMSSNVGSGLFIGLAGTGAAGGLAVGGFEWNMRKSRSGGDRGIHPRSHGRTGVRSQATWLLLALGWVFVPVYIAAGVVTMPQYLKKRFGGQRIQVYMSVLSLILYIFTKISTDIFSGALFIQMALGWNLYLSTGILLVVTAVYTIAGGLMAVIYTDALQTVIMVGGALVLMFLGFQDVGWYPGLEQRYRQAIPNVTVPNTTCHLPRPDAFHILRDPVSGDIPWPGLIFGLTVLATWCWCTDQVIVQRSLSAKSLSHAKGGSVLGGYLKILPMFFIVMPGMISRALFPDEVGCVDPDVCQRICGARVGCSNIAYPKLVMALMPVGLRGLMIAVIMAALMSSLTSIFNSSSTLFTIDVWQRFRRKSTEQELMVVGRVFVVFLVVISILWIPIIQSSNSGQLFDYIQAVTSYLAPPITALFLLAIFCKRVTEPGAFWGLVFGLGVGLLRMILEFSYPAPACGEVDRRPAVLKDFHYLYFAILLCGLTAIVIVIVSLCTTPIPEEQLTRLTWWTRNCPLSELEKEAHESTPEISERPAGECPAGGGAAENSSLGQEQPEAPSRSWGKLLWSWFCGLSGTPEQALSPAEKAALEQKLTSIEEEPLWRHVCNINAVLLLAINIFLWGYFA

SEQ ID NO: 60670 - protein, 634 aa, Homo sapiens
MVRLVLPNPGLDARIPSLAELETIEQEEASSRPKWDNKAQYMLTCLGFCVGLGNVWRFPYLCQSHGGGAFMIPFLILLVLEGIPLLYLEFAIGQRLRRGSLGVWSSIHPALKGLGLASMLTSFMVGLYYNTIISWIMWYLFNSFQEPLPWSDCPLNENQTGYVDECARSSPVDYFWYRETLNISTSISDSGSIQWWMLLCLACAWSVLYMCTIRGIETTGKAVYITSTLPYVVLTIFLIRGLTLKGATNGIVFLFTPNVTELAQPDTWLDAGAQVFFSFSLAFGGLISFSSYNSVHNNCEKDSVIVSIINGFTSVYVAIVVYSVIGFRATQRYDDCFSTNILTLINGFDLPEGNVTQENFVDMQQRCNASDPAAYAQLVFQTCDINAFLSEAVEGTGLAFIVFTEAITKMPLSPLWSVLFFIMLFCLGLSSMFGNMEGVVVPLQDLRVIPPKWPKEVLTGLICLGTFLIGFIFTLNSGQYWLSLLDSYAGSIPLLIIAFCEMFSVVYVYGVDRFNKDIEFMIGHKPNIFWQVTWRVVSPLLMLIIFLFFFVVEVSQELTYSIWDPGYEEFPKSQKISYPNWVYVVVVIVAGVPSLTIPGYAIYKLIRNHCQKPGDHQGLVSTLSTASMNGDLKY

SEQ ID NO: 60671 - protein, 592 aa, Homo sapiens
MEKARPLWANSLQFVFACISYAVGLGNVWRFPYLCQMYGGGSFLVPYIIMLIVEGMPLLYLELAVGQRMRQGSIGAWRTISPYLSGVGVASVVVSFFLSMYYNVINAWAFWYLFHSFQDPLPWSVCPLNGNHTGYDEECEKASSTQYFWYRKTLNISPSLQENGGVQWEPALCLLLAWLVVYLCILRGTESTGKVVYFTASLPYCVLIIYLIRGLTLHGATNGLMYMFTPKIEQLANPKAWINAATQIFFSLGLGFGSLIAFASYNEPSNNCQKHAIIVSLINSFTSIFASIVTFSIYGFKATFNYENCLKKVSLLLTNTFDLEDGFLTASNLEQVKGYLASAYPSKYSEMFPQIKNCSLESELDTAVQGTGLAFIVYTEAIKNMEVSQLWSVLYFFMLLMLGIGSMLGNTAAILTPLTDSKIISSHLPKEAISGLVCLVNCAIGMVFTMEAGNYWFDIFNDYAATLSLLLIVLVETIAVCYVYGLRRFESDLKAMTGRAVSWYWKVMWAGVSPLLIVSLFVFYLSDYILTGTLKYQAWDASQGQLVTKDYPAYALAVIGLLVASSTMCIPLAALGTFVQRRLKRGDADPVA

SEQ ID NO: 60672 - protein, 555 aa, Homo sapiens
MEKARPLWANSLQFVFACISYAVGLGNVWRFPYLCQMYGGGSFLVPYIIMLIVEGMPLLYLELAVGQRMRQGSIGAWRTISPYLSGVGVASVVVSFFLSMYYNVINAWAFWYLFHSFQDPLPWSVCPLNGNHTGYDEECEKASSTQYFWYRKTLNISPSLQENGGVQWEPALCLLLAWLVVYLCILRGTESTGKIEQLANPKAWINAATQIFFSLGLGFGSLIAFASYNEPSNNCQKHAIIVSLINSFTSIFASIVTFSIYGFKATFNYENCLKKVSLLLTNTFDLEDGFLTASNLEQVKGYLASAYPSKYSEMFPQIKNCSLESELDTAVQGTGLAFIVYTEAIKNMEVSQLWSVLYFFMLLMLGIGSMLGNTAAILTPLTDSKIISSHLPKEAISGLVCLVNCAIGMVFTMEAGNYWFDIFNDYAATLSLLLIVLVETIAVCYVYGLRRFESDLKAMTGRAVSWYWKVMWAGVSPLLIVSLFVFYLSDYILTGTLKYQAWDASQGQLVTKDYPAYALAVIGLLVASSTMCIPLAALGTFVQRRLKRGDADPVA

SEQ ID NO: 60673 - protein, 487 aa, Homo sapiens
MGDTGLRKRREDEKSIQSQEPKTTSLQKELGLISGISIIVGTIIGSGIFVSPKSVLSNTEAVGPCLIIWAACGVLATLGALCFAELGTMITKSGGEYPYLMEAYGPIPAYLFSWASLIVIKPTSFAIICLSFSEYVCAPFYVGCKPPQIVVKCLAAAAILFISTVNSLSVRLGSYVQNIFTAAKLVIVAIIIISGLVLLAQGNTKNFDNSFEGAQLSVGAISLAFYNGLWAYDGWNQLNYITEELRNPYRNLPLAIIIGIPLVTACYILMNVSYFTVMTATELLQSQAVAVTFGDRVLYPASWIVPLFVAFSTIGAANGTCFTAGRLIYVAGREGHMLKVLSYISVRRLTPAPAIIFYGIIATIYIIPGDINSLVNYFSFAAWLFYGLTILGLIVMRFTRKELERPIKVPVVIPVLMTLISVFLVLAPIISKPTWEYLYCVLFILSGLLFYFLFVHYKFGWAQKISKPITMHLQMLMEVVPPEEDPE

SEQ ID NO: 60674 - protein, 86 aa, Homo sapiens
MAVRQWVIALALAALLVVDREVPVAAGKLPFSRMPICEHMVESPTCSQMSNLVCGTDGLTYTNECQLCLARIKTKQDIQIMKDGKC

SEQ ID NO: 60675 - protein, 600 aa, Homo sapiens
MRSCLWRCRHLSQGVQWSLLLAVLVFFLFALPSFIKEPQTKPSRHQRTENIKERSLQSLAKPKSQAPTRARRTTIYAEPVPENNALNTQTQPKAHTTGDRGKEANQAPPEEQDKVPHTAQRAAWKSPEKEKTMVNTLSPRGQDAGMASGRTEAQSWKSQDTKTTQGNGGQTRKLTASRTVSEKHQGKAATTAKTLIPKSQHRMLAPTGAVSTRTRQKGVTTAVIPPKEKKPQATPPPAPFQSPTTQRNQRLKAANFKSEPRWDFEEKYSFEIGGLQTTCPDSVKIKASKSLWLQKLFLPNLTLFLDSRHFNQSEWDRLEHFAPPFGFMELNYSLVQKVVTRFPPVPQQQLLLASLPAGSLRCITCAVVGNGGILNNSHMGQEIDSHDYVFRLSGALIKGYEQDVGTRTSFYGFTAFSLTQSLLILGNRGFKNVPLGKDVRYLHFLEGTRDYEWLEALLMNQTVMSKNLFWFRHRPQEAFREALHMDRYLLLHPDFLRYMKNRFLRSKTLDGAHWRIYRPTTGALLLLTALQLCDQVSAYGFITEGHERFSDHYYDTSWKRLIFYINHDFKLEREVWKRLHDEGIIRLYQRPGPGTAKAKN

SEQ ID NO: 60676 - protein, 385 aa, Homo sapiens
MAAFLSAGLGILAPSETYPLPTTSSGWEPRLGSPFPSGPCTSSTGAQAVAEPTGQGPKNPRVSRVTVQLEMKPLWEEFNQLGTEMIVTKAGRRMFPPFQVKILGMDSLADYALLMDFIPLDDKRYRYAFHSSAWLVAGKADPATPGRVHFHPDSPAKGAQWMRQIVSFDKLKLTNNLLDDNGHIILNSMHRYQPRFHVVFVDPRKDSERYAQENFKSFIFTETQFTAVTAYQNHRITQLKIASNPFAKGFRESDLDSWPVAPRPLLSVPARSHSSLSPCVLKGATDREKDPNKASASTSKTPAWLHHQLLPPPEVLLAPATYRPVTYQSLYSGAPSHLGIPRTRPAPYPLPNIRADRDQGGLPLPAGLGLLSPTVVCLGPGQDSQ

SEQ ID NO: 60677 - protein, 229 aa, Homo sapiens
MTCCEGWTSCNGFSLLVLLLLGVVLNVIPLIVSLVEEDQFSQNPISCFEWWFPGIIGAGLMAIPATTMSLTARKRACCNNRTGMFLSSLFSVITVIGALYCMLISIQALLKGPLMCNSPSNSNANCEFSLKNISDIHPESFNLQWFFNDSCAPPTGFNKPTSNDTMASGWRASSFHFDSEENKHRLIHFSVFLGLLLVGILEVLFGLSQIVIGFLGCLCGVSKRRSQIV

SEQ ID NO: 60678 - protein, 351 aa, Homo sapiens
MDIPPLAGKIAALSLSALPVSYALNHVSALSHPLWVALMSALILGLLFVAVYSLSHGEVSYDPLYAVFAVFAFTSVVDLIIALQEDSYVVGFMEFYTKEGEPYLRTAHGVFICYWDGTVHYLLYLAMAGAICRRKRYRNFGLYWLGSFAMSILVFLTGNILGKYSSEIRPAFFLTIPYLLVPCWAGMKVFSQPRALTRCTANMVQEEQRKGLLQRPADLALVIYLILAGFFTLFRGLVVLDCPTDACFVYIYQYEPYLRDPVAYPKVQMLMYMFYVLPFCGLAAYALTFPGCSWLPDWALVFAGGIGQAQFSHMGASMHLRTPFTYRCLQWPAFFHQPPPSDPLALHKKQH

SEQ ID NO: 60679 - protein, 213 aa, Homo sapiens
MDIPPLAGKIAALSLSALPVSYALNHVSALSHPLWVALMSALILGLLFVAVYSLSHGEVSYDPLYAVFAVFAFTSVVDLIIALQEDSYVVGFMEFYTKEVLGGRPGSPLPHCPSESPTCPHRESHTCAQRTESSSATGMALFTTSSTWPWPAPSAEGAGGRERVAPDPGREVASSDGVPGQGGARSVCRRNQDASLGLQPGVARRRFQGTSQV

SEQ ID NO: 60680 - protein, 364 aa, Homo sapiens
MRPQDSTGVAELQEPGLPLTDDAPPGATEEPAAAEAAGAPDRGRCWLCLSSPCCSRTEPAKKKAPCPGLGLFYTLLSAFLFSVGSLFVKKVQDVHAVEISAFRCVFQMLVVIPCLIYRKTGFIGPKGQRIFLILRGVLGSTAMMLIYYAYQTMSLADATVITFSSPVFTSIFAWICLKEKYSPWDALFTVFTITGVILIVRPPFLFGSDTSGMEESYSGHLKGTFAAIGSAVFAASTLVILRKMGKSVDYFLSIWYYVVLGLVESVIILSVLGEWSLPYCGLDRLFLIFIGLFGLGGQIFITKALQIEKAGPVAIMKTMDVVFAFIFQIIFFNNVPTWWTVGGALCVVASNVGAAIRKWYQSSK

SEQ ID NO: 60681 - protein, 321 aa, Homo sapiens
MALGACGLLLLLAVPGVSLRTLQPGCGRPQVSDAGGRIVGGHAAPAGAWPWQASLRLRRMHVCGGSLLSPQWVLTAAHCFSGSLNSSDYQVHLGELEITLSPHFSTVRQIILHSSPSGQPGTSGDIALVELSVPVTLSSRILPVCLPEASDDFCPGIRCWVTGWGYTREGEPLPPPYSLREVKVSVVDTETCRRDYPGPGGSILQPDMLCARGPGDACQDDSGGPLVCQVNGAWVQAGIVSWGEGCGRPNRPGVYTRVPAYVNWIRRHITASGGSESGYPRLPLLAGFFLPGLFLLLVSCVLLAKCLLHPSADGTPFPAPD

SEQ ID NO: 60682 - protein, 914 aa, Homo sapiens
MSQSQNAIFTSPTGEENLMNSNHRDSESITDVCSNEDLPEVELVSLLEEQLPQYRLKVDTLFLYENQDWTQSPHQRQHASDALSPVLAEETFRYMILGTDRVEQMTKTYNDIDMVTHLLAERDRDLELAARIGQALLKRNHILSEQNESLEEQLGQAFDQVNQLQHELCKKDELLRIVSIASEESETDSSCSTPLRFNESFSLSQGLLQLEMLQEKLKELEEENMALRSKACHIKTETVTYEEKEQQLVSDCVKELRETNAQMSRMTEELSGKSDELIRYQEELSSLLSQIVDLQHKLKEHVIEKEELKLHLQASKDAQRQLTMELHELQDRNMECLGMLHESQEEIKELRSRSGPTAHLYFSQSYGAFTGESLAAEIEGTMRKKLSLDEESSLFKQKAQQKRVFDTVRIANDTRGRSISFPALLPIPGSNRSSVIMTAKPFESGLQQTEDKSLLNQGSSSEEVAGSSQKMGQPGPSGDSDLATALHRLSLRRQNYLSEKQFFAEEWQRKIQVLADQKEGVSGCVTPTESLASLCTTQSEITDLSSASCLRGFMPEKLQIVKPLEGSQTLYHWQQLAQPNLGTILDPRPGVITKGFTQLPGDAIYHISDLEEDEEEGITFQVQQPLEVEEKLSTSKPVTGIFLPPITSAGGPVTVATANPGKCLSCTNSTFTFTTCRILHPSDITQVTPSSGFPSLSCGSSGSSSSNTAVNSPALSYRLSIGESITNRRDSTTTFSSTMSLAKLLQERGISAKVYHSPISENPLQPLPKSLAIPSTPPNSPSHSPCPSPLPFEPRVHLSENFLASRPAETFLQEMYGLRPSRNPPDVGQLKMNLVDRLKRLGIARVVKNPGAQENGRCQEAEIGPQKPDSAVYLNSGSSLLGGLRRNQSLPVIMGSFAAPVCTSSPKMGVLKED

SEQ ID NO: 60683 - protein, 583 aa, Homo sapiens
MPGRTWELCLLLLLGLGLGSQEALPPPCESEIYCHGELLNQVQMAKLYQDDKQFVDMPLSIAPEQVLQTFTELSRDHNHSIPREQLQAFVHEHFQAKGQELQPWTPADWKDSPQFLQKISDAKLRAWAGQLHQLWKKLGKKMKPEVLSHPERFSLIYSEHPFIVPGGRFVEFYYWDSYWVMEGLLLSEMAETVKGMLQNFLDLVKTYGHVPNGGRVYYLQRSQPPLLTLMMDCYLTHTNDTAFLQENIETLALELDFWTKNRTVSVSLEGKNYLLNRYYVPYGGPRPESYSKDVELADTLPEGDREALWAELKAGAESGWDFSSRWLIGGPNPNSLSGIRTSKLVPVDLNAFLCQAEELMSNFYSRLGNDSQATKYRILRSQRLAALNTVLWDEQTGAWFDYDLEKKKKNREFYPSNLTPLWAGCFSDPGVADKALKYLEDNRILTYQYGIPTSLQKTGQQWDFPNAWAPLQDLVIRGLAKAPLRRAQEVAFQLAQNWIRTNFDVYSQKSAMYEKYDVSNGGQPGGGGEYEVQEGFGWDEGVVLMLLDRYGDRLTSGAKLAFLEPHCLAATLLPSLLLSLLPW

SEQ ID NO: 60684 - protein, 446 aa, Homo sapiens
MRECLSIHIGQAGIQIGDACWELYCLEHGIQPNGVVLDTQQDQLENAKMEHTNASFDTFFCETRAGKHVPRALFVDLEPTVIDGIRTGQHRSLFHPEQLLSGKEDAANNYARGRYSVGSEVIDLVLERTRKLAEQCGGLQGFLIFRSFGGGTGSGFTSLLMERLTGEYSRKTKLEFSVYPAPRISTAVVEPYNSVLTTHSTTEHTDCTFMVDNEAVYDICHRKLGVECPSHASINRLVVQVVSSITASLRFEGPLNVDLIEFQTNLVPYPRIHFPMTAFAPIVSADKAYHEQFSVSDITTACFESSNQLVKCDPRLGKYMACCLLYRGDVVPKEVNAAIAATKSRHSVQFVDWCPTGFKVGINNRPPTVMPGGDLAKVHRSICMLSNTTAIVEAWARLDHKFDLMYAKRAFLHWYLREGMEEAEFLEAREDLAALERDYEEVAQSF

SEQ ID NO: 60685 - protein, 674 aa, Homo sapiens
MARAHWGCCPWLVLLCACAWGHTKPVDLGGQDVRNCSTNPPYLPVTVVNTTMSLTALRQQMQTQNLSAYIIPGTDAHMNEYIGQHDERRAWITGFTGSAGTAVVTMKKAAVWTDSRYWTQAERQMDCNWELHKEVGTTPIVTWLLTEIPAGGRVGFDPFLLSIDTWESYDLALQGSNRQLVSITTNLVDLVWGSERPPVPNQPIYALQEAFTGSTWQEKVSGVRSQMQKHQKVPTAVLLSALEETAWLFNLRASDIPYNPFFYSYTLLTDSSIRLFANKSRFSSETLSYLNSSCTGPMCVQIEDYSQVRDSIQAYSLGDVRIWIGTSYTMYGIYEMIPREKLVTDTYSPVMMTKAVKNSKEQALLKASHVRDAVAVIRYLVWLEKNVPKGTVDEFSGAEIVDKFRGEEQFSSGPSFETISASGLNAALAHYSPTKELNRKLSSDEMYLLDSGGQYWDGTTDITRTVHWGTPSAFQKEAYTRVLIGNIDLSRLIFPAATSGRMVEAFARRALWDAGLNYGHGTGHGIGNFLCVHEWPVGFQSNNIAMAKGMFTSIEPGYYKDGEFGIRLEDVALVVEAKTKYPGSYLTFEVVSFVPYDRNLIDVSLLSPEHLQYLNRYYQTIREKVGPELQRRQLLEEFEWLQQHTEPLAARAPDTASWASVLVVSTLAILGWSV

SEQ ID NO: 60686 - protein, 340 aa, Homo sapiens
MPEWPPCLSVAPALVITMAAGKGAPLSPSAENRWRLSEPELGRGCKPVLLEKTNRLGPEAAVGRAGRDVGSAELALLVAPGKPRPGKPLPPKTRGEQRQSAFTELPRMKDRQVDAQAQEREHDDPTGQPGAPQLTQNIPRGPAGSKVFSVWPSGARSEQRSAFSKPTKRPAERPELTSVFPAGESADALGELSGLLNTTDLACWGRLSTPKLLVGDLWNLQALPQNAPLCSTFLGAPTLWLEHTQAQVPPPSSSSTTSWALLPPTLTSLGLSTQNWCAKCNLSFRLTSDLVFHMRSHHKKEHAGPDPHSQKRREEALACPVCQEHFRERHHLSRHMTSHS

SEQ ID NO: 60687 - DNA, 20 bp, Homo sapiens
gatcattgaaaaaacccctt

SEQ ID NO: 60688 - DNA, 20 bp, Homo sapiens
gatccatgctcagacaggat

SEQ ID NO: 60689 - DNA, 20 bp, Homo sapiens
gatcgctactgaagcaatag

SEQ ID NO: 60690 - DNA, 20 bp, Homo sapiens
gatctgatgtcaaacatcac

SEQ ID NO: 60691 - DNA, 20 bp, Homo sapiens
gatctacaaaaaggccttac

SEQ ID NO: 60692 - DNA, 20 bp, Homo sapiens
gatctaccttcataaaggaa

SEQ ID NO: 60693 - DNA, 20 bp, Homo sapiens
gatccaagcaggccttgaat

SEQ ID NO: 60694 - DNA, 20 bp, Homo sapiens
gatcctcggggagcttccgg

SEQ ID NO: 60695 - DNA, 20 bp, Homo sapiens
gatccctgaggacagggact

SEQ ID NO: 60696 - DNA, 20 bp, Homo sapiens
gatcaagcagtgcaccaccg

SEQ ID NO: 60697 - DNA, 20 bp, Homo sapiens
gatcagtggcgctggagggt

SEQ ID NO: 60698 - DNA, 20 bp, Homo sapiens
gatctgacgaatgtgatggc

SEQ ID NO: 60699 - DNA, 20 bp, Homo sapiens
gatctgtcctcctgttaccc

SEQ ID NO: 60700 - DNA, 20 bp, Homo sapiens
gatcaacatctccctgacaa

SEQ ID NO: 60701 - DNA, 20 bp, Homo sapiens
gatcgattccaaacatcact

SEQ ID NO: 60702 - DNA, 20 bp, Homo sapiens
gatcggaagaagaaaaataa

SEQ ID NO: 60703 - DNA, 20 bp, Homo sapiens
gatcatcgaccgtaaaaaga

SEQ ID NO: 60704 - DNA, 20 bp, Homo sapiens
gatcttatccctatatgatg

SEQ ID NO: 60705 - DNA, 20 bp, Homo sapiens
gatctttgttcccagttcag

SEQ ID NO: 60706 - DNA, 20 bp, Homo sapiens
gatccgcatcagcggttctg

SEQ ID NO: 60707 - DNA, 20 bp, Homo sapiens
gatcatgaatttgtgactta

SEQ ID NO: 60708 - DNA, 20 bp, Homo sapiens
gatccacgaccatgctcagc

SEQ ID NO: 60709 - DNA, 20 bp, Homo sapiens
gatctttaaaaaaaaagaaa

SEQ ID NO: 60710 - DNA, 20 bp, Homo sapiens
gatctcggccacttcccagg

SEQ ID NO: 60711 - DNA, 20 bp, Homo sapiens
gatctggaagtggctgaaat

SEQ ID NO: 60712 - DNA, 20 bp, Homo sapiens
gatcttaaataagcttggct

SEQ ID NO: 60713 - DNA, 20 bp, Homo sapiens
gatcaaatttcacacagcag

SEQ ID NO: 60714 - DNA, 20 bp, Homo sapiens
gatcaaggtggaaaacactg

SEQ ID NO: 60715 - DNA, 20 bp, Homo sapiens
gatcccctttccattggcaa

SEQ ID NO: 60716 - DNA, 20 bp, Homo sapiens
gatccttttccacgagaccc

SEQ ID NO: 60717 - DNA, 20 bp, Homo sapiens
gatccaaggagcgcttgagg

SEQ ID NO: 60718 - DNA, 20 bp, Homo sapiens
gatccacccaagtccttggg

SEQ ID NO: 60719 - DNA, 20 bp, Homo sapiens
gatcttgggctttcagcccc

SEQ ID NO: 60720 - DNA, 20 bp, Homo sapiens
gatcaagacaccattggatg

SEQ ID NO: 60721 - DNA, 20 bp, Homo sapiens
gatcagccccagggcactgg

SEQ ID NO: 60722 - DNA, 20 bp, Homo sapiens
gatcagtgagctgtttgacg

SEQ ID NO: 60723 - DNA, 20 bp, Homo sapiens
gatcattaatgacgccttca

SEQ ID NO: 60724 - DNA, 20 bp, Homo sapiens
gatcctcctgggcgtggcag

SEQ ID NO: 60725 - DNA, 20 bp, Homo sapiens
gatctccctccagttgttgg

SEQ ID NO: 60726 - DNA, 20 bp, Homo sapiens
gatctgctgccctgttgatt

SEQ ID NO: 60727 - DNA, 20 bp, Homo sapiens
gatctgggcccggcccagtg

SEQ ID NO: 60728 - DNA, 20 bp, Homo sapiens
gatctgtatatttttttcta

SEQ ID NO: 60729 - DNA, 20 bp, Homo sapiens
gatcaaagcaaagttccaag

SEQ ID NO: 60730 - DNA, 20 bp, Homo sapiens
gatcccctgaaggtccacct

SEQ ID NO: 60731 - DNA, 20 bp, Homo sapiens
gatcgagatgccaaaaagct

SEQ ID NO: 60732 - DNA, 20 bp, Homo sapiens
gatctgtatgatgcagggga

SEQ ID NO: 60733 - DNA, 20 bp, Homo sapiens
gatccagtgtggcaagaaac

SEQ ID NO: 60734 - DNA, 20 bp, Homo sapiens
gatcctccctacaatcaggg

SEQ ID NO: 60735 - DNA, 20 bp, Homo sapiens
gatcctggccttgagctcct

SEQ ID NO: 60736 - DNA, 20 bp, Homo sapiens
gatcgaccagaacgtggagg

SEQ ID NO: 60737 - DNA, 20 bp, Homo sapiens
gatcggggacaacctgcgag

SEQ ID NO: 60738 - DNA, 20 bp, Homo sapiens
gatctcggccagtgccgagg

SEQ ID NO: 60739 - DNA, 20 bp, Homo sapiens
gatcttctggctcacctcat

SEQ ID NO: 60740 - DNA, 20 bp, Homo sapiens
gatcttggccttgagctcgt

SEQ ID NO: 60741 - DNA, 20 bp, Homo sapiens
gatcaaagttaattgggaag

SEQ ID NO: 60742 - DNA, 20 bp, Homo sapiens
gatcaattgggaactacaat

SEQ ID NO: 60743 - DNA, 20 bp, Homo sapiens
gatcgcagactttgagttgc

SEQ ID NO: 60744 - DNA, 20 bp, Homo sapiens
gatcaacaaaatcggcaagg

SEQ ID NO: 60745 - DNA, 20 bp, Homo sapiens
gatcctggacagggagaagt

SEQ ID NO: 60746 - DNA, 20 bp, Homo sapiens
gatccttcttagtttaggag

SEQ ID NO: 60747 - DNA, 20 bp, Homo sapiens
gatcactgggaatgaaaacg

SEQ ID NO: 60748 - DNA, 20 bp, Homo sapiens
gatcaacagaagtccgtatt

SEQ ID NO: 60749 - DNA, 20 bp, Homo sapiens
gatccctgacacctatgccc

SEQ ID NO: 60750 - DNA, 20 bp, Homo sapiens
gatccaagaagcgggtccct

SEQ ID NO: 60751 - DNA, 20 bp, Homo sapiens
gatccagtccttctaagaaa

SEQ ID NO: 60752 - DNA, 20 bp, Homo sapiens
gatcgcttagctggatggag

SEQ ID NO: 60753 - DNA, 20 bp, Homo sapiens
gatctgaaaactgtaaccca

SEQ ID NO: 60754 - DNA, 20 bp, Homo sapiens
gatcttgaacaagtcacaac

SEQ ID NO: 60755 - DNA, 20 bp, Homo sapiens
gatcttattgatgacagagt

SEQ ID NO: 60756 - DNA, 20 bp, Homo sapiens
gatcagacttggtctcgatg

SEQ ID NO: 60757 - DNA, 20 bp, Homo sapiens
gatccaacatgtgtagtttc

SEQ ID NO: 60758 - DNA, 20 bp, Homo sapiens
gatctgcctgccttggtctc

SEQ ID NO: 60759 - DNA, 20 bp, Homo sapiens
gatccttattttgctgggat

SEQ ID NO: 60760 - DNA, 20 bp, Homo sapiens
gatcacatcggttttccaaa

SEQ ID NO: 60761 - DNA, 20 bp, Homo sapiens
gatcgaaaaaaaaatccaga

SEQ ID NO: 60762 - DNA, 20 bp, Homo sapiens
gatcttctccactcgttctg

SEQ ID NO: 60763 - DNA, 20 bp, Homo sapiens
gatcactgttatccaccaga

SEQ ID NO: 60764 - DNA, 20 bp, Homo sapiens
gatcttgaatcaatgttgag

SEQ ID NO: 60765 - DNA, 20 bp, Homo sapiens
gatccaagaaccacagctca

SEQ ID NO: 60766 - DNA, 20 bp, Homo sapiens
gatcccatgaggatggtccc

SEQ ID NO: 60767 - DNA, 20 bp, Homo sapiens
gatcccggggaccctcctac

SEQ ID NO: 60768 - DNA, 20 bp, Homo sapiens
gatcaatgggaaccaagcca

SEQ ID NO: 60769 - DNA, 20 bp, Homo sapiens
gatcctgctgaacactggcc

SEQ ID NO: 60770 - DNA, 20 bp, Homo sapiens
gatctgacttgatagaacta

SEQ ID NO: 60771 - DNA, 20 bp, Homo sapiens
gatcatgtgctccagtttat

SEQ ID NO: 60772 - DNA, 20 bp, Homo sapiens
gatcactgaaaaaaatggat

SEQ ID NO: 60773 - DNA, 20 bp, Homo sapiens
gatctaaaaatgtagggaga

SEQ ID NO: 60774 - DNA, 20 bp, Homo sapiens
gatctgggagagagaagtca

SEQ ID NO: 60775 - DNA, 20 bp, Homo sapiens
gatcctaagcaacctctgct

SEQ ID NO: 60776 - DNA, 20 bp, Homo sapiens
gatccggtaagtccaggcgc

SEQ ID NO: 60777 - DNA, 20 bp, Homo sapiens
gatctttctccgataaaacc

SEQ ID NO: 60778 - DNA, 20 bp, Homo sapiens
gatcaatattataataaaga

SEQ ID NO: 60779 - DNA, 20 bp, Homo sapiens
gatccgcatcaatgatgggg

SEQ ID NO: 60780 - DNA, 20 bp, Homo sapiens
gatcattctcagtgagggct

SEQ ID NO: 60781 - DNA, 20 bp, Homo sapiens
gatccatggggggagaagtg

SEQ ID NO: 60782 - DNA, 20 bp, Homo sapiens
gatctgcaggctacacctct

SEQ ID NO: 60783 - DNA, 20 bp, Homo sapiens
gatcaacatcgataaaatgc

SEQ ID NO: 60784 - DNA, 20 bp, Homo sapiens
gatcatcttgaaaggcttgt

SEQ ID NO: 60785 - DNA, 20 bp, Homo sapiens
gatccacggtggtgcgcttg

SEQ ID NO: 60786 - DNA, 20 bp, Homo sapiens
gatccaggagctcgaggagc

SEQ ID NO: 60787 - DNA, 20 bp, Homo sapiens
gatccccccactgagctgtg

SEQ ID NO: 60788 - DNA, 20 bp, Homo sapiens
gatccccggagtggtggatg

SEQ ID NO: 60789 - DNA, 20 bp, Homo sapiens
gatccctgcactccaagtag

SEQ ID NO: 60790 - DNA, 20 bp, Homo sapiens
gatctatgatacccagaagg

SEQ ID NO: 60791 - DNA, 20 bp, Homo sapiens
gatcatgccactgcacccta

SEQ ID NO: 60792 - DNA, 20 bp, Homo sapiens
gatcaagaatacttgtactt

SEQ ID NO: 60793 - DNA, 20 bp, Homo sapiens
gatcaggtatgggagcattt

SEQ ID NO: 60794 - DNA, 20 bp, Homo sapiens
gatccacctcactcctgatt

SEQ ID NO: 60795 - DNA, 20 bp, Homo sapiens
gatccgtgattctgaggact

SEQ ID NO: 60796 - DNA, 20 bp, Homo sapiens
gatctcagagacaagttcaa

SEQ ID NO: 60797 - DNA, 20 bp, Homo sapiens
gatctgaaatcagaaatatc

SEQ ID NO: 60798 - DNA, 20 bp, Homo sapiens
gatctgtgccattttcaaaa

SEQ ID NO: 60799 - DNA, 20 bp, Homo sapiens
gatcttttcattgctattca

SEQ ID NO: 60800 - DNA, 20 bp, Homo sapiens
gatcttcatacagttcattt

SEQ ID NO: 60801 - DNA, 20 bp, Homo sapiens
gatccaactctataattggt

SEQ ID NO: 60802 - DNA, 20 bp, Homo sapiens
gatccagcccacctgtgagg

SEQ ID NO: 60803 - DNA, 20 bp, Homo sapiens
gatctgtttcaggctgtgtc

SEQ ID NO: 60804 - DNA, 20 bp, Homo sapiens
gatcacagtgagaactggcc

SEQ ID NO: 60805 - DNA, 20 bp, Homo sapiens
gatctaccatgtaaaatgtt

SEQ ID NO: 60806 - DNA, 20 bp, Homo sapiens
gatccaatgaacatccaacc

SEQ ID NO: 60807 - DNA, 20 bp, Homo sapiens
gatcgggattgatgaagttt

SEQ ID NO: 60808 - DNA, 20 bp, Homo sapiens
gatcaggcacactcctcagt

SEQ ID NO: 60809 - DNA, 20 bp, Homo sapiens
gatccccgctttgaaatctg

SEQ ID NO: 60810 - DNA, 20 bp, Homo sapiens
gatcctggcgcaccagtgac

SEQ ID NO: 60811 - DNA, 20 bp, Homo sapiens
gatcatcctcagcttggagt

SEQ ID NO: 60812 - DNA, 20 bp, Homo sapiens
gatccactgcaggcaaaagc

SEQ ID NO: 60813 - DNA, 20 bp, Homo sapiens
gatcagaataagttatgaaa

SEQ ID NO: 60814 - DNA, 20 bp, Homo sapiens
gatcataagtcaaagacgtg

SEQ ID NO: 60815 - DNA, 20 bp, Homo sapiens
gatcagccactggaaggtgg

SEQ ID NO: 60816 - DNA, 20 bp, Homo sapiens
gatcgtggttgcagggatgc

SEQ ID NO: 60817 - DNA, 20 bp, Homo sapiens
gatcttcagggacacggccc

SEQ ID NO: 60818 - DNA, 20 bp, Homo sapiens
gatcacatcaaggaggtggc

SEQ ID NO: 60819 - DNA, 20 bp, Homo sapiens
gatcaggtctggatacttgg

SEQ ID NO: 60820 - DNA, 20 bp, Homo sapiens
gatcatgagggactcccctg

SEQ ID NO: 60821 - DNA, 20 bp, Homo sapiens
gatcgctgagctgctcagga

SEQ ID NO: 60822 - DNA, 20 bp, Homo sapiens
gatcggcgtggagggcggcc

SEQ ID NO: 60823 - DNA, 20 bp, Homo sapiens
gatcactacttgtgtgatgt

SEQ ID NO: 60824 - DNA, 20 bp, Homo sapiens
gatcatgaatatctctacaa

SEQ ID NO: 60825 - DNA, 20 bp, Homo sapiens
gatctataaaagatttttct

SEQ ID NO: 60826 - DNA, 20 bp, Homo sapiens
gatcatatgaattagccaaa

SEQ ID NO: 60827 - DNA, 20 bp, Homo sapiens
gatcatgaaccaacagatgc

SEQ ID NO: 60828 - DNA, 20 bp, Homo sapiens
gatcatcacatccgaccacg

SEQ ID NO: 60829 - DNA, 20 bp, Homo sapiens
gatctgctctcccgcccagc

SEQ ID NO: 60830 - DNA, 20 bp, Homo sapiens
gatcttcccttgggcaggag

SEQ ID NO: 60831 - DNA, 20 bp, Homo sapiens
gatcccggccgatgcgccgg

SEQ ID NO: 60832 - DNA, 20 bp, Homo sapiens
gatcccagtttgcagcaaac

SEQ ID NO: 60833 - DNA, 20 bp, Homo sapiens
gatctgccatcttgcatcag

SEQ ID NO: 60834 - DNA, 20 bp, Homo sapiens
gatcatctgagaaacttaaa

SEQ ID NO: 60835 - DNA, 20 bp, Homo sapiens
gatcctgattttcagccaag

SEQ ID NO: 60836 - DNA, 20 bp, Homo sapiens
gatccttttggcttctactc

SEQ ID NO: 60837 - DNA, 20 bp, Homo sapiens
gatctatattgtaccagaac

SEQ ID NO: 60838 - DNA, 20 bp, Homo sapiens
gatcttctgtccaatttgta

SEQ ID NO: 60839 - DNA, 20 bp, Homo sapiens
gatctttaaaaaggattgag

SEQ ID NO: 60840 - DNA, 20 bp, Homo sapiens
gatcccaaggagcttcatga

SEQ ID NO: 60841 - DNA, 20 bp, Homo sapiens
gatcgtcacggaggtgcagc

SEQ ID NO: 60842 - DNA, 20 bp, Homo sapiens
gatcgtgggtgacaagctgg

SEQ ID NO: 60843 - DNA, 20 bp, Homo sapiens
gatctccagcgatgtaatcg

SEQ ID NO: 60844 - DNA, 20 bp, Homo sapiens
gatctctgaggtctggtgat

SEQ ID NO: 60845 - DNA, 20 bp, Homo sapiens
gatcctcagccaaaggaacc

SEQ ID NO: 60846 - DNA, 20 bp, Homo sapiens
gatctccaaacggaagtcag

SEQ ID NO: 60847 - DNA, 20 bp, Homo sapiens
gatccaatgtttaaatatca

SEQ ID NO: 60848 - DNA, 20 bp, Homo sapiens
gatcccaatttgcttatcct

SEQ ID NO: 60849 - DNA, 20 bp, Homo sapiens
gatcattcatcattcttaat

SEQ ID NO: 60850 - DNA, 20 bp, Homo sapiens
gatccattagggttaccaga

SEQ ID NO: 60851 - DNA, 20 bp, Homo sapiens
gatctacttacccacaatct

SEQ ID NO: 60852 - DNA, 20 bp, Homo sapiens
gatcttttgccttgcaaatt

SEQ ID NO: 60853 - DNA, 20 bp, Homo sapiens
gatcagacaaacctctgcag

SEQ ID NO: 60854 - DNA, 20 bp, Homo sapiens
gatccagcaagcaggccaac

SEQ ID NO: 60855 - DNA, 20 bp, Homo sapiens
gatcagaaaaataattccat

SEQ ID NO: 60856 - DNA, 20 bp, Homo sapiens
gatcagctgaccatggctga

SEQ ID NO: 60857 - DNA, 20 bp, Homo sapiens
gatcatccagaaaagatagc

SEQ ID NO: 60858 - DNA, 20 bp, Homo sapiens
gatcgtagacacagggatga

SEQ ID NO: 60859 - DNA, 20 bp, Homo sapiens
gatcgtcttcagctacatat

SEQ ID NO: 60860 - DNA, 20 bp, Homo sapiens
gatccccaggagcagaggag

SEQ ID NO: 60861 - DNA, 20 bp, Homo sapiens
gatcaattaatacgagagaa

SEQ ID NO: 60862 - DNA, 20 bp, Homo sapiens
gatccagctgctcaggccct

SEQ ID NO: 60863 - DNA, 20 bp, Homo sapiens
gatctggtacaaagcaatcg

SEQ ID NO: 60864 - DNA, 20 bp, Homo sapiens
gatcatcatgatgtctacaa

SEQ ID NO: 60865 - DNA, 20 bp, Homo sapiens
gatccaccctgcccacaaaa

SEQ ID NO: 60866 - DNA, 20 bp, Homo sapiens
gatcaaaatcaaaacattct

SEQ ID NO: 60867 - DNA, 20 bp, Homo sapiens
gatcatacatggcattttct

SEQ ID NO: 60868 - DNA, 20 bp, Homo sapiens
gatcccaaactgtaaaagat

SEQ ID NO: 60869 - DNA, 20 bp, Homo sapiens
gatcccttaatcttggactt

SEQ ID NO: 60870 - DNA, 20 bp, Homo sapiens
gatctgccttgctcactatt

SEQ ID NO: 60871 - DNA, 20 bp, Homo sapiens
gatcaataaatgtttgaatg

SEQ ID NO: 60872 - DNA, 20 bp, Homo sapiens
gatctttttatcaaactatg

SEQ ID NO: 60873 - DNA, 20 bp, Homo sapiens
gatcagggaaatgttggaat

SEQ ID NO: 60874 - DNA, 20 bp, Homo sapiens
gatcatttgcatgattttca

SEQ ID NO: 60875 - DNA, 20 bp, Homo sapiens
gatctctgaaacaggactga

SEQ ID NO: 60876 - DNA, 20 bp, Homo sapiens
gatcctgtgcgtggggctag

SEQ ID NO: 60877 - DNA, 20 bp, Homo sapiens
gatcagcttccactgttaga

SEQ ID NO: 60878 - DNA, 20 bp, Homo sapiens
gatctcacaggcggcgggga

SEQ ID NO: 60879 - DNA, 20 bp, Homo sapiens
gatctccaaggcctgaataa

SEQ ID NO: 60880 - DNA, 20 bp, Homo sapiens
gatccccaaagcatcagcga

SEQ ID NO: 60881 - DNA, 20 bp, Homo sapiens
gatccttggcagagaagggt

SEQ ID NO: 60882 - DNA, 20 bp, Homo sapiens
gatcttcccgttgttcttgc

SEQ ID NO: 60883 - DNA, 20 bp, Homo sapiens
gatccccacgagccattcag

SEQ ID NO: 60884 - DNA, 20 bp, Homo sapiens
gatccccatccacttgcagg

SEQ ID NO: 60885 - DNA, 20 bp, Homo sapiens
gatcgcttcaaggtttacgc

SEQ ID NO: 60886 - DNA, 20 bp, Homo sapiens
gatctaatctattcctgggg

SEQ ID NO: 60887 - DNA, 20 bp, Homo sapiens
gatctgcaacttcaatcaat

SEQ ID NO: 60888 - DNA, 20 bp, Homo sapiens
gatctggacataggacaagg

SEQ ID NO: 60889 - DNA, 20 bp, Homo sapiens
gatcaggcttctggaaagtg

SEQ ID NO: 60890 - DNA, 20 bp, Homo sapiens
gatccagtcccaagttgctc

SEQ ID NO: 60891 - DNA, 20 bp, Homo sapiens
gatcgtggaggattgcgggt

SEQ ID NO: 60892 - DNA, 20 bp, Homo sapiens
gatctcatggctccacctgc

SEQ ID NO: 60893 - DNA, 20 bp, Homo sapiens
gatctggaggaaaaagagcc

SEQ ID NO: 60894 - DNA, 20 bp, Homo sapiens
gatcgtgaaactgcaaaatt

SEQ ID NO: 60895 - DNA, 20 bp, Homo sapiens
gatctccagctggagcagcg

SEQ ID NO: 60896 - DNA, 20 bp, Homo sapiens
gatctccaaagactgaggac

SEQ ID NO: 60897 - DNA, 20 bp, Homo sapiens
gatccaagggcacaaatgat

SEQ ID NO: 60898 - DNA, 20 bp, Homo sapiens
gatcctgaagtgactccgtt

SEQ ID NO: 60899 - DNA, 20 bp, Homo sapiens
gatcaccaccaccgagacca

SEQ ID NO: 60900 - DNA, 20 bp, Homo sapiens
gatcctaagtaagaacataa

SEQ ID NO: 60901 - DNA, 20 bp, Homo sapiens
gatctttccttgtgtttgcc

SEQ ID NO: 60902 - DNA, 20 bp, Homo sapiens
gatctaactccctgctgcat

SEQ ID NO: 60903 - DNA, 20 bp, Homo sapiens
gatcaaagtctgggcactcg

SEQ ID NO: 60904 - DNA, 20 bp, Homo sapiens
gatcaagaccgtgcatatga

SEQ ID NO: 60905 - DNA, 20 bp, Homo sapiens
gatccacaaccagctcatct

SEQ ID NO: 60906 - DNA, 20 bp, Homo sapiens
gatccccacctcagcttgga

SEQ ID NO: 60907 - DNA, 20 bp, Homo sapiens
gatcgtctccaactgtgagg

SEQ ID NO: 60908 - DNA, 20 bp, Homo sapiens
gatcttcacgcagctgaaga

SEQ ID NO: 60909 - DNA, 20 bp, Homo sapiens
gatccatctcctttctactg

SEQ ID NO: 60910 - DNA, 20 bp, Homo sapiens
gatccttcgagtccaatagg

SEQ ID NO: 60911 - DNA, 20 bp, Homo sapiens
gatcccagttatacgtgaac

SEQ ID NO: 60912 - DNA, 20 bp, Homo sapiens
gatctgggacggattacact

SEQ ID NO: 60913 - DNA, 20 bp, Homo sapiens
gatcgcttctctggctccat

SEQ ID NO: 60914 - DNA, 20 bp, Homo sapiens
gatccatgactctcagaaag

SEQ ID NO: 60915 - DNA, 20 bp, Homo sapiens
gatcaccaaatgaaaacacc

SEQ ID NO: 60916 - DNA, 20 bp, Homo sapiens
gatcatttaaagaacagctt

SEQ ID NO: 60917 - DNA, 20 bp, Homo sapiens
gatctggtttctgctggtac

SEQ ID NO: 60918 - DNA, 20 bp, Homo sapiens
gatcacttaattctgacata

SEQ ID NO: 60919 - DNA, 20 bp, Homo sapiens
gatccttctgcacctagcac

SEQ ID NO: 60920 - DNA, 20 bp, Homo sapiens
gatcatgccttgtgttttcc

SEQ ID NO: 60921 - DNA, 20 bp, Homo sapiens
gatccaattcatgtctgtgg

SEQ ID NO: 60922 - DNA, 20 bp, Homo sapiens
gatctcgccactatgctcca

SEQ ID NO: 60923 - DNA, 20 bp, Homo sapiens
gatcactgattccccagggt

SEQ ID NO: 60924 - DNA, 20 bp, Homo sapiens
gatctcctccaggtctccgt

SEQ ID NO: 60925 - DNA, 20 bp, Homo sapiens
gatctttctgcaccctgggg

SEQ ID NO: 60926 - DNA, 20 bp, Homo sapiens
gatcactacagtttaatgtc

SEQ ID NO: 60927 - DNA, 20 bp, Homo sapiens
gatctattttattttagcct

SEQ ID NO: 60928 - DNA, 20 bp, Homo sapiens
gatctttatattcattttca

SEQ ID NO: 60929 - DNA, 20 bp, Homo sapiens
gatccaaggagaaactgcag

SEQ ID NO: 60930 - DNA, 20 bp, Homo sapiens
gatcgttttcttccaaacaa

SEQ ID NO: 60931 - DNA, 20 bp, Homo sapiens
gatcactgattactatttac

SEQ ID NO: 60932 - DNA, 20 bp, Homo sapiens
gatcttttttttgtttgttt

SEQ ID NO: 60933 - DNA, 20 bp, Homo sapiens
gatcacaccttgttgggaca

SEQ ID NO: 60934 - DNA, 20 bp, Homo sapiens
gatcaccatgcccaggacac

SEQ ID NO: 60935 - DNA, 20 bp, Homo sapiens
gatcctgcatgctttgggat

SEQ ID NO: 60936 - DNA, 20 bp, Homo sapiens
gatcttaaaagagtgatgac

SEQ ID NO: 60937 - DNA, 20 bp, Homo sapiens
gatcttcttgaccttctcca

SEQ ID NO: 60938 - DNA, 20 bp, Homo sapiens
gatcttgttaaagatttcaa

SEQ ID NO: 60939 - DNA, 20 bp, Homo sapiens
gatcaaaatcctgacattcg

SEQ ID NO: 60940 - DNA, 20 bp, Homo sapiens
gatcaactgaacatctatat

SEQ ID NO: 60941 - DNA, 20 bp, Homo sapiens
gatcagcatcaaggcaaaca

SEQ ID NO: 60942 - DNA, 20 bp, Homo sapiens
gatcatcacccttgtcagtg

SEQ ID NO: 60943 - DNA, 20 bp, Homo sapiens
gatctttttgagggtgacat

SEQ ID NO: 60944 - DNA, 20 bp, Homo sapiens
gatcaccatgaaatccactg

SEQ ID NO: 60945 - DNA, 20 bp, Homo sapiens
gatcacgggataccacttcc

SEQ ID NO: 60946 - DNA, 20 bp, Homo sapiens
gatcattaaaaaagaaaaat

SEQ ID NO: 60947 - DNA, 20 bp, Homo sapiens
gatcaagctgactgctcctc

SEQ ID NO: 60948 - DNA, 20 bp, Homo sapiens
gatcatttcgttttcttctt

SEQ ID NO: 60949 - DNA, 20 bp, Homo sapiens
gatcatgtgtacaggcttcc

SEQ ID NO: 60950 - DNA, 20 bp, Homo sapiens
gatccgcctgcctctgcctc

SEQ ID NO: 60951 - DNA, 20 bp, Homo sapiens
gatctgctgcttctaacctt

SEQ ID NO: 60952 - DNA, 20 bp, Homo sapiens
gatccaagcaaataagtaag

SEQ ID NO: 60953 - DNA, 20 bp, Homo sapiens
gatctaagtattccccaccc

SEQ ID NO: 60954 - DNA, 20 bp, Homo sapiens
gatcaaaaattgttgaaaca

SEQ ID NO: 60955 - DNA, 20 bp, Homo sapiens
gatcaaatttgggtatatgc

SEQ ID NO: 60956 - DNA, 20 bp, Homo sapiens
gatcaatgtatatgaagctc

SEQ ID NO: 60957 - DNA, 20 bp, Homo sapiens
gatcattctcaggaacttca

SEQ ID NO: 60958 - DNA, 20 bp, Homo sapiens
gatcaaataacaaaacgaag

SEQ ID NO: 60959 - DNA, 20 bp, Homo sapiens
gatcagctgaaatttgtcct

SEQ ID NO: 60960 - DNA, 20 bp, Homo sapiens
gatcatcttggcaaggattg

SEQ ID NO: 60961 - DNA, 20 bp, Homo sapiens
gatccaccttcttccttagg

SEQ ID NO: 60962 - DNA, 20 bp, Homo sapiens
gatcctccccacccagtttc

SEQ ID NO: 60963 - DNA, 20 bp, Homo sapiens
gatctgaaatgcgtgctgat

SEQ ID NO: 60964 - DNA, 20 bp, Homo sapiens
gatctggcctccggggtttt

SEQ ID NO: 60965 - DNA, 20 bp, Homo sapiens
gatctttactggtgctcact

SEQ ID NO: 60966 - DNA, 20 bp, Homo sapiens
gatcacagaaggaagcacac

SEQ ID NO: 60967 - DNA, 20 bp, Homo sapiens
gatcacttctacccaagtca

SEQ ID NO: 60968 - DNA, 20 bp, Homo sapiens
gatcacttctactgaagcca

SEQ ID NO: 60969 - DNA, 20 bp, Homo sapiens
gatcacttctactgaagtca

SEQ ID NO: 60970 - DNA, 20 bp, Homo sapiens
gatctggctgagcaggcggg

SEQ ID NO: 60971 - DNA, 20 bp, Homo sapiens
gatcaacgttcagtgctgtg

SEQ ID NO: 60972 - DNA, 20 bp, Homo sapiens
gatccagggaaaccagctgt

SEQ ID NO: 60973 - DNA, 20 bp, Homo sapiens
gatcccttgatggttctggg

SEQ ID NO: 60974 - DNA, 20 bp, Homo sapiens
gatcccttgcggcttgtcag

SEQ ID NO: 60975 - DNA, 20 bp, Homo sapiens
gatcctcagaggctgagaag

SEQ ID NO: 60976 - DNA, 20 bp, Homo sapiens
gatccaggctcaggacccgg

SEQ ID NO: 60977 - DNA, 20 bp, Homo sapiens
gatcaactactgcaatgaga

SEQ ID NO: 60978 - DNA, 20 bp, Homo sapiens
gatcctcccacacaggaggg

SEQ ID NO: 60979 - DNA, 20 bp, Homo sapiens
gatcctgagggaaaagctct

SEQ ID NO: 60980 - DNA, 20 bp, Homo sapiens
gatcgtggcgcatggcttgg

SEQ ID NO: 60981 - DNA, 20 bp, Homo sapiens
gatctggtcatcacacaccc

SEQ ID NO: 60982 - DNA, 20 bp, Homo sapiens
gatcctggctctgtgctgtg

SEQ ID NO: 60983 - DNA, 20 bp, Homo sapiens
gatcaaaaatgaatctcatt

SEQ ID NO: 60984 - DNA, 20 bp, Homo sapiens
gatctgtggtttttctactt

SEQ ID NO: 60985 - DNA, 20 bp, Homo sapiens
gatctttctgtcttgcagaa

SEQ ID NO: 60986 - DNA, 20 bp, Homo sapiens
gatcacaacagcctaaacaa

SEQ ID NO: 60987 - DNA, 20 bp, Homo sapiens
gatctcactcttcctcatcc

SEQ ID NO: 60988 - DNA, 20 bp, Homo sapiens
gatcatgaccatggccttcg

SEQ ID NO: 60989 - DNA, 20 bp, Homo sapiens
gatccagagcccctgagcgt

SEQ ID NO: 60990 - DNA, 20 bp, Homo sapiens
gatctggctctggtggtgtg

SEQ ID NO: 60991 - DNA, 20 bp, Homo sapiens
gatcacaggctggcccaggt

SEQ ID NO: 60992 - DNA, 20 bp, Homo sapiens
gatcaacgggagagaaggaa

SEQ ID NO: 60993 - DNA, 20 bp, Homo sapiens
gatcaagattatcgaaggag

SEQ ID NO: 60994 - DNA, 20 bp, Homo sapiens
gatcaagccgatgggagcag

SEQ ID NO: 60995 - DNA, 20 bp, Homo sapiens
gatcacaggcctgaggaagg

SEQ ID NO: 60996 - DNA, 20 bp, Homo sapiens
gatcactcaggagacatccc

SEQ ID NO: 60997 - DNA, 20 bp, Homo sapiens
gatccctggcccaggacagg

SEQ ID NO: 60998 - DNA, 20 bp, Homo sapiens
gatcctggggccctcagctc

SEQ ID NO: 60999 - DNA, 20 bp, Homo sapiens
gatctccctcctttacattt

SEQ ID NO: 61000 - DNA, 20 bp, Homo sapiens
gatctctctacaagagcccc

SEQ ID NO: 61001 - DNA, 20 bp, Homo sapiens
gatctgccgcctcagcttct

SEQ ID NO: 61002 - DNA, 20 bp, Homo sapiens
gatctttcccaggccgcacc

SEQ ID NO: 61003 - DNA, 20 bp, Homo sapiens
gatctgctctgaccttaagc

SEQ ID NO: 61004 - DNA, 20 bp, Homo sapiens
gatcaacaggtggaatttga

SEQ ID NO: 61005 - DNA, 20 bp, Homo sapiens
gatcataaatgcattcatac

SEQ ID NO: 61006 - DNA, 20 bp, Homo sapiens
gatcatttcatttaaaaaat

SEQ ID NO: 61007 - DNA, 20 bp, Homo sapiens
gatcctggctaagagggaaa

SEQ ID NO: 61008 - DNA, 20 bp, Homo sapiens
gatcagtgataccttagaga

SEQ ID NO: 61009 - DNA, 20 bp, Homo sapiens
gatctcatttttaaaattct

SEQ ID NO: 61010 - DNA, 20 bp, Homo sapiens
gatctgccaaccacgcccac

SEQ ID NO: 61011 - DNA, 20 bp, Homo sapiens
gatcactcagagcctatgaa

SEQ ID NO: 61012 - DNA, 20 bp, Homo sapiens
gatcaagatggtgataactt

SEQ ID NO: 61013 - DNA, 20 bp, Homo sapiens
gatcaataaccttcgtctga

SEQ ID NO: 61014 - DNA, 20 bp, Homo sapiens
gatccttgcactagctacat

SEQ ID NO: 61015 - DNA, 20 bp, Homo sapiens
gatcaaggatgttctcaaca

SEQ ID NO: 61016 - DNA, 20 bp, Homo sapiens
gatcctgctgacttggcagc

SEQ ID NO: 61017 - DNA, 20 bp, Homo sapiens
gatctccgaggccttgaccc

SEQ ID NO: 61018 - DNA, 20 bp, Homo sapiens
gatcatctagggtgtttgga

SEQ ID NO: 61019 - DNA, 20 bp, Homo sapiens
gatctctttcaagaactgga

SEQ ID NO: 61020 - DNA, 20 bp, Homo sapiens
gatcttctcaatggtggcct

SEQ ID NO: 61021 - DNA, 20 bp, Homo sapiens
gatcaatacgtaatatcatg

SEQ ID NO: 61022 - DNA, 20 bp, Homo sapiens
gatcaccatcaattttagtt

SEQ ID NO: 61023 - DNA, 20 bp, Homo sapiens
gatcatttaacacatttgga

SEQ ID NO: 61024 - DNA, 20 bp, Homo sapiens
gatccaagcctcgtttcact

SEQ ID NO: 61025 - DNA, 20 bp, Homo sapiens
gatcttcatgaccagttgat

SEQ ID NO: 61026 - DNA, 20 bp, Homo sapiens
gatcttgtcttctagtattt

SEQ ID NO: 61027 - DNA, 20 bp, Homo sapiens
gatctctccttcctctgggg

SEQ ID NO: 61028 - DNA, 20 bp, Homo sapiens
gatcaatgttatgaatttga

SEQ ID NO: 61029 - DNA, 20 bp, Homo sapiens
gatcaggaaatgagtattaa

SEQ ID NO: 61030 - DNA, 20 bp, Homo sapiens
gatcattgctcccaaactgt

SEQ ID NO: 61031 - DNA, 20 bp, Homo sapiens
gatccacatagctaatatga

SEQ ID NO: 61032 - DNA, 20 bp, Homo sapiens
gatcgaatttaatttccttt

SEQ ID NO: 61033 - DNA, 20 bp, Homo sapiens
gatcttataattgaaagtcc

SEQ ID NO: 61034 - DNA, 20 bp, Homo sapiens
gatctttttatgcaagattt

SEQ ID NO: 61035 - DNA, 20 bp, Homo sapiens
gatcgaagctcaatttgatg

SEQ ID NO: 61036 - DNA, 20 bp, Homo sapiens
gatctgcccacctcggcctg

SEQ ID NO: 61037 - DNA, 20 bp, Homo sapiens
gatctaaccagcaacaggga

SEQ ID NO: 61038 - DNA, 20 bp, Homo sapiens
gatcagattgcaattccaga

SEQ ID NO: 61039 - DNA, 20 bp, Homo sapiens
gatctcagcaagtggctcac

SEQ ID NO: 61040 - DNA, 20 bp, Homo sapiens
gatccttctgaattatatgt

SEQ ID NO: 61041 - DNA, 20 bp, Homo sapiens
gatcttcatctgactatgac

SEQ ID NO: 61042 - DNA, 20 bp, Homo sapiens
gatcttaaaagctttgtgat

SEQ ID NO: 61043 - DNA, 20 bp, Homo sapiens
gatcccacacctcacaaacc

SEQ ID NO: 61044 - DNA, 20 bp, Homo sapiens
gatccggagaatggcagtgg

SEQ ID NO: 61045 - DNA, 20 bp, Homo sapiens
gatcccatttttggaacgat

SEQ ID NO: 61046 - DNA, 20 bp, Homo sapiens
gatcctaggacttctgattg

SEQ ID NO: 61047 - DNA, 20 bp, Homo sapiens
gatcacactgagatggaaga

SEQ ID NO: 61048 - DNA, 20 bp, Homo sapiens
gatcagtgctgtgacagaag

SEQ ID NO: 61049 - DNA, 20 bp, Homo sapiens
gatcatgtggtacttattca

SEQ ID NO: 61050 - DNA, 20 bp, Homo sapiens
gatctcctacccgaactggg

SEQ ID NO: 61051 - DNA, 20 bp, Homo sapiens
gatctaaaaatatttgtcct

SEQ ID NO: 61052 - DNA, 20 bp, Homo sapiens
gatcattggtatctgatatc

SEQ ID NO: 61053 - DNA, 20 bp, Homo sapiens
gatcgacttctcatcctctc

SEQ ID NO: 61054 - DNA, 20 bp, Homo sapiens
gatcgttccactttttgtgg

SEQ ID NO: 61055 - DNA, 20 bp, Homo sapiens
gatccagcccaactgaaaaa

SEQ ID NO: 61056 - DNA, 20 bp, Homo sapiens
gatcccacaggagcacctca

SEQ ID NO: 61057 - DNA, 20 bp, Homo sapiens
gatctggatgtcctgtttgg

SEQ ID NO: 61058 - DNA, 20 bp, Homo sapiens
gatcttttatttcatgtcat

SEQ ID NO: 61059 - DNA, 20 bp, Homo sapiens
gatctatatgtttctgtaaa

SEQ ID NO: 61060 - DNA, 20 bp, Homo sapiens
gatctaatgtaaaatccaga

SEQ ID NO: 61061 - DNA, 20 bp, Homo sapiens
gatctgcatatataagacac

SEQ ID NO: 61062 - DNA, 20 bp, Homo sapiens
gatcaaggaggcctgcctct

SEQ ID NO: 61063 - DNA, 20 bp, Homo sapiens
gatcacagtcattggtgctc

SEQ ID NO: 61064 - DNA, 20 bp, Homo sapiens
gatccaaaactttttgagcc

SEQ ID NO: 61065 - DNA, 20 bp, Homo sapiens
gatctcggagcattctggat

SEQ ID NO: 61066 - DNA, 20 bp, Homo sapiens
gatcttaatcattttggata

SEQ ID NO: 61067 - DNA, 20 bp, Homo sapiens
gatcagtcacaagcaactca

SEQ ID NO: 61068 - DNA, 20 bp, Homo sapiens
gatctcttgggaaaggtggt

SEQ ID NO: 61069 - DNA, 20 bp, Homo sapiens
gatcttccctgcgctggtgt

SEQ ID NO: 61070 - DNA, 20 bp, Homo sapiens
gatcttttgaggctgtcatc

SEQ ID NO: 61071 - DNA, 20 bp, Homo sapiens
gatccatggggggatgatgg

SEQ ID NO: 61072 - DNA, 20 bp, Homo sapiens
gatcctttcagtaaaaaccc

SEQ ID NO: 61073 - DNA, 20 bp, Homo sapiens
gatctgaaataataaaaggc

SEQ ID NO: 61074 - DNA, 20 bp, Homo sapiens
gatcatggtagtagaaccaa

SEQ ID NO: 61075 - DNA, 20 bp, Homo sapiens
gatccttatcgtgagaccac

SEQ ID NO: 61076 - DNA, 20 bp, Homo sapiens
gatctgaaatcttggaatgt

SEQ ID NO: 61077 - DNA, 20 bp, Homo sapiens
gatcttattaggttgaacca

SEQ ID NO: 61078 - DNA, 20 bp, Homo sapiens
gatcttaagggtctatatat

SEQ ID NO: 61079 - DNA, 20 bp, Homo sapiens
gatcagtccgtgtccgtttc

SEQ ID NO: 61080 - DNA, 20 bp, Homo sapiens
gatctgagtttaactcatta

SEQ ID NO: 61081 - DNA, 20 bp, Homo sapiens
gatctttctgacattgtgct

SEQ ID NO: 61082 - DNA, 20 bp, Homo sapiens
gatccgccgccacatcacag

SEQ ID NO: 61083 - DNA, 20 bp, Homo sapiens
gatctccctgaagttgagct

SEQ ID NO: 61084 - DNA, 20 bp, Homo sapiens
gatccgaaccaattttgatg

SEQ ID NO: 61085 - DNA, 20 bp, Homo sapiens
gatccagctccgcccctggc

SEQ ID NO: 61086 - DNA, 20 bp, Homo sapiens
gatccctcaaatacactaca

SEQ ID NO: 61087 - DNA, 20 bp, Homo sapiens
gatcaagataccacatagcc

SEQ ID NO: 61088 - DNA, 20 bp, Homo sapiens
gatcgggaacaaatgaatct

SEQ ID NO: 61089 - DNA, 20 bp, Homo sapiens
gatctggcaatacaggacca

SEQ ID NO: 61090 - DNA, 20 bp, Homo sapiens
gatctggcagccctggagag

SEQ ID NO: 61091 - DNA, 20 bp, Homo sapiens
gatcctgctgctttttcccc

SEQ ID NO: 61092 - DNA, 20 bp, Homo sapiens
gatcactgatgctggctatg

SEQ ID NO: 61093 - DNA, 20 bp, Homo sapiens
gatctcagaaaataaattgc

SEQ ID NO: 61094 - DNA, 20 bp, Homo sapiens
gatcacaaaatgttgcctgt

SEQ ID NO: 61095 - DNA, 20 bp, Homo sapiens
gatccagactctcattcctt

SEQ ID NO: 61096 - DNA, 20 bp, Homo sapiens
gatcaaggagaaaaataaat

SEQ ID NO: 61097 - DNA, 20 bp, Homo sapiens
gatctgtaagaaccactgca

SEQ ID NO: 61098 - DNA, 20 bp, Homo sapiens
gatcactgctgaggtcacaa

SEQ ID NO: 61099 - DNA, 20 bp, Homo sapiens
gatcccttcaagtggagtaa

SEQ ID NO: 61100 - DNA, 20 bp, Homo sapiens
gatctacgtgtggaaaggga

SEQ ID NO: 61101 - DNA, 20 bp, Homo sapiens
gatctcagtaggcctaacct

SEQ ID NO: 61102 - DNA, 20 bp, Homo sapiens
gatccaggtttctgggaagt

SEQ ID NO: 61103 - DNA, 20 bp, Homo sapiens
gatctcagccagcctcccag

SEQ ID NO: 61104 - DNA, 2129 bp, Homo sapiens
tcctatccaccctccactcccctgtcccttggtgactcatccctgagcttcccaaggaagcccccaccctctgccctttcctcccgccttccatgagtggaaaatccacctccgccccctatagcaggccagcccccttcctccccagtctccgaccccatcccccagccgaccagtttcctctccaggaccagggagcaatcacagctgccccgaccttggcttcctctgctgggtgggattgggggctgggcccccaaatgggcccctggcttcccccttcctctgggcaggggacagagagacacaggctcggggagcaggactgacttcctcttgtcccggaatgagcatgcctgccctttgcaagcaggtttgggtctcacgcagaggaaaccaaaagcaataagagggagggaaggcagagcaaccaatcaagggcagggtgagactcaaaacgagcgggctccctggggagccagacagaggctgggggtgatggcggagctacagcagctgcaggagtttgagatccccactggccgggaggctctgaggggcaaccacagtgccctgctgcgggtcgctgactactgcgaggacaactatgtgcaggccacagacaagcggaaggcgctggaggagaccatggccttcactacccaggcactggccagcgtggcctaccaggtgggcaacctggccgggcacactctgcgcatgttggacctgcagggggccgccctgcggcaggtggaagcccgtgtaagcacgctgggccagatggtgaacatgcatatggagaaggtggcccgaagggagatcggcaccttagccactgtccagcggctgccccccggccagaaggtcatcgccccagagaacctaccccctctcacgccctactgcaggagacccctcaactttggctgcctggacgacattggccatgggatcaaggacctcagcacgcagctgtcaagaacaggcaccctgtctcgaaagagcatcaaggcccctgccacacccgcctccgccaccttggggagaccaccccggattcccgagccagtgcacctgccggtggtgcccgacggcagactctccgccgcctcctctgcgtcttccctggcctcggccggcagcgccgaaggtgtcggtggggcccccacgcccaaggggcaggcagcacctccagccccacctctccccagctccttggacccacctcctccaccagcagccgtcgaggtgttccagcggcctcccacgctggaggagttgtccccacccccaccggacgaagagctgcccctgccactggacctgcctcctcctccacccctggatggagatgaattggggctgcctccacccccaccaggatttgggcctgatgagcccagctgggtgcctgcctcatacttggagaaagtggtgacactgtacccatacaccagccagaaggacaatgagctctccttctctgagggcactgtcatctgtgtcactcgccgctactccgatggctggtgcgagggcgtcagctcagaggggactggattcttccctgggaactatgtggagcccagctgctgacagcccagggctctctgggcagctgatgtctgcactgagtgggtttcatgagccccaagccaaaaccagctccagtcacagctggactgggtctgcccacctcttgggctgtgagctgtgttctgtccttcctcccatcggagggagaaggggtcctggggagagagaatttatccagaggcctgctgcagatggggaagagctggaaaccaagaagtttgtcaacagaggacccctactccatgcaggacagggtctcctgctgcaagtcccaactttgaataaaacagatgatgtcctgtgactgccccacagagataaggggccaggagggattgaaaggcatcccagttctaaggctgctgctaattacagcccccaacctccaacccaccagctgacctagaagcagcatcttcccatttcctcagtacccacaaagtgcagcccacattggaccccagacacccctctgcagccattgactgcaacttgttcttttgcccattgaaaaaaaaaaaaaaaaaaaa

SEQ ID NO: 61105 - DNA, 1941 bp, Homo sapiens
cacctgtcattcgttcgtcctcagtgcagggcaacaggactttaggttcaagatggtgactgcagccatgctgctacagtgctgcccagtgcttgcccggggccccacaagcctcctaggcaaggtggttaagactcaccagttcctgtttggtattggacgctgtcccatcctggctacccaaggaccaaactgttctcaaatccaccttaaggcaacaaaggctggaggagattctccatcttgggcgaagggccactgtcccttcatgctgtcggaactccaggatgggaagagcaagattgtgcagaaggcagccccagaagtccaggaagatgtgaaggctttcaagacagatctgcctagctccctggtctcagtcagcctaaggaagccattttccggtccccaggagcaggagcagatctctgggaaggtcacacacctgattcagaacaatatgcctggaaactatgtcttcagttatgaccagtttttcagggacaagatcatggagaagaaacaggatcacacctaccgtgtgttcaagactgtgaaccgctgggctgatgcatatccctttgcccaacatttctctgaggcatctgtggcctcaaaggatgtgtccgtctggtgtagtaatgattacctgggcatgagccgacaccctcaggtcttgcaagccacacaggagaccctgcagcgtcatggtgctggagctggtggcacccgcaacatctcaggcaccagtaagtttcatgtggagcttgagcaggagctggctgagctgcaccagaaggactcagccctgctcttctcctcctgctttgttgccaatgactctactctcttcaccttggccaagatcctgccagggtgcgagatttactcagacgcaggcaaccatgcttccatgatccaaggtatccgtaacagtggagcagccaagtttgtcttcaggcacaatgaccctgaccacctaaagaaacttctagagaagtctaaccctaagatacccaaaattgtggcctttgagactgtccactccatggatggtgccatctgtcccctcgaggagttgtgtgatgtgtcccaccagtatggggccctgaccttcgtggatgaggtccatgctgtaggactgtatgggtcccggggcgctgggattggggagcgtgatggaattatgcataagattgacatcatctctggaactcttggcaaggcctttggctgtgtgggcggctacattgccagcacccgtgacttggtggacatggtgcgctcctatgctgcaggcttcatctttaccacttctctgccccccatggtgctctctggagctctagaatctgtgcggctgctcaagggagaggagggccaagccctgaggcgagcccaccagcgcaatgtcaagcacatgcgccagctactcatggacaggggccttcctgtcatcccctgccccagccacatcatccccatccgggtgggcaatgcagcactcaacagcaagctctgtgatctcctgctctccaagcatggcatctatgtgcaggccatcaactacccaactgtcccccggggtgaagagctcctgcgcttggcaccctccccccaccacagccctcagatgatggaagattttgtggagaagctgctgctggcttggactgcggtggggctgcccctccaggatgtgtctgtggctgcctgcaatttctgtcgccgtcctgtacactttgagctcatgagtgagtgggaacgttcctacttcgggaacatggggccccagtatgtcaccacctatgcctgagaagccagctgcctaggattcacaccccacctgcgcttcacttgggtccaggcctactcctgtcttctgctttgttgtgtgcctctagctgaattgagcctaaaaataaagcacaaaccacagca

SEQ ID NO: 61106 - DNA, 1830 bp, Homo sapiens
cacctgtcattcgttcgtcctcagtgcagggcaacaggactttaggttcaagatggtgactgcagccatgctgctacagtgctgcccagtgcttgcccggggccccacaagcctcctaggcaaggtggttaagactcaccagttcctgtttggtattggacgctgtcccatcctggctacccaaggaccaaactgttctcaaatccaccttaaggcaacaaaggctggaggagattctccatcttgggcgaagggccactgtcccttcatgctgtcggaactccaggatgggaagagcaagattgtgcagaaggcagccccagaagtccaggaagatgtgaaggctttcaagacaggaaactatgtcttcagttatgaccagtttttcagggacaagatcatggagaagaaacaggatcacacctaccgtgtgttcaagactgtgaaccgctgggctgatgcatatccctttgcccaacatttctctgaggcatctgtggcctcaaaggatgtgtccgtctggtgtagtaatgattacctgggcatgagccgacaccctcaggtcttgcaagccacacaggagaccctgcagcgtcatggtgctggagctggtggcacccgcaacatctcaggcaccagtaagtttcatgtggagcttgagcaggagctggctgagctgcaccagaaggactcagccctgctcttctcctcctgctttgttgccaatgactctactctcttcaccttggccaagatcctgccagggtgcgagatttactcagacgcaggcaaccatgcttccatgatccaaggtatccgtaacagtggagcagccaagtttgtcttcaggcacaatgaccctgaccacctaaagaaacttctagagaagtctaaccctaagatacccaaaattgtggcctttgagactgtccactccatggatggtgccatctgtcccctcgaggagttgtgtgatgtgtcccaccagtatggggccctgaccttcgtggatgaggtccatgctgtaggactgtatgggtcccggggcgctgggattggggagcgtgatggaattatgcataagattgacatcatctctggaactcttggcaaggcctttggctgtgtgggcggctacattgccagcacccgtgacttggtggacatggtgcgctcctatgctgcaggcttcatctttaccacttctctgccccccatggtgctctctggagctctagaatctgtgcggctgctcaagggagaggagggccaagccctgaggcgagcccaccagcgcaatgtcaagcacatgcgccagctactcatggacaggggccttcctgtcatcccctgccccagccacatcatccccatccgggtgggcaatgcagcactcaacagcaagctctgtgatctcctgctctccaagcatggcatctatgtgcaggccatcaactacccaactgtcccccggggtgaagagctcctgcgcttggcaccctccccccaccacagccctcagatgatggaagattttgtggagaagctgctgctggcttggactgcggtggggctgcccctccaggatgtgtctgtggctgcctgcaatttctgtcgccgtcctgtacactttgagctcatgagtgagtgggaacgttcctacttcgggaacatggggccccagtatgtcaccacctatgcctgagaagccagctgcctaggattcacaccccacctgcgcttcacttgggtccaggcctactcctgtcttctgctttgttgtgtgcctctagctgaattgagcctaaaaataaagcacaaaccacagca

SEQ ID NO: 61107 - DNA, 1937 bp, Homo sapiens
cacctgtcattcgttcgtcctcagtgcagggcaacagggcccacatgccttggccccacataccaacccaggctgctgtgacagcccatgagagggggagaggttgctctgggatggaacaagaaaaagaggttgttttgtgaggactttaggttcaagatggtgactgcagccatgctgctacagtgctgcccagtgcttgcccggggccccacaagcctcctaggcaaggtggttaagactcaccagttcctgtttggtattggacgctgtcccatcctggctacccaaggaccaaactgttctcaaatccaccttaaggcaacaaaggctggaggagattctccatcttgggcgaagggccactgtcccttcatgctgtcggaactccaggatgggaagagcaagattgtgcagaaggcagccccagaagtccaggaagatgtgaaggctttcaagacaggaaactatgtcttcagttatgaccagtttttcagggacaagatcatggagaagaaacaggatcacacctaccgtgtgttcaagactgtgaaccgctgggctgatgcatatccctttgcccaacatttctctgaggcatctgtggcctcaaaggatgtgtccgtctggtgtagtaatgattacctgggcatgagccgacaccctcaggtcttgcaagccacacaggagaccctgcagcgtcatggtgctggagctggtggcacccgcaacatctcaggcaccagtaagtttcatgtggagcttgagcaggagctggctgagctgcaccagaaggactcagccctgctcttctcctcctgctttgttgccaatgactctactctcttcaccttggccaagatcctgccagggtgcgagatttactcagacgcaggcaaccatgcttccatgatccaaggtatccgtaacagtggagcagccaagtttgtcttcaggcacaatgaccctgaccacctaaagaaacttctagagaagtctaaccctaagatacccaaaattgtggcctttgagactgtccactccatggatggtgccatctgtcccctcgaggagttgtgtgatgtgtcccaccagtatggggccctgaccttcgtggatgaggtccatgctgtaggactgtatgggtcccggggcgctgggattggggagcgtgatggaattatgcataagattgacatcatctctggaactcttggcaaggcctttggctgtgtgggcggctacattgccagcacccgtgacttggtggacatggtgcgctcctatgctgcaggcttcatctttaccacttctctgccccccatggtgctctctggagctctagaatctgtgcggctgctcaagggagaggagggccaagccctgaggcgagcccaccagcgcaatgtcaagcacatgcgccagctactcatggacaggggccttcctgtcatcccctgccccagccacatcatccccatccgggtgggcaatgcagcactcaacagcaagctctgtgatctcctgctctccaagcatggcatctatgtgcaggccatcaactacccaactgtcccccggggtgaagagctcctgcgcttggcaccctccccccaccacagccctcagatgatggaagattttgtggagaagctgctgctggcttggactgcggtggggctgcccctccaggatgtgtctgtggctgcctgcaatttctgtcgccgtcctgtacactttgagctcatgagtgagtgggaacgttcctacttcgggaacatggggccccagtatgtcaccacctatgcctgagaagccagctgcctaggattcacaccccacctgcgcttcacttgggtccaggcctactcctgtcttctgctttgttgtgtgcctctagctgaattgagcctaaaaataaagcacaaaccacagca

SEQ ID NO: 61108 - DNA, 1745 bp, Homo sapiens
cacctgtcattcgttcgtcctcagtgcagggcaacagattctccatcttgggcgaagggccactgtcccttcatgctgtcggaactccaggatgggaagagcaagattgtgcagaaggcagccccagaagtccaggaagatgtgaaggctttcaagacagatctgcctagctccctggtctcagtcagcctaaggaagccattttccggtccccaggagcaggagcagatctctgggaaggtcacacacctgattcagaacaatatgcctggaaactatgtcttcagttatgaccagtttttcagggacaagatcatggagaagaaacaggatcacacctaccgtgtgttcaagactgtgaaccgctgggctgatgcatatccctttgcccaacatttctctgaggcatctgtggcctcaaaggatgtgtccgtctggtgtagtaatgattacctgggcatgagccgacaccctcaggtcttgcaagccacacaggagaccctgcagcgtcatggtgctggagctggtggcacccgcaacatctcaggcaccagtaagtttcatgtggagcttgagcaggagctggctgagctgcaccagaaggactcagccctgctcttctcctcctgctttgttgccaatgactctactctcttcaccttggccaagatcctgccagggtgcgagatttactcagacgcaggcaaccatgcttccatgatccaaggtatccgtaacagtggagcagccaagtttgtcttcaggcacaatgaccctgaccacctaaagaaacttctagagaagtctaaccctaagatacccaaaattgtggcctttgagactgtccactccatggatggtgccatctgtcccctcgaggagttgtgtgatgtgtcccaccagtatggggccctgaccttcgtggatgaggtccatgctgtaggactgtatgggtcccggggcgctgggattggggagcgtgatggaattatgcataagattgacatcatctctggaactcttggcaaggcctttggctgtgtgggcggctacattgccagcacccgtgacttggtggacatggtgcgctcctatgctgcaggcttcatctttaccacttctctgccccccatggtgctctctggagctctagaatctgtgcggctgctcaagggagaggagggccaagccctgaggcgagcccaccagcgcaatgtcaagcacatgcgccagctactcatggacaggggccttcctgtcatcccctgccccagccacatcatccccatccgggtgggcaatgcagcactcaacagcaagctctgtgatctcctgctctccaagcatggcatctatgtgcaggccatcaactacccaactgtcccccggggtgaagagctcctgcgcttggcaccctccccccaccacagccctcagatgatggaagattttgtggagaagctgctgctggcttggactgcggtggggctgcccctccaggatgtgtctgtggctgcctgcaatttctgtcgccgtcctgtacactttgagctcatgagtgagtgggaacgttcctacttcgggaacatggggccccagtatgtcaccacctatgcctgagaagccagctgcctaggattcacaccccacctgcgcttcacttgggtccaggcctactcctgtcttctgctttgttgtgtgcctctagctgaattgagcctaaaaataaagcacaaaccacagca

SEQ ID NO: 61109 - DNA, 2566 bp, Homo sapiens
tcaccatggaatatgaagtcaagaaagggaagaagggctttgtatcccccatccgaaggctggtgttccccaaggccgggcgccgggcagcctgtaggagcagcgtgagccgccggcccctgcactcgatgcccctttatccccccgactacctcatcgacccccagattctgctgtgtgactacctggagaaagaggtcaagttcctgggccaccttacctgggtgacttcctcactgaacccctccagtcgggacgagctcctgcagctgctagacaccgccaggcagctgaaggagctgccgctgaagaccacggcggagcaggacagcatcctgagcctgtctgcccgctgcctgctgctcacctggcgcgacaatgaagagctcattctgcgaatccctacgcacgagatcgccgccgcctcctacctgcaggacgacgcgctgcacctgctagtgctcaagaccggtctgggtgtggacccggtgccggccggcgtggatgccagcccaggcggcgcaggacgcgaccccggcccgccaggcggggcgcccgagaagcggcgggtgggcaccgcggagcggcgccacaccatctgcagcctggactggcggatggggtggggtgggggcgccgcggaggcccgggccgggggaggcggcggcggcagcttggagcgccagcgcgccggggcgcgggcgtcgggcagctgggagcgacggcagacgttcagcggcagctgggagcggcggcacggaggcggcggcggcggcggcggcgcgggaaagccgggcggtagctgggagcggaggcaggcgggcagcggcgggggaggcagctgggagcggcgccaccccggccccaacccgctcgacccgcaggaccccagccccgacgcctactgcaacctggtcatcctggctgtagccaacagggacgctgcagaggagtcctgcgcactcatctgtcaggtcttccagatcatctacggggaccagagtattgagtgtgtggaccgggctggctaccactacacatccacacctgaacggccatggctctgcagccgcataatggctcccaggacacctttgaagcatgttacagcggcacgtccacaccttctttccatggctcccactgcagcggcagcgaccacagcagtctgggcttggagcagttacaggattacatggtcacgttgcggagtaagctggggcccctcgagatccagcagtttgcgatgctgctgcgggagtaccggctggggctgcccatccaggactattgcacaggcctgctgaagctctacggagaccggcgcaagttcctcctccttgggatgcggcccttcatcccggaccaggacatcggctacttcgagggcttcctggagggcgtgggcatccgcgagggcggcatcctcactgacagcttcggccgcatcaagcgcagcatgagctccacgtcggcctccgcagtgcgcagctacgatggcgcggcgcagcggcccgaggcacaggccttccaccggctgctggctgacatcacgcacgacatcgaggcgctggcccccgatgacgacgacgacgacgaggatgagccccggggctccaggggcgggagcgacgccgcagaagacaactacctgtagccaccgcccctgcggacggcgtggctcagcagcccacctctgagtctcagctttgcttcggggaccctatccccagggcccccccatcacacctggcggggccggggggtcttcactccagggtctcgctccctgcccttggggcccggggccatgcagtacctggagtgtcctgcagggggaaagcgaagccgggccctgaagtccggggcagtcacccggggctcctgggccgctctgccgggctggggctgagcagcgatcctgctttgtcccagaagtccagagggatcagccccagaacacaccctcctccccgggacgccgcagctttctggaggctgaggaaggcatgaagagtgggctccacctgctggccgactgagaaaagaatttccagaactcggtcctattttacagattgagaaactatggttcaagaagagaggacggggcttgagggaatctcctgattctccttatatgacctcaaactgaccatactaaacagtgtagaaggtctttttaaggctctaaatgtcagggtctcccatcccctgatgcctgacttgtacagtcagtgtggagtagacggtttcctccacccagggttgactcagggggatgatctgggtcccattctggtcttaagaccccaaacaagggtttttttcagctccaggatctggagcctctatctggttagtgtcgtaacctctgtgtgcctcccgttaccccatctgtccagtgagctcagcccccatccacctaacagggtggccacagggattactgagggttaagaccttagaactgggtctagcacccgataagagctcaataaatgttgttcctttccacatcaaaaaaaaaaaaaaaaaaaaaaaaaaaaaaaaaaaaaaaaaaaaa

SEQ ID NO: 61110 - DNA, 2297 bp, Homo sapiens
agccgtgctcagaaagtttctggatcccaggctcatctccacagaggagaacacgcaggcagcagagaccatggggcccatctcagccccttcctgcagatggcgcatcccctggcaggggctcctgctcacagcctcacttttcaccttctggaacccgcccaccactgctcagctcactattgaagctgtgccatccaatgctgcagaggggaaggaggttcttctacttgtccacaatctgccccaggaccctcgtggctacaactggtacaaaggggaaacagtggatgccaaccgtcgaattataggatatgtaatatcaaatcaacagattaccccagggcctgcatacagcaatcgagagacaatataccccaatgcatccctgctgatgcggaacgtcaccagaaatgacacaggatcctacaccctacaagtcataaagctaaatcttatgagtgaagaagtaactggccagttcagcgtacatccggagactcccaagccctccatctccagcaacaactccaaccccgtggaggacaaggatgctgtggccttcacctgtgaacctgagactcagaacacaacctacctgtggtgggtaaatggtcagagtctcccggtcagtcccaggctgcagctgtccaatggcaacaggaccctcactctactcagtgtcacaaggaatgacgtaggaccctatgaatgtgaaatacagaacccagcgagtgcaaacttcagtgacccagtcaccctgaatgtcctctatggcccagatgcccccaccatttccccttcagacacctattaccatgcaggggtaaatctcaacctctcctgccatgcggcctctaatccaccctcacagtattcttggtctgtcaatggcacattccagcaatacacacaaaagctctttatccccaacatcactacaaagaacagcggatcctatgcctgccacaccactaactcagccactggccgcaacaggaccacagtcaggatgatcacagtctctgatgctttagtacaaggaagttctcctggcctctcagctagagccactgtcagcatcatgattggagtactggccagggtggctctgatatagtagctctggtgtagtttctgcatttcaagaagactggcagacagttgtttttattcttcctcaaagcatttgcaatcagctaccattcaaaattgcttcttcttcaagatttatggaaaatactctgacgagtactcttgaacacaagttcctgataactttaagatcacgccactggactgtctatgaacttgcaaacaggctgatacctttgtgaagttgcccaccaaaacacagaaggaaaaaaacatgaatttcattgaactaaataataatgaggataatgtttttaagatttttttttttttttgagatggaatctcgctctgtcgcccaggctggagtgcagtggcacgatctcaactcactgcaagctccgcctcctgggttcacaccattctcctgcctcagcctcctgagtagctgggactacaggcgcctgccacaacgcccggctaattttttgtatttttagtagagacggggtttcactgtggtctcaatctcctgacttcatggtccgcctgcctcagcctcccaaagttctgggattacaggtgtgagccaccgcgcccagcccgtttttaagattttttatttgaaaaattgccaattctttaagtgttttctttttcagatttatgaatttctttatcttttaagctatctataccttactgcaatttggtaaagcagacttttgtgaacaaaaattataacatttacttttgctccctacctgactgccacagaactgggcaactattcatgagtattcatatgtttatggtaattcagttatttgcacaagttcagtgagaatctgctgtctttataatgggatatagtttaaaacattggttatattaccaaggctttgattgggatgttatatttgagaaaatacagagaatgatagattaacggagtgtctaatctatcgtgtcaaccccaaatttttacgtatgagatcctttagtccacccaatggctgacagtaacagcatctttaacacaactctttgttcaaatgtactatggtctcttttagagtcagactcctagactcacttgttctcactgtctgttttaatttaacccaggcatgcaatgctagataataaaattgctccctattggctgatcaaaaaaaaaaaaaaaaaaaaaaaaaaaaaaa

SEQ ID NO: 61111 - DNA, 542 bp, Homo sapiens
gtctgccctctctgctcgccctgcctagcttgaggatctgtcaccccagccatgaggattatcgccctcctcgctgctattctcttggtagccctccaggtccgggcaggcccactccaggcaagaggtgatgaggctccaggccaggagcagcgtgggccagaagaccaggacatatctatttcctttgcatgggataaaagctctgctcttcaggtttcaggctcaacaaggggcatggtctgctcttgcagattagtattctgccggcgaacagaacttcgtgttgggaactgcctcattggtggtgtgagtttcacatactgctgcacgcgtgtcgattaacgttctgctgtccaagagaatgtcatgctgggaacgccatcatcggtggtgttagcttcacatgcttctgcagctgagcttgcagaatagagaaaaatgagctcataatttgctttgagagctacaggaaatggttgtttctcctatactttgtccttaacatctttcttgatcctaaatatatatctcgtaacaag

SEQ ID NO: 61112 - DNA, 2812 bp, Homo sapiens
agacgcgagcatgtgcagtttgcagcgcatccgtactatggggacacatggaagctgccagccccccagccaaggatcagctgagccctagggctgatgcttgcctacgttgctgataatggcactgaggcccagccaacaaaggttaacccaggacactcctggacagtgatcctgatgtctgttgtgagctgcacactcaagggtgtgataaccagccccagtcggcgccatggcgtctgccgagcccctgacggcgctgtcccgctggtacctgtatgccatccacggctacttctgcgaggtgatgttcacagcggcctgggagttcgtggtgaacttgaactggaagttccctggggtcacgagcgtgtgggccctcttcatctacggcacctccatcctcatcgtggagcgcatgtacctgcggctgcgcggccgctgcccgctgctcctgcgctgcctcatctacacgctctggacctacctgtgggagttcaccaccggcttcatcctgcgccagttcaacgcctgcccctgggactactcccagttcgactttgacttcatgggcctcatcaccctggagtacgccgtgccctggttctgcggggccctcatcatggagcagttcatcatccgcaacaccctccgcctccgcttcgacaaggacgctgagcccggggagcccagcggcgccctagccctggccaacggccatgtcaagactgactgagcaggaagcgggtggggggcctggggatctctcatggaactcatggacaaagagaccaagctggtgaggttgccccatccatgcagcaaaagccctgctccggccaagcctcagccctatagggcacacagagccccctaacgtccgcgggggccggtgttggggggccgtggtcaggtgttgggggatggggtgtggaggcagcagagggacattgggaagggtccatggatcgcggcccagttcaggggttggtaccaggaggcctgtggctgagcagcgatggactatgtagttgactttggaagcagcaggccctgtcctggccaagggacaatgagaatggggccgcaggtgggaggcaaggcctgacctccctccctccgatctggatttagttgagctttggctggttccattaggcaatattcagatggccaccattatttctgttttatgggagaggtctgttggcaaagagtcggccacccagatttaccacatttctctgcagaacactcttttgttcaatataagcagagaccttccaccgggggcaggatttgtgatacctgcagtgagccaaggaccaggctagttcctgtgatgctgaagatgttgaagggaagcccataacattacaacgttgaccaatcctccagaaaagaagctctaacagaggaccctggctgtctacggggttggtttccatctctccattcgtgagctccttgaaggcagagaacacttggcttttcttcctatacctccagtccctaatgcagggacatgagagatgcccatttgtgtttgatgaatgaatgagtgaataaatgaatgaatgagtgcctggagatcagagtacatgggatgagtgttcggagttctacagactcaggaagccccagctgacattccaagaagaaggagacacgaaggtgaggggatgccatgcagttagcgtcacatgaagaaaaacaaaatttaaggtatcatccttagaagacggagggatgacagtttcaaggaggatttgttcatcagatgctgggaaggaatttcaacagatgaggaaactgaagagcagagaggttaagtacccccctaccctgccccccaggggacacaacctgctggagtgcaatggcacgatctcggctcactgcaacctctgcctcccgggttcaagcgattctcctgcctcggcctcccgggtggctgagattacagatgcaaggtagagagtggaaggaatgaaggggtgggcgagggcatgaagaagcctccccagctctaatggccactgtctgaaagtgatgcagctcacttccacccacattcgccagatttcaatccatagcctcacttaactgtagggcaggctaggacatatcatctttccatgtgctgagaaaaaatagaaaagaccaagattggtgaaaaggagcaaactagtgacgagaaccttgccatagccatttttttgccactcacagaagccggtctgtaccaagcgagaagtggctataggagaagtggtcctgaggctcatctgccttctcctggtcaccctcccaatatatccctcctgtgctgagctagttttctattacttttcatcacctacatctaaaagagacctacctatctaacacagtctttgtcttactatcataatgctattaatgcaagctaaataataatctttcatcttctttttttctttatctttttcacttgaattgctttaaattcaaatcttcctgctatagtgtgaatgtttgtgttccccccaaatttatgtttaaactttaacctccaagctgatggtattaggaagtggggcttggggaggtgattaggtcatgagggtggaatatttgagaatgagattagtgcccttgtgaattaggcctgagagagatcccctcatctcaccatgtaaggacacagcagaaggtgctatctttgaaccaggaagtgagccctggccagacactgaacctgccgatacctcaatcttgtccttctcagtctccagaactgtgagaaataaatttctgttgtttataaacc

SEQ ID NO: 61113 - DNA, 3136 bp, Homo sapiens
atgggctgcctggccctgtcttggggacatgaagcctggtttgccaagtgggaaccgagggacatgtgctccaagagacacatccagggactgcaatcaatttccaaagggccttttctcctttcagcgatgctgttaagaaaggcaatgaatcatgtgccacaagaatcttgggagaacccacgagcttgggagctggtgacagacccccattcggagcgctctctgcacagctacacagcgaccccgcccccgcctgcccatcaggacggctctgcagctgcaaagggcgagtgcttggttcccaaggcagggcccagctccatggttctcctcgcctcactctcctccgtgagcctcagggacccggtggccacagcaccctcagttctccccagagttgctgttcccacctctggctgtgaggagcccgcctggcacagctgcgtgagtgccgggcgtccttgcctgaaacaaactgcaattcagcgcgggattccaggattccatggcaactgctcgtgccctgtgttccggccccagctggggcttgggagcagctgctgtgtcatgggggatccacttgtttaccgacagccccaaggacccggacatggtgccagcttcccatgccttggccctgagatctgggaggcccatcgcggccggtgcttcccccaaccccactgagcatctccttcccgccctgtgtccacccacctcctgcccaagacccctgagtgttcgtgggctctacctggtgggatgctctttggcttgtagacaggggttggttggcagcatagtgttccctatcgatgtccacatcctagtgggagcctgtgactacctggctcgggggatccaggttgcagatgaaataaggttggatcagctgactttaaactagggtggtgaccctggagcatcccggggggcccagtgtgatcacaaggtccttaaaagtggaggaggggccagcgtggggctcacgcctgcaatcccagagctttgggaagccgaggcagcaggatcccctgaatccaggagttcgaagccagcctgggcaacaaagtgagaccgagtcttcaaagccagcctgagccacatagtgagactgagtcctgtctctacaaaaagtaaacaaaaatcagccgagtgtagtggtgcacgcctgtggtcccagctactcaggaggctgaggtgggaggattgcttgagcctaggtcaaagctgcagtggccatgatcacacccctgcactccagcctgggtgacagtgagaccctgtcaaaaaaaaaaaaaaaaagtggaggagggaggcaggcgagccgggctcagtgaggagggcccaggctgcagtgggtgccagaatctatcctggaaaaaggaatgacatgaacacgagggaagccccgaagggccattcagtgcagcactgagtgagaggggacgtcctcaaggagccacgagccctggtgatgaggctgtggtgggtgggggcccagcgggtagcaggcgccccctgtgtgcgcagcggggctggttgctccacatatcgccctggtgcatccgagtcccgagctgccactcctgcaggcctgctctagggcggggcggggcttgcacaagcagcacctgtaggtcccgagtgcgtggctcccccagccccaacacaccccccagcccaagtggtggagtaaaggtctccgcacatggccttggggtggggttaggaccccagtccctgccaccacccaacaggcagggctttgggcaagctactcagtgcccgagacccaatttctggtcggcaggtgagaggggccggggggacaagagcctgttcccaagctctccagaagtcaggcccctgaggtggtgcagtgtggctgacatgaccatccccacggacccttgcctcccactcgccccgcaggaccatgcccaggcccgttgcctctgctgtggcttccacaacattccccctggctcccaatccctgcacggaccttcctgcttgggaaaaacctcaagggacaggccatgacctgcagagcggagtgtgatctggaaacgggagcctttcaagaattggccagacggggacaggcgtggtggctcacgctgggaggctgaggcaggtggatcacctgaggtcaaaagttcgaaaccagcctggccaacatggcgaaaccccgtctccaccaaaaatataaaaattagctgggtgtggtggtacagacctgtaatcccagttatttgagaggctgagacaggagaatcgcttgaacccaggagatggaggttgaggtgagccaagatcgtgccactgcactccagcctgggtgacagcgtgcgactccatctcaaaacaaaaagcaaacccaaaaagagttggccagagggatatgcagatgtgattagggctaaggacccacacagcccgaggtgggtacggcccctaggcctggaaacacttctggcctgcatgagaagtggtgacggtgggcgtgggtcagaggccctgaactggaggaaggggccacgagccaaggagagtgggggcctccagaagtggggaggagcggggaagcggcttctcccccaggaactctgacgtggcccagatttcaatgcagacttgaatggggcctctaaccgtgagaggataaccgtcattttaaagagaaagacacgtgtctggcctacgtcacaagatggctcttgccacacagtacgctccctgatgtggggtctgcgccacagggctgggggcactgcctgggagaaaaggaccgagacctttgcacactcgacgtgccaggtcccctgtggccacagtgcctgcctggagagcacccgggacgcagagctgctggtggccctggggacagcaggggggacccgggcaacgtccccccaccccccagagctctgctctgaccgatgcccccctgcggtggggtgggcagtttccttaaagacacagccgccagccgcggagtctgcgcgtgttgtttactgttggtcactctctgctcttagcttcacattaccatttcgtgttttgtcaaagtccgtctcaattcgcgtttggtaaaataaatagataatgagcctctaggccggcgctc

SEQ ID NO: 61114 - DNA, 2598 bp, Homo sapiens
ccaggctccaggccctggcttagagggagcggggagtctggacttcaggctggatcccttcctcttcctggagcgggtgctggcccccaacccgcttgcgtcagggacaaaaggactccttccctttccagcctggaaagcccctctgctgcaggctggaggaagggaccctgggcccagcctatagtcagcggtgtctatgggcatggatctggacggggaaaaggacaaagcagcctccatccacagttcattccgggaccaggcccttgcaggcacgcgctgggctcctgtgggaagacactaagggccccaggacagacctcctctccgggcatctgggttcctagatggcagaggtggcagagtggggtgggatggcccaattgggagctttagcttccggcaaagagctgagcacagtacatcttcattgtgtaagattctcctgggagaccagggcccagctggtggtgagctgggggaagtgggtgatactgccgtgggaggagccacctggccctctggggaagtgcactcgctgtctgcagcgcccaggcctgggtagctgggtgggggctggggggccatctgtgctcagggtgcctgcacctgggccttctctgccctgggccaagcctgcccgagcctctctgtcctctgcctgcccagctggacatctctgggcctctctggagaccagtggggtgggctgtgggggcgtcatattgccctggcttggcatccctcttgtggctgtacccctcccagcagccccaggactagcaagtccccgagatgggggtggggacagtggttgatgccaaaggttgtgggggcaggggcggggcaggagcaggaaggtcccctgagttccctcaccttgggcagagataaaaggagcacagttccaggcggggctgagctagggcgtagctgtgatttcaggggcacctctggcggctgccgtgatttgagaatctcgggtctcttggctgactgatcctgggagactgtggatgaataatgctgggcacggccccacccggaggctgcgaggcttgggggtcctggccggggtggctctgctcgctgccctctggctcctgtggctgctggggtcagcccctcggggtaccccggcaccccagcccacgatcaccatccttgtctggcactggcccttcactgaccagcccccagagctgcccagcgacacctgcacccgctacggcatcgcccgctgccacctgagtgccaaccgaagcctgctggccagcgccgacgccgtggtcttccaccaccgcgagctgcagacccggcggtcccacctgcccctggcccagcggccgcgagggcagccctgggtgtgggcctccatggagtctcctagccacacccacggcctcagccacctccgaggcatcttcaactgggtgctgagctaccggcgcgactcggacatctttgtgccctatggccgcctggagccccactgggggccctcgccaccgctgccagccaagagcagggtggccgcctgggtggtcagcaacttccaggagcggcagctgcgtgccaggctgtaccggcagctggcgcctcatctgcgggtggatgtctttggccgtgccaatggacggccactgtgcgccagctgcctggtgcccaccgtggcccagtaccgcttctacctgtcctttgagaactctcagcaccgcgactacattacggagaaattctggcgcaacgcactggtggctggcactgtgccagtggtgctggggcccccacgggccacctatgaggccttcgtgccggctgacgccttcgtgcatgtggatgactttggctcagcccgagagctggcggctttcctcactggcatgaatgagagccgataccaacgcttctttgcctggcgtgacaggctccgcgtgcgactgttcaccgactggcgggaacgtttctgtgccatctgtgaccgctacccacacctaccccgcagccaagtctatgaggaccttgagggttggtttcaggcctgagatccgctggccgggggaggtgggtgtgggtggaagggctgggtgtcgaaatcaaaccaccaggcatccggcccttaccggcaagcagcgggctaacgggaggctgggcacagaggtcaggaagcaggggtggggggtgcaggtgggcactggagcatgcagaggaggtgagagtgggagggaggtaacgggtgcctgctgcggcagacgggaggggaaaggctgccgaggaccctccccaccctgaacaaatcttgggtgggtgaaggcctggctggaagagggtgaaaggcagggcccttggggctggggggcaccccagcctgaagtttgtgggggccaaacctgggaccccgagcttcctcggtagcagaggccctgtggtccccgagacacaggcacgggtccctgccacgtccatagttctgaggtccctgtgtgtaggctggggcggggcccaggagaccacggggagcaaaccagcttgttctgggctcagggagggagggcggtggacaataaacgtctgagcagtgaaaaaaaaaaaaaa

SEQ ID NO: 61115 - DNA, 3062 bp, Homo sapiens
gacaagagctcagacctgaggagagtgactagcttctctgtgtcccaggtggccaccttccactgtggaagctcatggactccattgggtcttcagggttgcggcagggggaagaaaccctgagttgctctgaggagggcttgcccgggccctcagacagctcagagctggtgcaggagtgcctgcagcagttcaaggtgacaagggcacagctacagcagatccaagccagcctcttgggttccatggagcaggcgctgaggggacaggccagccctgcccctgcggtccggatgctgcctacatacgtggggtccaccccacatggcactgagcaaggagacttcgtggtgctggagctgggggccacaggggcctcactgcgtgttttgtgggtgactctaactggcattgaggggcatagggtggagcccagaagccaggagtttgtgatcccccaagaggtgatgctgggtgctggccagcagctctttgactttgctgcccactgcctgtctgagttcctggatgcgcagcctgtgaacaaacagggtctgcagcttggcttcagcttctctttcccttgtcaccagacgggcttggacaggagcaccctcatttcctggaccaaaggttttaggtgcagtggtgtggaaggccaggatgtggtccagctgctgagagatgccattcggaggcagggggcctacaacatcgacgtggttgctgtggtgaacgacacagtgggcaccatgatgggctgtgagccgggggtcaggccgtgtgaggttgggctagttgtagacacgggcaccaacgcgtgttacatggaggaggcacggcatgtggcagtgctggacgaagaccggggccgcgtctgcgtcagcgtcgagtggggctccttaagcgatgatggggcgctgggaccagtgctgaccaccttcgaccataccctggaccatgagtccctgaatcctggtgctcagaggtttgagaagatgatcggaggcctgtacctgggtgagctggtgcggctggtgctggctcacttggcccggtgtggggtcctctttggtggctgcacctcccctgccctgctgagccaaggcagcatcctcctggaacacgtggctgagatggaggacccctctactggggcagcccgtgtccatgctatcctgcaggacttgggcctgagccctggggcttcggatgttgagcttgtgcagcacgtctgtgcggccgtgtgcacgcgggctgcccagctctgtgctgccgccctggccgctgttctctcctgcctccagcacagccgggagcaacaaacactccaggttgctgtggccaccggaggccgagtgtgtgagcggcaccccaggttctgcagcgtcctgcaggggacagtgatgctcctggccccggaatgcgatgtctccttaatcccctctgtggatggtggtggccggggagtggcgatggtgactgctgtggctgcccgtctggctgcccaccggcgcctgctggaggagaccctggccccattccggttgaaccatgatcaactggctgcggttcaggcacagatgcggaaggccatggccaaggggctccgaggggaggcctcctcccttcgcatgctgcccactttcgtccgggccacccctgacggcagcgagcgaggggatttcctggccctggacctcgggggcacgaacttccgtgtcctcctggtacgtgtgaccacaggcgtgcagatcaccagcgagatctactccattcccgagactgtggcccagggttctgggcagcagctctttgaccacatcgtggactgcatcgtggacttccagcagaagcagggcctgagcgggcagagcctcccactgggttttaccttctccttcccatgtaggcagcttggcctagaccagggcatcctcctgaactggaccaagggtttcaaggcatcagactgcgagggccaagatgtcgtgagtctgttgcgggaagccatcactcgcagacaggcagtggagctgaatgtggttgccattgtcaatgacacggtggggaccatgatgtcctgtggctatgaggacccccgttgcgagataggcctcattgtcggaaccggcaccaatgcctgctacatggaggagctccggaatgtggcgggcgtgcctggggactcaggccgcatgtgcatcaacatggagtggggcgcctttggggacgatggctctctggccatgctcagcacccgctttgatgcaagtgtggaccaggcgtccatcaaccccggcaagcagaggtttgaaaagatgatcagcggcatgtacctgggggagatcgtccgccacatccttttacatttaaccagccttggcgttctcttccggggccagcagatccagcgccttcagaccagggacatcttcaagaccaagttcctctctgagatcgaaagtgacagcctggccctgcggcaggtccgagccatcctagaggatctggggctacccctgacctcagatgacgccctgatggtgctagaggtgtgccaggctgtgtcccagagggctgcccagctctgtggggcgggtgtagctgccgtggtggagaagatccgggggaaccggggcctggaagagctggcagtgtctgtgggggtggatggaacgctctacaagctgcacccgcgcttctccagcctggtggcggccacagtgcgggagctggcccctcgctgtgtggtcacgttcctgcagtcagaggatgggtccggcaaaggtgcggccctggtcaccgctgttgcctgccgccttgcgcagttgactcgtgtctgaggaaacctccaggctgaggaggtctccgccgcagccttgctggagccgggtcggggtctgcctgtttcccagccaggcccagccacccaggactcctgggacatcccatgtgtgacccctctgcggccatttggccttgctccctggctttccctgagagaagtagcactcaggttagcaatatatatatataatttatttacaaaaaaaaaaaaa

SEQ ID NO: 61116 - DNA, 3912 bp, Homo sapiens
ctgtgctctgtccccaaccttccacttcccctcaacgcgctgctcagggatgaccttcggcactgtgcttcttctgagtgtcctggcttcttatcatggattcaacctggatgtggaggagcctacgatcttccaggaggatgcaggcggctttgggcagagcgtggtgcagttcggtggatctcgactcgtggtgggagcacccctggaggtggtggcggccaaccagacgggacggctgtatgactgcgcagctgccaccggcatgtgccagcccatcccgctgcacatccgccctgaggccgtgaacatgtccttgggcctgaccctggcagcctccaccaacggctcccggctcctggcctgtggcccgaccctgcacagagtctgtggggagaactcatactcaaagggttcctgcctcctgctgggctcgcgctgggagatcatccagacagtccccgacgccacgccagagtgtccacatcaagagatggacatcgtcttcctgattgacggctctggaagcattgaccaaaatgactttaaccagatgaagggctttgtccaagctgtcatgggccagtttgagggcactgacaccctgtttgcactgatgcagtactcaaacctcctgaagatccacttcaccttcacccaattccggaccagcccgagccagcagagcctggtggatcccatcgtccaactgaaaggcctgacgttcacggccacgggcatcctgacagtggtgacacagctatttcatcataagaatggggcccgaaaaagtgccaagaagatcctcattgtcatcacagatgggcagaagtacaaagaccccctggaatacagtgatgtcatcccccaggcagagaaggctggcatcatccgctacgctatcggggtgggacacgctttccagggacccactgccaggcaggagctgaataccatcagctcagcgcctccgcaggaccacgtgttcaaggtggacaactttgcagcccttggcagcatccagaagcagctgcaggagaagatctatgcagttgagggaacccagtccagggcaagcagctccttccagcacgagatgtcccaagaaggcttcagcacagccctcacaatggatggcctcttcctgggggctgtggggagctttagctggtctggaggtgccttcctgtatcccccaaatatgagccccaccttcatcaacatgtctcaggagaatgtggacatgagggactcttacctgggttactccaccgagctagccctgtggaagggggtacagaacctggtcctgggggccccccgctaccagcataccgggaaggctgtcatcttcacccaggtgtccaggcaatggaggaagaaggccgaagtcacagggacgcagatcggctcctacttcggggcctccctctgctccgtggatgtggacagcgatggcagcaccgacctgatcctcattggggccccccattactatgagcagacccgagggggccaggtgtccgtgtgtcccttgcctagggggagggtgcagtggcagtgtgacgctgttctccgtggtgagcagggccacccctggggccgctttggggcagccctgacagtgttgggggatgtgaatgaggacaagctgatagacgtggccattggggccccgggagagcaggagaaccggggtgctgtctacctgtttcacggagcctcagaatccggcatcagcccctcccacagccagcggattgccagctcccagctctcccccaggctgcagtattttgggcaggcgctgagtgggggtcaggacctcacccaggatggactgatggacctggccgtgggggcccggggccaggtgctcctgctcaggagtctgccggtgctgaaagtgggggtggccatgagattcagccctgtggaggtggccaaggctgtgtaccggtgctgggaagagaagcccagtgccctggaagctggggacgccaccgtctgtctcaccatccagaaaagctcactggaccagctaggtgacatccaaagctctgtcaggtttgatctggcactggacccaggtcgtctgacttctcgtgccattttcaatgaaaccaagaaccccactttgactcgaagaaaaaccctgggactggggattcactgtgaaaccctgaagctgcttttgccagattgtgtggaggatgtggtgagccccatcattctgcacctcaacttctcactggtgagagagcccatcccctccccccagaacctgcgtcctgtgctggccgtgggctcacaagacctcttcactgcttctctccccttcgagaagaactgtgggcaagatggcctctgtgaaggggacctgggtgtcaccctcagcttctcaggcctgcagaccctgaccgtggggagctccctggagctcaacgtgattgtgactgtgtggaacgcaggtgaggattcctacggaaccgtggtcagcctctactatccagcagggctgtcgcaccgacgggtgtcaggagcccagaagcagccccatcagagtgccctgcgcctggcatgtgagacagtgcccactgaggatgagggcctaagaagcagccgctgcagtgtcaaccaccccatcttccatgagggctctaacggcaccttcatagtcacattcgatgtctcctacaaggccaccctgggagacaggatgcttatgagggccagtgcaagcagtgagaacaataaggcttcaagcagcaaggccaccttccagctggagctcccggtgaagtatgcagtctacaccatgatcagcaggcaggaagaatccaccaagtacttcaactttgcaacctccgatgagaagaaaatgaaagaggctgagcatcgataccgtgtgaataacctcagccagcgagatctggccatcagcattaacttctgggttcctgtcctgctgaacggggtggctgtgtgggatgtggtcatggaggccccatctcagagtctcccctgtgtttcagagagaaaacctccccagcattctgacttcctgacccagatttcaagaagtcccatgctggactgctccattgctgactgcctgcagttccgctgtgacgtcccctccttcagcgtccaggaggagctggatttcaccctgaagggcaatctcagtttcggctgggtccgcgagacattgcagaagaaggtgttggtcgtgagtgtggctgaaattacgttcgacacatccgtgtactcccagcttccaggacaggaggcatttatgagagctcagatggagatggtgctagaagaagacgaggtctacaatgccattcccatcatcatgggcagctctgtgggggctctgctactgctggcgctcatcacagccacactgtacaagcttggcttcttcaaacgccactacaaggaaatgctggaggacaagcctgaagacactgccacattcagtggggacgatttcagctgtgtggccccaaatgtgcctttgtcctaataatccactttcctgtttatctctaccactgtgggctggacttgcttgcaaccataaatcaacttacatggaaacaacttctgcatagatctgcactggcctaagcaacctaccaggtgctaagcaccttctcggagagatagagattgtaatgtttttacatatctgtccatctttttcagcaatgacccactttttacagaagcaggcatggtgccagcataaattttcatatgcttaagaattgtcacatgaaatgaggatgtttatagcacactttccttgcgtggaagagctataacccagggacctgagtgcctctctgggaatagtcgggggaacctatttgtgggcattgaaaaagttttttcactttc

SEQ ID NO: 61117 - DNA, 6026 bp, Homo sapiens
gagcctcggtgggaagaaggggcttctgggtggggagtgggagagagacttccttggggagaggaattcagctgcacgctggagtcagctggagttgcccaggccctgtgagcaagtggcaggcgtgcccagctgcattggggagagggctgttctcaaggccaaggtcatttttggagggagaactggacgcctgatcaaatctggcccacaatggactcagcagccaaggatgagatgcagccggcgttgtcccctggacctgagtggccagagcaggagcgggcagagcagctggcccggggtgcagcgctcaagtgggcctcaggcatcttctaccggccggagcagctggccaggctaggccagtaccgcagccgcgaggtgcagcgtacctgctccctggaatcgcgcctcaagtcagtgatgcagtcatacctggaaggcgtgcagactggtgtgtggcagctggcccaggccattgaggtggtgcagggaacccgggaggccctgagccaggcccgtgggttgctccagggcatgtcccaggccttacagactctagagcccctacgggagcgggttgcccagcacaagcaactgcaggccctgtctcacctgctgcctcggctgcgggcagtgccggctgcagtgtcccacacacagactctgattgatggccaacagttcttggaggcatatgtgagccttcgggagctggagcagctgcgagaggatacgtgggcacccctggggggcctggagttgccagtcttccaggggctggaccttctgttcgaggcactgggccaggctgtggaagcagctgcaggggccgcagggaagctggcacgggaggacccagccctgttggtggctgctgtgcgtgtggcggaggtggagactggacgaacaacccccctgggccaggtcccccgggactggcgtcagcgctgtctgagggcactacaggagggcctggagcaggcccactttgggtcacctctgctgcctgcaccaggggccctaccagggtggctggaggctctgcgagtggccctgccagtcgagttggccacagctgaggcactagtagcgccttgctgcccgccacagtacaacgtggtccagctatgggcccacacgctgcatagtggtttgcgccgcagcctgcagaacctccttgcagggcctgagctagaagctgcggatgccttcgccttgctgcactgggcactgcatgtgtacctggggcaggaaatgatggggagcctggagttggggcctgaggctgatgtgtcccagctggagccccttctgaccttggagaacattgagcagctggaggcaacatttgtggccaacatccaggcaagtgtgtctcagtggctgcagaatgcactggatggggaggtagctgagtggggccgggagcatgggcccaacacagacccgtctggctcctattactcaccaatgccagccattgtgctgcagatcctggaagagaacattcgtgtggccagcctggtcagtgagtcactgcaacagcgagtgcatggcatggcactgtcagaactgggcacattcttgaggagcttcagtgatgctctgatccgattctcccgagaccacttcagggggaaatcaatggcccctcattacgtgccctacctactggccgccctcaaccacaagtcagcactcggctcctcagtgtctgtcctgcagctggacggggcgccttcaggggccttggctccagtggaagctgcgctggacgagttgcagaggaggatctaccgcttggtgttggaggcgctgcaggcggagctccagcccctgttcgcggatctgccctcgcgccaatggctgtcgagccctgagctcctgcaaagtgtgtgtgaacggacggggcgcttctgccgggacttctggcgcgtgcggaaccccacggttcagctgctgctggctgaggccgagcgtgccgtggtgctccagtacctgagcgcgctgatgcaaggccgcctggtgtgccgcggagccgacgagaggacccaggcggccgagcgcctgcggcacgatgctgcccagcttcagcagcttttcctcagtttgggcctggaggagaacgcgcactgcgcgccggtgctgctcgccctgagggagctgctaaacctccgcgaccccgcgctgctgggcctggaggtggctggcctgcggcaacaatttcccgacgtgagcgaggaccacgtctccgccctcttgggcctgcgcggggacttgtcccgggagcagcacctggccgcgctcagctccctgcaggctgcgctgccgccgtcgccccgcgcgagccgccgcgtcctcttcagcctagtgcccgcgcccgcgctcgcgccggcctcctgcctgccctcggggtcctgcgcccgagccctgctgctcgcagaataaaccacggctgccggacgcctgagtctgttggcctcgggggcgcgccgccgcggagactgacgcgaagccccacgctttcgtaagagcgtgcgcgcgcccgaggacgtacgtcatcggcgacggctcccgccggctgggcgtccggtggccggtgtagcagagcgggagcggcgggcggcgagcagaggagctaacaggtgggggcacggcacgcggacggacccccccaaaggccgggaggaggcgcgcgacgcgacctttcctgatctcccggagaagcctccactccattgtctcctggccccaccctccattgggcacgcccttcaccttatcccccaccacttattggctgcaggtcacgcccctcctctatttctggttccccattggctcttcaccttgtcctctccggggcttctctccgcacaggccacaccctctcatttgtcactagaccccgccttaatagtggggggctcctcccccatccatccttcattcattatgcacccagtgctgggtgcttggtacacgggggtgaatcagaccccattcctgccttcggggagttcaggggattgtgggaggacacggacctagactccaacagtgacagctctgagtaaagaagtcgccgaagcagtgggacactagacgcggggaaggcttcctggaggaagtgaggcctaaactgagccttgaagaatggttaagagtttgctccaggaatatattgcaaaggcattcttggcggaaggacccgagacgtgaaaaaaacaggcgtattctggtaatttcgaggagatggagaagtaacagcatgtgtttatcctgatggaaagagtccagtagagaggaagagattgatgatgtaggagagaggagaaatgctggaaaggtcgacagtgtggggagttggagtgacccggctggatgtgacccccaggacagaatggtgctggactcaggggctcaggcgtatgatcaggcaccccccagcccgcctaccagtcccccatccctgcgccataggctgaagccctcagaccgagatgggccaccactgtacccctggtctcagtccctggccttgcccctggctctggcagtccccccagcgctgcagccccagcctgagcagcagccgttctcacagatgctcctgggccaccgtggccacatgcgtcgcagtgagagcacctactctgtaaatagtactggccggcgggggcgtggcaccctgggacggcctccacctggacggggacggaacccaggtgggggcaccctgcggcctgcagcctccctgcctcacattgctaagactcaaagggatgcaggccatattgccagcaagagcccctgcatgttggtggccctgcggccaaccaacatggaccgtgagcgagacaagttcttccagtcccattacacctacaatccacagtttgagtaccaggagcccatgcccacggctgtgctggaaaagtactgcgaggcctctggacagttcatccatcaggcagttggcatcattgaggctgttctggagaagtttggaacctatgaacactttgaggctgccactggggggcagctgctcaccaagtgccagatatggtcgattgtgcgcaaatacatgcagaaggagggctgcgctggggaggttgtggtgcagctgagtgaggacctgctgtcccaggcagtgatgatggtggagaacagccggcccacattggcgatcaacctgaccggagcccgccagtactggttggagggcatgctgcggcatgagatagaggcacccactacctgcggggcgtgaacaacgcgcgccagccgtggcacaacgcggagggccggctgcggtacgggctgcggccggcgaaccccacggaggagggcctggccagcctgcacagcgtgctgttccgcaagcagccgttcctgtggcgcgctgcactgctctactacaccatccaccgcgccgcgcgcatgtccttccgtcagctcttccaggacctggagcgctacgtgcaggacgccgatgtgcgctgggagtactgcgtgcgcgccaagcgcggccagaccgacacctcgctgccaggttgtttcagcaaggaccaggtgtacctggacggcatcgtgcgcattctgcgacatcgccagaccatcgatttcccgttgctgacctcactgggcaaggtgtcctatgaggatgtggaccacctgcggccccatggggtgctggataatacccgggtgccccacttcatgcaggacttggcacgctaccggcagcagctggagcacatcatggccaccaaccggctggatgaggcggagctgggtcgcctgctacccgactgatgtccgttgagggctgcagtcagaggccctggacagaagctccagataggcccctagaacatgaagcagtttgctctgtgcgtccacggcctaggtgtttcttgggggtgttgggagggcaggagcattccttgaggaggagtggcaacatcaaagtgtttgtgtcccttgccagcctccctggggtctggggacctgcagcagcatgtctggcaaactgagtcgccctcctgcctccagctctctgttgagcagagggaaggcatgggggcaggaagagagctgagcattgatggggatgggggtggtttgggaatagaaacttgttcttgcatgagatggctttggttgtcccagtactccagtctctcccttcccttacctggccccttggtgctccttcagcatttgtgctgtctacctctcactgggtcctggtgggggtcgggctcccttctcctggggtgattgatggcctgagcctggggtcctggtagtagagacccagctggcctggggtctgctttccgacattttgcctctctcactggtcatgtatttattccatatttatatggtctacttcctgtggctgggagcagcagctcctgaaggttccgtgggggtgcggggggttggacaggacactccttcttggaaggcaccaattttcccagccccactcccattacacacacacacacacacacacacacacacacacacacacacacacacacacacacactgattcaggccttgagagtcaagcccaagagctcccttggccctgttccccactccctccactggcctctgctgttcctgtctttgctcacaccctcacagctgctctctggcagaggttggcatagcctaggagcagctgcaattgcacctgagggacaggccctagagtttggtggcccaagtcctgaacccctcttagaccaggtgaggtgcagaggtggttgctgcttccagtttcccttcagacttagctgtgtgaaccccactcctatcctttggccttagttttcccatctgtaaaactcagaaacgcagttggaaagtccttattcatttagtaagcgaatatattataatatgtatagagcgccttttgtgtaagtcactggtcagaatcctcactgagctcccagtccagagagaagccagacaattaaaacagtaatgac

SEQ ID NO: 61118 - DNA, 3167 bp, Homo sapiens
ctggctaggacctccagtactatgttgaaaaggagtggttagagtaggctcttcgtcttgttccagttctcaaagggaatgctttcaccttttccccattcagtattatgttggctgtgggtctgtcatagatggcttttattacattaagactcagcttcgcactccagggctgcgtaccaccagccactgtcatgttaaccccttcccaggccaatgtgtccttggtctggagcccaatctgctggacagcctgggaccgtccattttcggggtggtgggcaacctggtggccatcgtggtgctgtgcaagtcgcgcaaggagcagaaggagaccaccttctacacagttatgcggctggttgccaccgacctgttgttcactttgctggtgagccaggtgaccatcgccatgtacatgaagggcgggtaacctgggggccagctgctgtgtgagtacagcatcttcagcttgttcttcttcagtcagtccggcctcagcatcgtctgtgccatgatatctatacaggatgtctcaactcaaatgtgaaattttcatggagaatatttgaactgtatttagattaatacaaattgcagttaaaaagtttaatatagatttaccagggggcgtgcagcccgcttgccaatcagatcgctgctgagcggtcccacagccaacccccgaagagcagcctgctggcttccccagtgcccaggagttggggatgtcctacaaacctaccacccctgcccccagcagcacccccggcttcagcacccctgggccaggcactcgggtccctacaggaagcgtcccgtcgccgtcgggctcagggccgggagccactgccccttgcagaccgctgtttaaagactttggaccgcctaccgtcggttgtgtgcaggccatgaaaccacctggtgcccagggctcccagagcacctacacagaactgctgttggtcacaggggagatgggcaaagggatccggcccacctatgctggcagcaagagcgccgcggagcgcctgaagacaggtatcatccatccctagtcagagtgcctggtggagacagagcggaacgcccacacttaacaggaagctcctaggcctctgtgtctggacttcagagcacctgcttctccctggccttcatccctagttgcactaaccatcctgggcttcctgtcctgtgtcccttgatgggtgccctccaggaaccaaggggcggttctcactgcaggtggcagcactaaggacccccctccccaccccaccccgccaacgcaacaagagttagcagcgaggtccccgtgagtcccacccatgacctacagacagtgttgcccactggaactttctgtggcccccaccactcagcccttcccagcacttgtccagagcctctttctccctcagcacagctcaggcctcaggcctgacacttccctgccttgtgtcttttgctaaatatgacctttctatattaataaaagatgctttggagttgtgctctctaaaaaaaagtttaatataaaggagaaataaaaggaaatttagcaaagaaatatgtagatgaatatttaaatactcagaggtgacattactaccagacataatgagattatcagatgtttcatttacttatgattaatatgtttgtatttattttttattcattttattttatttatgtatttatttatttttattatactttaagttctagggtacatgtgcacaacgtgcaggtttgttacatctgtatacatgtgctgtgttggtttgctgcacccattaacttgtcatttacattaggtatttctcctaatgctctccctcccccagccccccaccccatgacaggccccagtgtgtgatgttcccctgcctgtgtccaagtattctcattgtttaatttccacctatgagtgagaatatgcagtgtttggttttctgaccttgcgatagtttaaacaaactaggaagttcagaagtcactttacaagagaaataaagaaaaataaagtattaatgacattggtaacagaataaaaattagagttagacaaagtattaacaagcaagcttatatatttataagagatgggaaaatattagaaaggaataaatcatgtcttgtcaacatgaagaaaaagtgtattttttttgttaacttattattgtgtttccttgtataattttcacttggttttgttggttttactacttgcttcattctttcaaaaactacatcttcatagaccatttcagcttttgctatgtgggcagaattataaaacccaatttcaaaatttcaactgaacgttgtcagcatttttctttgggctttttattgaaaaaaaatcctaattgtgtgtgtgtgtattttagtatgaccatgaatgtaataacaataaaataaaacaaaaacaaatggatatgcaatatgttggactagcatctcaaatatgaaaaaggcattgccaacagtgatataattttttttataatggtaagctttttaaagtataatcttattttaacctaaaatcttactatcagaaaatgcagtgtacattaaaatgttctgaaatgctttattcacatttattaaatggttgtactcactcagatatctacaaattggtttttcacttatgtaattatcttatagaatgttcaaaagtcatgcagaatgtgagataattttctattgaatatgattgttttatcattgcaagacatcaaacatccctgtttcctgccaaatgaatgtacaatagcaataaatgtaaagatgtgttttttggaaaagacacatttttgagttataaaacaaggattttaaaacttgaattgttacagtgagtatgtcttaatataggctacagtcactttagataaaaaattacctcacatctattttcaatattacttaaagatgttcatttagtggcaaatatttttttttttgcctagaggcagatattttgccacatggctatttatgaaactgtatttaaatgcatgtacacatataaaagctgccactgtggctgtaaactattacaagttatcaagattaaaaaataaacaaaaaatatttcagtttttctatgaaatgtctttactcgagtccaaatttagaggtttaaaatg

SEQ ID NO: 61119 - DNA, 3168 bp, Homo sapiens
ctggctaggacctccagtactatgttgaaaaggagtggtgagagtaggctcttcgtcttgttccagttctcaaagggaatgctttcaccttttccccattcagtattatgttggctgtgggtctgtcatagatggcttttattacattaagactcagctttgcactccagggctgcgtaccaccagccactgtcatgttaaccccttcccaggccaatgtgtccttggcctggagcccaatctgctggacagcctgggaccgtccattttcggggtggtgggcaacctggtggccatcgtggtgctgtgcaagtcgcgcaaggagcagaaggagaccaccttctatacagttatgcggctggctgccaccgacctgttgttcactttgctggtgagccaggtgaccatcgccatgtacatgaagggcgggtaacctgggggccagctgctgtgtgagtacagcatcttcagcctgttcttcttcagtcagtccggcctcagcatcgtctgtgccatgatatctatacaggatgtctcaactcaaatgtgaaattttcatggagaatatttgaactgtatttagattaatacaaattgcagttaaaacgtttaatatagatttaccagggggcgtgcagcccgcttgccaatcagatcgctgctgagcggtcccgcagccaacccccgaagagcagcctgctggcttccccagcgcccaggagttggggatgtcctacaaacctaccacccctgcccccagcagcacccccggcttcagcacccctgggccaggcactccggtccctacaggaagcgtcccgtcgccgtcgggctcagggccgggagccactgccccttgcagaccgctgtttaaagactttggaccacctacggtcggttgtgtgcaggccatgaaaccacctggtgcccagggctcccagagcacctacacggaactgctgttggtcacaggggagatgggcaaagggatccggcccacctatgctggcagcaagagcgccgcggagcgcctgaagagaggtatcatccatccctagtcagagtgcctggtagagacagagcggaacggccacacttaacaggaagctcctaggcctctgtgtctggacttcagagcacctgcttctccctggccttcatccctagttgcactaaccatcctgggcttcctgtcctgtgtcccttgatgggtgccctccaggaaccaaggggcggttctcactgcaggtggcagcactaaggacccccctccccaccccaccccgccaacgcaacaagagttagcagcgaggtccccgtgagtcccacccatgacctgcagacagtgttgcccactggaactttctgtggcgcccaccactcagcccttcccagcacttgtccagagcctctttctccctcagcacagctcaggcctcaggcctgacacttccctgccttgtgtcttttgctaaatatgacctttctatattaataaaagatgctttggagttgtgctctctaaaaaaaagtttaatataaaggagaaataaaaggaaatttagcaaagaaatatgtagatgaatatttaaatactcagaggtgacattactaccagacataatgagattatcagatgtttcatttacttatgattaatatgtttgtatttattttttattcattttattttatttatgtatttatttttattatactttaagttctagggtacatgtgcacaacgtgcaggtttgttacatctgtatacatgtgctgtgttggtttgctgcacccattaacttgtcatttacattaggtatttctcctaatgctctccctcccccagccccccaccccatgacaggccccagtgtgtgatgttcccctgcctgtgtccaagtattctcattgtttaatttccacctatgagtgagaatatgcagtgtttggttttctgaccttgcgatagtttaaacaaactaggaagttcagaagtcactttacaagagaaataaagaaaaataaagtattaatgacattggtaacagaataaaaattagagttagacaaagtattagcaagcaagcttatatatttataagagatgggaaaatattagaaaggaataaatcatgtcttgtcaacatgaagaaaaagtgtatttttttgttaacttattattgtgtttccttgtataattttcacttggttttgttggttttactacttgcttcattctttcaaaaactacatcttcatagaccatttcagcttttgctatgtaggcagaattataaaacccaatttcaaaatttcaactgaacgttgtcagcatttttctttgggctttttattgaaaaaaaaaaacctaagtaattgtgtgtgtgtgtattttagtattaccatgaatgtaataacaataaagtcaaacaaaaacaaatggatatgcaatatgttggactagcatctcaaatatgaaaaaggcattgccaacagtgatataattttttttcataacggtaagctttttaaagtataatcttattttaacctaaaatcttactatcagaaaatgcagtgtacattaaaatgttctgaaatgctttattcacatttattaaatggttgtactcactcagatatctacaaattggtttttcacttatgtaattatcttatagaatgttcaaaagtcatgcagaatgtgagataattttctattgaatatgattgttttatcattgcaagacatcaaacatccctgtttcctgccaaatgaatgtacaatagcaataaatgtaaagatgtgttttttggaaaagacacatttttgagttataaaacaaggattttaaaacttgaattgttacagtgagtatgtcttaatataggctacagtcactttagataaaaaattacctcacatctattttcaatattacttaaagatgttcatttagtggcaaatattttttttttgcctagaggcagatattttgccacatggctatttatgaaactgtatttaaatgcatgtacacatataaaagctgccactgtggctgtaaactattacaagttatcaagattaaaaaataaacaaaaaatatttcagtttttctatgaaatgtctttactcgagtccaaatttagaggtttaaaatg

SEQ ID NO: 61120 - DNA, 3168 bp, Homo sapiens
ctggctaggacctccagtactatgttgaaaaggagtggtgagagtaggctcttcgtcttgttccagttctcaaagggaatgctttcaccttttccccattcagtattatgttggctgtgggtctgtcatagatggcttttattacattaagactcagcttcgcactccagggctgcgtaccaccagccactgtcatgttaaccccttcccaggccaatgtgtccttggcctggagcccaatctgctggacagcttgggaccgtccattttcggggtggtgggcaacctggtggccatcgtggtgctgtgcaagtcgcgcaaggagcagaaggagaccaccttctacacagttatgcggctggctgccaccgacctgttgttcactttgctggtgagccaggtgaccatcgccatgtacatgaagggcgggtaacctgggggccagctgctgtgtgagtacagcatcttcagcctgttcttcttcagtcagtccggcctcagcatcgtctgtgccatgatatctatacaggatgtctcaactcaaatgtgaaattttcatggagaatatttgaactgtatttagattaatacaaattgcagttaaaaagtttaatatagatttaccagggggcgtgcagccctcttgccaatcagatcgttgctgagcggtcccgcagccaacccccgaagagcagcctgctggcttccccagcgcccaggagttggggatgtcctacaaacctaccacccctgcccccagcagcacccccggcttcagcacccctgggccaggcactccggtccctacaggaagcgtcccgtcgccgtcgggctcagggccgggagccactgccccttgcagaccgctgtttaaagactttggaccgcctaccgtcggttgtatgcaggccatgaaaccacctggtgcccagggctcccagagcacctacacggaactgctgttggtcacaggggagatgggcaaagggatccggcccacctatgctggcagcaagagcgccgcggagcgcctgaagagaggtatcatccatccctagtcagagtgcctggtagagacagagcggaacgcccacacttaacaggaagctcctaggcctctgtgtctggacttcagagcacctgcttctccctggccttcatccctagttgcactaaccatcctgggcttcctgtcctgtgtcccttgatgggtgccctccaggaaccaaggggcggttctcactgcaggtggcagcactaaggacccccctccccaccccaccccgccaacgcaacaagagttagcagcgaggtccccgtgagtcccacccatgacctgcagacagtgttgcccactggaactttctgtggcccccaccactcagcccttcccagcacttgtccagagcctctttctccctcagcacagctcagacctcaggcctgacacttccttgccttgtgtcttttgctaaatatgacctttctatattaataaaagatgctttggagttgtgctctctaaaaaaaagtttaatataaaggagaaataaaaggaaatttagcaaagaaatatgtagatgaatatttaaatactcagaggtgacattactaccagacataatgagattatcagatgtttcatttacttatgattaatatgtttgtatttattttttattcattttattttatttatgtatttatttatttttattatactttaagttctagggtacatgtgcacaacgtgcaggtttgttacatctgtatacatgtgctgtgttggtttgctgcacccattaacttgttatttacattaggtatttctcctaatgctctccctcccccagccccccaccccatgacaggccccagtgtgtgatgttcccctgcctgtgtccaagtattctcattgtttaatttccacctatgagtgagaatatgcagtgtttggttttctgaccttgcgatagtttaaacaaactaggaagttcagaagtcactttacaagagaaataaagaaaaataaagtattaatgacattggtaacaataaaaattagagttagacaaagtattaacaagcaagcttatatatttataagagatgggaaaatattagaaaggaataaatcatgtcttgtcaacatgaagaaaaagtgtatttttttgttaacttattattgtgtttccttgtataattttcacttggttttgttggttttactacttgcttcattctttcaaaaactgcatcttcatagaccatttcagcttttgctatgtgggcagaattataaaacccaatttcaaaatttcagctgaacgttgtcagcatttttctttgggctttttatcggaaaaaaaacctaagtaattgtgtgtgtgtgtattttagtattaccatgaatgtaataacaataaaatcaaacaaaaacaaatggatatgcaatatgttggactagcatctcaaatatgaaaaaggcattgccaacagtgatataattttttttcataatggtaagctttttaaagtataatcttattttaacctaaaatcttactatcagaaaatgcagtgtacattaaaatgttctgaaatgctttattcacatttattaaatggttgtactcactcagatatctacaaattggtttttcacttatgtaattatcttatagaatgttcaaaagtcatgcagaatgtgagataactttctattgaatatgattgttttatcattgcaagacatcaaacatccctgtttcctgccaaatgaatgtacaatagcaataaatgtaaagatgtgttttttggaaaagacacatttttgagttataaaacaaggattttaaaacttgaattgttacagtgagcatgtcttaatataggctacagtcactttagataaaaaattacctcacatctattttcaatattacttaaagatgttcatttagtggcaaatattttttttttgcctggaggcagatattttgccacatggctatttatgaaactgtatttaaatgcatgtacacatataaaagctgccactgtggctgtaaactattacaagttatcaagattaaaaaataaacaaaaaatatttcagtttttctatgaaatgtctttactcgagtccaaatttagaggtttaaaatg

SEQ ID NO: 61121 - DNA, 159 bp, Homo sapiens
atgaagaaagaccaatgctgctttaaggcttttagtgaacatctgaagtgcccacaagacaacaacaaaagcagcatacattgtatggatttatctcaacgctattgtttaatggctgtgtttaatgtgatctatctggaaaatgaggactccgaataa

SEQ ID NO: 61122 - DNA, 159 bp, Homo sapiens; identical to SEQ ID NO: 61121

SEQ ID NO: 61123 - DNA, 396 bp, Homo sapiens
acccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcattagcagtgctttagcctggtatcagcagaaaccagggaaagctcctaagctcctgatctatgatgcctccagtttggaaagtggggtcccatcaaggttcagcggcagtggatctgggacagatttcactctcaccatcagcagcctgcagcctgaagattttgcaacttattactgtcaacagtttaataattaccctcacatagtgttacaaacccgaacataa

SEQ ID NO: 61124 - DNA, 399 bp, Homo sapiens
tcccctacagaagcccccagagagcagcacctcaccatggactgcacctggaggatcctcctcttggtggcagcagctacaggcacccacgccgaggtccagctggtacagtctggggctgaggtgaagaagcctggggctacagtgaaaatctcctgcaaggtttctggatacaccttcaccgactactacatgcactgggtgcaacaggcccctggaaaagggcttgagtggatgggacttgttgatcctgaagatggtgaaacaatatacgcagagaagttccagggcagagtcaccataaccgcggacacgtctacagacacagcctacatggagctgagcagcctgagatctgaggacacggccgtgtattactgtgcaacagacacagtgtga

SEQ ID NO: 61125 - DNA, 1652 bp, Homo sapiens
agcagctgcagtcggaaaaatcagagaaagcgtcacccagccccagattccgaggggcctgccagggactctctcctcctgctccttggaaaggaagaccccgaaagacccccaagccaccggctcagacctgcttctgggctgccatgggacttgcggccaccgccccccggctgtcctccacgctgccgggcagataagggcagctgctgcccttggggcacctgctcactcccgcagcccagccactcctccagggccagcccttccctgactgagtgaccacctctgctgccccgaggccatgtaggccgtgcttaggcctctgtggacacactgctggggacggcgcctgagctctcagggggacgaggaacaccaccatgccccggggcttcacctggctgcgctatcttgggatcttccttggcgtggccttggggaatgagcctttggagatgtggcccttgacgcagaatgaggagtgcactgtcacgggttttctgcgggacaagctgcagtacaggagccgacttcagtacatgaaacactacttccccatcaactacaagatcagtgtgccttacgagggggtgttcagaatcgccaacgtcaccaggctgcagagggcccaggtgagcgagcgggagctgcggtatctgtgggtcttggtgagcctcagtgccactgagtcggtgcaggacgtgctgctcgagggccacccatcctggaagtacctgcaggaggtgcagacgctgctgctgaatgtccagcagggcctcacggatgtggaggtcagccccaaggtggaatccgtgttgtccctcttgaatgccccagggccaaacctgaagctggtgcggcccaaagccctgctggacaactgcttccgggtcatggagctgctgtactgctcctgctgtaaacaaagctccgtcctaaactggcaggactgtgaggtgccaagtcctcagtcttgcagcccagagccctcattgcagtatgcggccacccagctgtaccctccgcccccgtggtcccccagctccccgcctcactccacgggctcggtgaggccggtcagggcacagggcgagggcctcttgccctgagcaccctggatggtgactgcggataggggcagccagaccagctcccacaggagttcaactgggtctgagacttcaaggggtggtggtgggagccccccttgggagaggacccctgggaagggtgtttttcctttgagggggattctgtgccacagcagggctcagcttcctgccttccatagctgtcatggcctcacctggagcggaggggacctggggacctgaaggtggatggggacacagctcctggcttctcctggtgctgccctcactgtccccccgcctaaagggggtactgagcctcctgtggcccgcagcagtgagggcacagctgtgggttgcaggggagacagccagcacggcgtggccattctatgaccccccagcctggcagactggggagctgggggcagagggcggtgccaagtgccacatcttgccatagtggatgctcttccagtttcttttttctattaaacaccccacttcctttgaaaaaaaaaaaaaaaaaaaaaaaaaaaaaaaaaaaaaaaaaaaaaa

SEQ ID NO: 61126 - DNA, 3565 bp, Homo sapiens
gattcccgggcccacccgacccagcggcgcgaccctggccctccgggaccctccgctgactccaccgcgcacttcccgggacccccacacacatcccagccctccggccgatccctccctactcggtgccgggtgccccccgccctctccaggcccggatctcctcccccaggtccccggggcggccccagccaggcccccttcgaaccccgccggcggcccgggctggggcgcaccatgcggctgcggctccggcttctggcgctgctgcttctgctgctggcaccgcccgcgcgcgccccgaagccctcggcgcaggacgtgagcctgggcgtggactggctgactcgctatggttacctgccgccaccccaccctgcccaggcccagctgcagagccctgagaagttgcgcgatgccatcaaagtcatgcagaggttcgcggggctgccggagaccggccgcatggacccagggacagtggccaccatgcgtaagccccgctgctccctgcctgacgtgctgggggtggcggggctggtcaggcggcgtcgccggtacgctctgagcggcagcgtgtggaagaagcgaaccctgacatggagggtacgttccttcccccagagctcccagctgagccaggagaccgtgcgggtcctcatgagctatgccctgatggcctggggcatggagtcaggcctcacatttcatgaggtggattccccccagggccaggagcccgacatcctcatcgactttgcccgcgccttccaccaggacagctaccccttcgacgggttggggggcaccctagcccatgccttcttccctggggagcaccccatctccggggacactcactttgacgatgaggagacctggacttttgggtcaaaagacggcgaggggaccgacctgtttgccgtggctgtccatgagtttggccacgccctgggcctgggccactcctcagcccccaactccattatgaggcccttctaccagggtccggtgggcgaccctgacaagtaccgcctgtctcaggatgaccgcgatggcctgcagcaactctatgggaaggcgccccaaaccccatatgacaagcccacaaggaaacccctggctcctccgccccagcccccggcctcgcccacacacagcccatccttccccatccctgatcgatgtgagggcaattttgacgccatcgccaacatccgaggggaaactttcttcttcaaaggcccctggttctggcgcctccagccctccggacagctggtgtccccgcgacccgcacggctgcaccgcttctgggaggggctgcccgcccaggtgagggtggtgcaggccgcctatgctcggcaccgagacggccgaatcctcctctttagcgggccccagttctgggtgttccaggaccggcagctggagggcggggcgcggccgctcacggagctggggctgcccccgggagaggaggtggacgccgtgttctcgtggccacagaacgggaagacctacctggtccgcggccggcagtactggcgctacgacgaggcggcggcgcgcccggaccccggctaccctcgcgacctgagcctctgggaaggcgcgcccccctcccctgacgatgtcaccgtcagcaacgcaggtgacacctacttcttcaagggcgcccactactggcgcttccccaagaacagcatcaagaccgagccggacgccccccagcccatggggcccaactggctggactgccccgccccgagctctggtccccgcgcccccaggccccccaaagcgacccccgtgtccgaaacctgcgattgtcagtgcgagctcaaccaggccgcaggacgttggcctgctcccatcccgctgctcctcttgcccctgctggtggggggtgtagcctcccgctgatggggggagccatccagaccgaacagcgccctccacggccgagtcccccgccgctggacctggtcgggggttgtgaggcgctgcggaggccccttgtctgttcccacggacgggggctcgggcgcggactaagcaggggggatctcccgcgcaggggcggcggcggcggggaccggtcgcctggcgctgggctcagtctcctcagggtctgagaccccggcgctgccaccggaacccgccttcaggggcgcacgcgcgctgggaccatgcgtcggtcgtcgcccccgtcgttccctcccggctgccgccagggggcggtcggaccccgcctcccgagcccggggaggggcggggaggacaaggggcgggcccgcggcctcacccggagggacggcagccccggtcgcgcgctggccccgcaggaccttccttttccaggaagagccagcttttctcggagcgcagtcctgggactctccgcagccccgccccgcctggccactgcgtctggcattcctgggtcgttagaggacaggcctgactgcgaagctgtgccttgcccctctcccacccgcagtttctcaccccgttctgctcccacaaggcccccctacagtcactgccacactggtggggacctgggacccagacccggaaccagcccagatatcacccctgaggacccatgcgccacgtcctgggtggtggaatcagtggctggagggacgacccttgctctccaggctgttaaccttttccgttgctcccccgccacccacctcctcctccccaggccacccaacttgggcacctccctgggcccagaactgccttccattcaatggggaacccttctatccccaagaaccccttccctgcttgcaccctggagagaacagcttgactcccatcaactcaacgctggtggaaagacagggaccgaaccctggctcaggcctggtcattgcctcctcagcactccctcctgggaggccttagctctagagtgaggggtgggtggaacctgggggcacctcgttcaccctgtccccactccccacagttttaggatctaaatgattgcctctggaactattcttctagactatcccacatcagaatcactgggaaatttaagtttgcagatcccacactcaccctgaatcctcactcagggtggggtcaggaatctgcattttaactagtcgcggggattgtggggggcagtagctggctgtttcgtggcatttctgtggctctgcagtgttcctccaccccaggaccaatatgttcaggccacaccgatggcctgaaccccatgggtagagtcacttaggggccacttcctaagttgctgtccagcctcagtgaccccctagtgcttcctggagctgaggctgtgggcggctgtcccagcaaccatgcgaggggttgccccagttgctcatacaaacagatcagcatgaggacagaaggcaggagactttggtcagttacctgggaattctgggctgccaggaaacgatttgggcctctgtcagtttcttttccatgtatgaggagggggaaatttgtatattagaaacttattcatcccactcaggacaataaaaacgaatgtacaaaaaaaaaaaaaaaa

SEQ ID NO: 61127 - DNA, 3105 bp, Homo sapiens
gattcccgggcccacccgacccagcggcgcgaccctggccctccgggaccctccgctgactccaccgcgcacttcccgggacccccacacacatcccagccctccggccgatccctccctactcggtgccgggtgccccccgccctctccaggcccggatctcctcccccaggtccccggggcggccccagccaggcccccttcgaaccccgccggcggcccgggctggggcgcaccatgcggctgcggctccggcttctggcgctgctgcttctgctgctggcaccgcccgcgcgcgccccgaagccctcggcgcaggacgtgagcctgggcgtggactggctgactcgctatggttacctgccgccaccccaccctgcccaggcccagctgcagagccctgagaagttgcgcgatgccatcaaagtcatgcagaggttcgcggggctgccggagaccggccgcatggacccagggacagtggccaccatgcgtaagccccgctgctccctgcctgacgtgctgggggtggcggggctggtcaggcggcgtcgccggtacgctctgagcggcagcgtgtggaagaagcgaaccctgacatggagggtacgttccttcccccagagctcccagctgagccaggagaccgtgcgggtcctcatgagctatgccctgatggcctggggcatggagtcaggcctcacatttcatgaggtggattccccccagggccaggagcccgacatcctcatcgactttgcccgcgccttccaccaggacagctaccccttcgacgggttggggggcaccctagcccatgccttcttccctggggagcaccccatctccggggacactcactttgacgatgaggagacctggacttttgggtcaaaagacggcgaggggaccgacctgtttgccgtggctgtccatgagtttggccacgccctgggcctgggccactcctcagcccccaactccattatgaggcccttctaccagggtccggtgggcgaccctgacaagtaccgcctgtctcaggatgaccgcgatggcctgcagcaactctatgggaaggcgccccaaaccccatatgacaagcccacaaggaaacccctggctcctccgccccagcccccggcctcgcccacacacagcccatccttccccatccctgatcgatgtgagggcaattttgacgccatcgccaacatccgaggggaaactttcttcttcaaaggcccctggttctggcgcctccagccctccggacagctggtgtccccgcgacccgcacggctgcaccgcttctgggaggggctgcccgcccaggtgagggtggtgcaggccgcctatgctcggcaccgagacggccgaatcctcctctttagcgggccccagttctgggtgttccaggaccggcagctggagggcggggcgcggccgctcacggagctggggctgcccccgggagaggaggtggacgccgtgttctcgtggccacagaacgggaagacctacctggtccgcggccggcagtactggcgctacgacgaggcggcggcgcgcccggaccccggctaccctcgcgacctgagcctctgggaaggcgcgcccccctcccctgacgatgtcaccgtcagcaacgcaggtgacacctacttcttcaagggcgcccactactggcgcttccccaagaacagcatcaagaccgagccggacgccccccagcccatggggcccaactggctggactgccccgccccgagctctggtccccgcgcccccaggccccccaaagcgacccccgtgtccgaaacctgcgattgtcagtgcgagctcaaccaggccgcaggacgttggcctgctcccatcccgctgctcctcttgcccctgctggtggggggtgtagcctcccgctgatggggggagccatccagaccgaacagcgccccgcctggccactgcgtctggcattcctgggtcgttagaggacaggcctgactgcgaagctgtgccttgcccctctcccacccgcagtttctcaccccgttctgctcccacaaggcccccctacagtcactgccacactggtggggacctgggacccagacccggaaccagcccagatatcacccctgaggacccatgcgccacgtcctgggtggtggaatcagtggctggagggacgacccttgctctccaggctgttaaccttttccgttgctcccccgccacccacctcctcctccccaggccacccaacttgggcacctccctgggcccagaactgccttccattcaatggggaacccttctatccccaagaaccccttccctgcttgcaccctggagagaacagcttgactcccatcaactcaacgctggtggaaagacagggaccgaaccctggctcaggcctggtcattgcctcctcagcactccctcctgggaggccttagctctagagtgaggggtgggtggaacctgggggcacctcgttcaccctgtccccactccccacagttttaggatctaaatgattgcctctggaactattcttctagactatcccacatcagaatcactgggaaatttaagtttgcagatcccacactcaccctgaatcctcactcagggtggggtcaggaatctgcattttaactagtcgcggggattgtggggggcagtagctggctgtttcgtggcatttctgtggctctgcagtgttcctccaccccaggaccaatatgttcaggccacaccgatggcctgaaccccatgggtagagtcacttaggggccacttcctaagttgctgtccagcctcagtgaccccctagtgcttcctggagctgaggctgtgggcggctgtcccagcaaccatgcgaggggttgccccagttgctcatacaaacagatcagcatgaggacagaaggcaggagactttggtcagttacctgggaattctgggctgccaggaaacgatttgggcctctgtcagtttcttttccatgtatgaggagggggaaatttgtatattagaaacttattcatcccactcaggacaataaaaacgaatgtacaaaaaaaaaaaaaaaa

SEQ ID NO: 61128 - DNA, 2494 bp, Homo sapiens
agtccctttttcttgagagagtgtggctctgtcaccaaggctggagtgcaggggcacaatctcagctcactgcaacctccaccttgcgtgtctcagcctcctgagcagctgggaccgcgggagtgtgccaccacacccagctaatttttgtatttttttagtggagatggggtgtcaccatgttggccaggctggtctcaaactctcggcctcagcctcccaaagtgctgggattataggtgtgagccaccacacccagcctctatatcccttttatcggtggacccaacaatcttctgtagacagaagactgtgtgaataagccaatggtcccaagagagcacgcatcctaatgagaacggagacagataataaagagggaaacaagtaaaccaactatcaatgattaggagcgtcagatagagccaggtgcagcctggacaacatgatgagatccccatctctaaaagtataaaataaattggctggtcatgatggtgcacacctgtggccccagcttctcagtaggctgaggtgggaggattgcttgagcctgggaggtcaagcctacagtgagccatgatctcaccatgcactccagcctagacaacagggcaaggccctctaaaaaaaaaaatgaaaagatagcatgctttggccggatgtggtggctcacgcctgtaatcccagcacttcggggggttgaggcgggcagatcactgaggtcaggagtacgagatcagcctggccagcacggtgaaaccccgtctctgctgaaggtgcaaaattgactgggcgtggtggctcatgcctgtagtcccagctactctggaggctgaggcgggagaatcgcttgaacccgggaggcggaggttgtggtgagctgagattgcgccattgcactccagcctgggcaacaagagcgaaactccgtctcaaaaaaggatagcatgcttcataaacggtgaaatgacatgcaaaggccatagttgtcaagcaccagtaacaccagagagtggcctgtctttccttcaagcagaccagagaggaccgttctgctggacgcctacagtgaacatctggcagcggccctgtgcaccaatccaaacctgatagagctgtctctgtaccgaaatgccctgggcagccggggggtgaagctgctctgtcaaggactcagacaccccaactgcaaacttcagaacctgagcactttgggaggcccagatggggaggatcacttgacccaggagttcaagaccagcctggccaacatggtgaaaccccatctctactaaaaataccaaaatgagccaggcatggtggcacacgtctgtaagcccagctactcaggaggccaaggcaggaggattgcttcaacccaggaggcagaggttgtggctgaagaggtgccgcatctccagctcagcctgcgaggacctctctgcagctctcatagccaataagaatttgacaaggatggatctcagtggcaacggcgttggattcccaggcatgatgctgctttgcgagggcctgcggcatccccagtgcaggctgcagatgattcagttgaggaagtgtcagctggagtccggggcttgtcaggagatggcttctgtgctcggcaccaacccacatctggttgagttggacctgacaggaaatgcactggaggatttgggcctgaggttactatgccagggactgaggcacccagtctgcagactacggactttgtggctgaagatctgccgcctcactgctgctgcctgtgacgagctggcctcaactctcagtgtgaaccagagcctgagagagctggacctgagcctgaatgagctgggggacctcggggtgctgctgctgtgtgagggcctcaggcatcccacgtgcaagctccagaccctgcggctggatagctgtggcctcacagccaaggcttgtgagaatctttacttcaccctggggatcaaccagaccttgaccgacctttacctgaccaacaacgccctaggggacacaggtgtccgactgctttgcaagcggctgagccatcctggctgcaaactccgagtcctctggttatttgggatggacctgaataaaatgacccacagtaggttggcagcgcttcgagtaacaaaaccttatttggacattggctgctgaatggtcctatctgctggctctcccctgagatctggacagaggaagatgggagggtgctcatcacccccccagcataatgatcagcctccttcctagagacagactcatgcagattgagatcaaaagtccctctgcttgggatcaaattaatgtttgacagagctggccaggcgtggtggctcatgtatgtaatcctagcacttcgagaggccgaggcaggtggatcacgaggtcaggagtttgagattagcctggccaagatggtgaaaccctgtctctactaaaaataaaaaaaaattagccaggaaaaaaaaaaaaaaaa

SEQ ID NO: 61129 - DNA, 3827 bp, Homo sapiens
ccacgcgtccggcaaaaggtctttcctcccttgctctctcctccaaccactggctcagcctctccgcccgctgcctgtgaatgatgcaatggaaggtgtgctggggtcgccctgtgtcccgtgcataggagcatctcagcctccaggtcctctcctttggggctcacggcacccccatgctacgaaccgcaggcagggacggcctctgtcgcctgtccacctacttggaagaactcgaggctgtggaactgaagaagttcaagttatacctggggaccgcgacagagctgggagaaggcaagatcccctggggaagcatggagaaggccggtcccctggaaatggcccagctgctcatcacccacttcgggccagaggaggcctggaggttggctctcagcacctttgagcggataaacaggaaggacctgtgggagagaggacagagagaggacctggtgagggataccccacctggtggcccgtcctcacttgggaaccagtcaacatgccttctggaagtctctcttgtcactccaagaaaagatccccaggaaacctacagggactatgtccgcaggaaattccggctcatggaagaccgcaatgcgcgcctaggggaatgtgtcaacctcagccaccggtacacccggctcctgctggtgaaggagcactcaaaccccatgcaggtccagcagcagcttctggacacaggccggggacacgcgaggaccgtgggacaccaggctagccccatcaagatagagaccctctttgagccagacgaggagcgccccgagccaccgcgcaccgtggtcatgcaaggcgcggcagggataggcaagtccatgctggcacacaaggtgatgctggactgggcggacgggaagctcttccaaggcagatttgattatctcttctacatcaactgcagggagatgaaccagagtgccacggaatgcagcatgcaagacctcatcttcagctgctggcctgagcccagcgcgcctctccaggagctcatccgagttcccgagcgcctccttttcatcatcgacggcttcgatgagctcaagccttctttccacgatcctcagggaccctggtgcctctgctgggaggagaaacggcccacggagctgcttcttaacagcttaattcggaagaagctgctccctgagctatctttgctcatcaccacacggcccacggctttggagaagctccaccgtctgctggagcaccccaggcatgtggagatcctgggcttctctgaggcagaaaggaaggaatacttctacaagtatttccacaatgcagagcaggcgggccaagtcttcaattacgtgagggacaacgagcctctcttcaccatgtgcttcgtccccctggtgtgctgggtggtgtgtacctgcctccagcagcagctggagggtggggggctgttgagacagacgtccaggaccaccactgcagtgtacatgctctacctgctgagtctgatgcaacccaagccgggggccccgcgcctccagcccccacccaaccagagagggttgtgctccttggcggcagatgggctctggaatcagaaaatcctatttgaggagcaggacctccggaagcacggcctagacggggaagacgtctctgccttcctcaacatgaacatcttccagaaggacatcaactgtgagaggtactacagcttcatccacttgagtttccaggaattctttgcagctatgtactatatcctggacgagggggagggcggggcaggcccagaccaggacgtgaccaggctgttgaccgagtacgcgttttctgaaaggagcttcctggcactcaccagccgcttcctgtttggactcctgaacgaggagaccaggagccacctggagaagagtctctgctggaaggtctcgccgcacatcaagatggacctgttgcagtggatccaaagcaaagctcagagcgacggctccaccctgcagcagggctccttggagttcttcagctgcttgtacgagatccaggaggaggagtttatccagcaggccctgagccacttccaggtgatcgtggtcagcaacattgcctccaagatggagcacatggtctcctcgttctgtctgaagcgctgcaggagcgcccaggtgctgcacttgtatggcgccacctacagcgcggacggggaagaccgcgcgaggtgctccgcaggagcgcacacgctgttggtgcagctaccagagaggaccgttctgctggacgcctacagtgaacatctggcagcggccctgtgcaccaatccaaacctgatagagctgtctctgtaccgaaatgccctgggcagccggggggtgaagctgctctgtcaaggactcagacaccccaactgcaaacttcagaacctgaggctgaagaggtgccgcatctccagctcagcctgcgaggacctctctgcagctctcatagccaataagaatttgacaaggatggatctcagtggcaacggcgttggattcccaggcatgatgctgctttgcgagggcctgcggcatccccaatgcaggctgcagatgattcagttgaggaagtgtcagctggagtccggggcttgtcaggagatggcttctgtgcttggcaccaacccacatctggttgagttggacctgacaggaaatgcactggaggatttgggcctgaggttactatgccagggactgaggcacccagtctgcagactacggactttgtggctgaagatctgccgcctcactgctgctgcctgtgacgagctggcctcaactctcagtgtgaaccagagcctgagagagctggacctgagcctgaatgagctgggggacctcggggtgctgctgctgtgtgagggcctcaggcatcccacgtgcaagctccagaccctgcggttgggcatctgccggctgggctctgccgcctgtgagggtctttctgtggtgctccaggccaaccacaacctccgggagctggacttgagtttcaacgacctgggagactggggcctgtggttgctggctgaggggctgcaacatcccgcctgcagactccagaaactgtggctggatagctgtggcctcacagccaaggcttgtgagaatctttacttcaccctggggatcaaccagaccttgaccgacctttacctgaccaacaacgccctaggggacacaggtgtccgactgctttgcaagcggctgagccatcctggctgcaaactccgagtcctctggttatttgggatggacctgaataaaatgacccacagtaggttggcagcgcttcgagtaacaaaaccttatttggacattggctgctgaatggtcctatctgctggctctcccctgagatctggacagaggaagatgggagggtgctcatcacccccccagcataatgatcagcctccttcctagagacagactcatgcagattgagatcaaaagtccctctgcttgggatcaaattaatgtttgacagagctggccaggcgtggtggctcatgtatgtaatcctagcacttcgagaggccgaggcaggtggatcacgaggtcaggagtttgagattagcctggccaagatggtgaaaccctgtctctactaaaaataaaaaaaaattagccaggcatggtggcgggcacctgtagtcccagctactcaggaggctgaggcaggagaatcgcttgaacccgggaggtggaggttgcagtgagccgagatcgcgccactgcactccagcctgggcgacagagtgggactccatctcaaaaaaaaaaaaaaaaaaa

SEQ ID NO: 61130 - DNA, 3050 bp, Homo sapiens
ctaaagagtcgccgcagacaagcaggcccccagatggagaaccagcctgtgaggtggcgggccctgccaggcctcccacgccctcctgggctccccgcagccccctggctcctccttggcgtgctgctgctgcccgggaccctgcgactggcaggaggacagtcagtgacccacaccggcctgcccatcatggcctccctggccaacacagctatctccttcagctgcaggatcacctatccatacactccccaattcaaggttttcacagtcagctactttcatgaagatctccagggacagaggagccctaagaagccaacaaactgccaccctggactgggcacagagaaccagagccacaccctggactgccaggtcacccttgtgctgccgggagcatcggccactggcacctactactgctctgtccactggccacactccacggtgagaggcagcggcaccttcatcctggtcagagacgcagggtaccgagagcccccgcagagtccacagaagctcctgctctttggcttcaccggcctcctgagtgtcctgagtgtagtgggcacggccctgctgctctggaacaagaagcggatgcggggtccagggaaggaccccaccaggaagtgcccagatccaagatctgccagcagccccaagcagcatccttcagaatctgtctacacagctctgcagcgccgcgagaccgaggtctatgcctgcatcgagaatgaggatggcagctcacccaccgccaagcagagccccctctcccaggagagaccgcatagattcgaagatgatggcgaacttaacctggtctatgaaaatctctaggatgggctccaccgctcatagagcttgccctgggtcagaggaccggggcagcccctgccaccaaaggacttgatctgagttgggagtaaggcccccagggacaccccatcatttcaccctcacattcaaggcccttcctgtcttggccggccccactgcccccccattctatgccccaaccaccaaggctttcccatcttggggcctttgcccaggctgttccttctgccaggcaggcccttcctcccttggcccaaccagcaaagcgcccctcagtcttcaagggctttcctggatgccacccttgcccagagccctgctcactgcctcatgctgacagagcagcatgctctcttggcaccagcctgcacctcagccagtagggcagcctctgagctgagggaggaccctgcaggggcgcctagcagtgctgtgtggggagccgaggtatggaggagctggggagcagctatgcaaatccctacctacccagctgggccagaggcacgaggcagccaggcagggtgggagcaggggctggcgtgggaggtctgggggacagacaaggatgatggacccctcagaggcaagactaggatcagggacagatctggaggcccaggacatggctgagaggtggtcagcaggctgggggcatggagcagagagggcttgggtacaagctggagaggaaggagattctggcatgttggggtgagggcagagggacagatgaggggaggagggtgctggctaaacaggaactgaatgaatggcctgaagctccctctcccaagggttcccactcccattggcctggccctgtacgtgcactgtgtcatctccttggtcaccctctgctccaggccttctccaccacaggacctcagctgtccctccttctacccaaggtggagtcccccaaagtcccttctgtctggcctatcctgtgcccaccacctgtggcttcatccagccctcctcctctatctttatctgccataggccgcagccctggccccctgtggattgaggtcccaagtggtccagctgtggggtttggtgctgggaccctcaatggcagccggaaggtccctctgaggcagaagctcaagccccatggggacagtggctccccagtgcctggccctgagccatttctgctgtttcaggtgcccacatcaccctcatttcctcctcgcagtagccctgcaccgtggccagaaacccatccacaggcaggcagtggctggggtccgggtgccccgggctgttgggctctgcttcctccctctgctcccccatgtctccctgagttctcccacctttgctcatttgtaaaatgggcaggtcaatcttcccaccccaccgtgtgggctgccccaaccccaaatgtgcccagggaggggggggaacccaaggcacaggccccgcccctgcccccaagcagcactgggctactggctcacagaagcacctttggttctgcaggtcatgcccctccctgcagggaagggaaagctggtggtagaggctgggcacagactgacgtccagaagaagtcccttggccctgctagggtggcaccagacttctctggtcccacaggacagccagtggcctcccaacttggttctgggcccccgcctgcaagcacacatggcaaggagggctttagcaggctcacataaccgagtggcaaggcccctgctcccagaggctggatttgaatgaactccgggcctgtttggggaggtgaagctgccaggtgtgcacaggggcctcccaggctcctggctccaccagccaaggaggtgggggcaagggtcagggcaatgggggacaatgccgctcagggtgcagtgagctcccctgggaaaaccgaagccagcaagaccaggagagggccacctcactgggcctgcctcccccacctcctgggcctctctgacctcagctcctagaccctggacccttggctgggactcagcattttccagtctttttcaggggtagacaggggagcctgggttaaactttaccactgtgccctggcccaggcatcaccaacacggcctccctgcagctgccctgccaccgacagaccccgattaaacccacacctggccttggcctcccctgctctataccttgcatggtttttgcctcacttggaataaaattccaactcctcaaaaaaaaaa

SEQ ID NO: 61131 - DNA, 1678 bp, Homo sapiens
gcatatactgtcatcatcttggaaagaaaaggctgagaacgtaaaactgaggacagaggaggaaagcagggtgacccctgatgttgccctagaaaatggaaaacaaaacacagcaaaacagaaaaacagaagatctgactctgcctttagccaggaaaacagtttgggggagtaaaaagtattagggaaaagagtgggcattttgcctggaaaaaaggtttctagagccatctgggctttccgggaacctggaccagactctggcccagtaggatgtccccgtgtcctccccagcagagcaggaacagggtgatacagctgtccacttcagagctaggagagatggaactgacttggcaggagatcatgtccatcaccgagctgcagggtctgaatgctccaagtgagccatcatttgagccccaagccccagctccataccttggacctccaccacccacaacttactgcccctgctcaatccacccagattctggcttcccacttcctccaccaccttatgagctcccagcatccacatcccatgtcccagatcccccatactcctatggcaacatggccataccagtctccaagccactgagcctctcaggcctgctcagtgagccgctccaagaccccttagccctcctggacattgggctgccagcagggccacctaagccccaagaagacccagaatccgactcaggattatccctcaactatagcgatgctgaatctcttgagctggaggggacagaggctggtcggcggcgcagcgaatatgtagagatgtacccagtggagtacccctactcactcatgcccaactccttggcccactccaactataccttgccagctgctgagacccccttggccttagagccctcctcaggccctgtgcgggctaagcccactgcacggggggaggcagggagtcgggatgaacgtcgggccttggccatgaagattccttttcctacggacaagattgtcaacttgccggtagatgactttaatgagctattggcaaggtacccgctgacagagagccagctagcgctagtccgggacatccgacgacggggcaaaaacaaggtggcagcccagaactgccgcaagaggaagctggaaaccattgtgcagctggagcgggagctggagcggctgaccaatgaacgggagcggcttctcagggcccgcggggaggcagaccggaccctggaggtcatgcgccaacagctgacagagctgtaccgtgacattttccagcaccttcgggatgaatcaggcaacagctactctcctgaagagtacgcgctgcaacaggctgccgatgggaccatcttccttgtgccccgggggaccaagatggaggccacagactgagctggcccagaggggtggaactgctgatgggatttccttcattcccttctgataaaggtactccccaaccctgagtcccagaaggagctgagttctctagaccagaagaggatgacaatggcaacaagtgtttggaagttccaaggtgtgttcaaagaggcttgccttgagggagggctggaatctgtcttccctgactcggctcctcaggtctttagcctccaccttgtctaagctttggtctataaagtgcgctacagaaaaaaaaaaaaaaaaaaaaaaa

SEQ ID NO: 61132 - DNA, 2083 bp, Homo sapiens
caaaacccagacccccaggtcccggccaatggaggcgatttagactggagtgggaccgcgtctgtcaaaagcccgactcggcagcagcggcggagtccaggaggagagctggagccgccgcgctgcctccccgcccccgccgggatttattatttggactggacaattaagtggccctgatgatgttaccaagcccggtcacctccacccctttctcagtcaaagacattttgaatctggagcagcagcaccagcacttccatggtgcgcacttgcaggcggacttggagcaccacttccactctgcgccctgcatgctggccgccgctgaggggacgcaattttctgacggaggggaggaggacgaggaagacgagggcgagaaattgtcctatttgaactcactagccgcagcagacggccacggggattcagggctgtgtccccagggctatgtccacacggtcctgcgagactcgtgcagcgagcccaaggaacatgaagaggagcccgaggtcgtgagggaccggagccaaaaaagctgccagctgaagaagtctctagagacggccggagactgcaaggcggcggaggagagcgagaggccgaagccacgcagccgccggaagccccgggtcctcttctcgcaagcccaggtcttcgagctggaacgcaggttcaagcagcagcggtacctgtcggcacccgagcgcgagcacctcgccagcagcctgaagctcacatccactcaggtgaaaatctggttccagaatcgcaggtacaagtgcaagagacagcggcaggacaagtctctggagcttggcgcacacgcgcccccgccgccgccgcgccgcgtggctgtcccggtgctggtgcgggacggcaagccgtgcgtcacgcccagcgcgcaggcctacggcgcgccctacagcgtgggcgccagcgcctactcctacaacagcttccccgcctacggctatgggaactcggcggcgggacctccgcggcgaccactgccatgcagcccgcctgcagcgcggccggaggcggcccctttgtgaacgtgagcaacctaggaggcttcggcagcggcggcagcgcacagccgttgcaccagggtactgcagccggggccgcgtgcgctcagggcaccttgcagggcatccgggcctggtagggacggggcgggtcacgcggcgggcaccccagcgcagcctggcgccgcgggactgaagctcgagaagggcctgacctaaaggtcaggtcccctcgttaaaaaaatatgtacgtctagctcctcagggcttcggatcgcagctcactcgaggcctggggaaggggactcaggggcgaggaggatgactgggtccggtcgccaggactgtctctgaggcagaaacgccggctgggcgccggggaggacgatggccccgaccctggcagcgagaggagaccaggaggctaggaccctggccgcgcttggttcttccaaagcgagaagggcttctctccctctgcctttccgcggcctccgcgaagcgttggcggggagcccaaggacataacaaattaaaagcatgaaggagagaaaaatgggggtcgtggcttgagaaattccaggccctaccgatcctctgccccctttgcgggcctggagcgccatagcacagtcgatttcgtttcgcagctgtctcccctccgcagcagatacctcggtccagatctccggattgtcgggggacgcaggactcttcgaggaaaaccagccgaatgagatcaaaagttgggggtggggggaggctgaacaaactcaggacctggtggcccaccggaggtgttaccgggtttcctttctgtttcgtattctgtattcagcacatgttatctatctatctatctatataactataaccacacgccgtgtagacacccgctgccacacactacaggagtcaataaacaaggtgcaatattttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 61133 - DNA, 4966 bp, Homo sapiens
gtagatgcagtccgccgccgccgctgcctcagccagcaatgcaagattagatctctaaatgcagcaaaacactgcctgaaaacagaccggcccgcgcagcaagcagacatttcacggtgcgctggggaagcttcaaaatatatctgtgactctgtcttcgttgctcttcatccccatcaatttcatcacgggaggcgagcagcaagtaagaatttcactttcggatctgcctagagacacacctccctgctccctcccccactcgatgtgaagagtattccggagtctccgggcgggagtagatttgcagcaccctagcgggagcgaggaaaacctactgattctttagctcattatcatctctcccagacgagatttccttcttatcgcctgcctcatcgctcaagtttgagcctcccgaagtccgggcgggagagacgaaacccctggctcacccccagccgcaggaagccaccgccttgctccaagcccctgcagctctgctgcaccgcagcttctcacccagtgcggatgctgtagatcaacaggttcagggaacttgagcagaataaggagagaccaccgggtgccgcagctcgggtgcagagggaaaaaaggacccatagacttgtggctcgcgtcgcgcgcgcacgctgcgccagggccccaggctggcgcgcactccctctctggctcctccagtccgattgctcctgcccccaccttacaggtctgggatgtacctttccatctgttgctgctttcttctatgggcccctgccctcactctcaagaacctcaactactccgtgccggaggagcaaggggccggcacggtgatcgggaacatcggcagggatgctcgactgcagcctgggcttccgcctgcagagcgcggcggcggagggcgcagcaagtcgggtagctaccgggtgctggagaactccgcaccgcacctgctggacgtggacgcagacagcgggctcctctacaccaagcagcgcatcgaccgcgagtccctgtgccgccacaatgccaagtgccagctgtccctcgaggtgttcgccaacgacaaggagatctgcatgatcaaggtagagatccaggacatcaacgacaacgcgccctccttctcctcggaccagatcgaaatggacatctcggagaacgctgctccgggcacccgcttccccctcaccagcgcacatgaccccgacgccggcgagaatgggctccgcacctacctgctcacgcgcgacgatcacggcctctttggactggacgttaagtcccgcggcgacggcaccaagttcccagaactggtcatccagaaggctctggaccgcgagcaacagaatcaccatacgctcgtgctgactgccctggacggtggcgagcctccacgttccgccaccgtacagatcaacgtgaaggtgattgactccaacgacaacagcccggtcttcgaggcgccatcctacttggtggaactgcccgagaacgctccgctgggtacagtggtcatcgatctgaacgccaccgacgccgatgaaggtcccaatggtgaagtgctctactctttcagcagctacgtgcctgaccgcgtgcgggagctcttctccatcgaccccaagaccggcctaatccgtgtgaagggcaatctggactatgaggaaaacgggatgctggagattgacgtgcaggcccgagacctggggcctaaccctatcccagcccactgcaaagtcacggtcaagctcatcgaccgcaacgacaatgcgccgtccatcggtttcgtctccgtgcgccagggggcgctgagcgaggccgcccctcccggcaccgtcatcgccctggtgcgggtcactgaccgggactctggcaagaacggacagctgcagtgtcgggtcctaggcggaggagggacgggcggcggcgggggcctgggcgggcccgggggttccgtccccttcaagcttgaggagaactacgacaacttctacacggtggtgactgaccgcccgctggaccgcgagacacaagacgagtacaacgtgaccatcgtggcgcgggacgggggctctcctcccctcaactccaccaagtcgttcgcgatcaagattctagacgagaacgacaacccgcctcggttcaccaaagggctctacgtgcttcaggtgcacgagaacaacatcccgggagagtacctgggctctgtgctcgcccaggatcccgacctgggccagaacggcaccgtatcctactctatcctgccctcgcacatcggcgacgtgtctatctacacctatgtgtctgtgaatcccacgaacggggccatctacgccctgcgctcctttaacttcgagcagaccaaggcttttgagttcaaggtgcttgctaaggactcgggggcgcccgcgcacttggagagcaacgccacggtgagggtgacagtgctagacgtgaatgacaacgcgccagtgatcgtgctccccacgctgcagaacgacaccgcggagctgcaggtgccgcgcaacgctggcctgggctatctggtgagcactgtgcgcgccctagacagcgacttcggcgagagcgggcgtctcacctacgagatcgtggacggcaacgacgaccacctgtttgagatcgacccgtccagcggcgagatccgcacgctgcaccctttctgggaggacgtgacgcccgtggtggagctggtggtgaaggtgaccgaccacggcaagcctaccctgtccgcagtggccaagctcatcatccgctcggtgagcggatcccttcccgagggggtaccacgggtgaatggcgagcagcaccactgggacatgtcgctgccgctcatcgtgactctgagcactatctccatcatcctcctagcggccatgatcaccatcgccgtcaagtgcaagcgcgagaacaaggagatccgcacttacaactgccgcatcgccgagtacagccacccgcagctgggtgggggcaagggcaagaagaagaagatcaacaaaaatgatatcatgctggtgcagagcgaagtggaggagaggaacgccatgaacgtcatgaacgtggtgagcagcccctccctggccacctcccccatgtacttcgactaccagacccgcctgcccctcagctcgccccggtcggaggtgatgtatctcaaaccggcctccaacaacctgactgtccctcaggggcacgcgggctgccacaccagcttcaccggacaagggactaatgcaagcgagacccctgccactcggatgtccataattcagacagacaattttcccgcagagcccaattacatgggcagcaggcagcagtttgttcaaagtatttcagtagctccacgtttaaggacccagaaagagccagcctgagagacagtgggcacggggacagtgatcaggctgacagtgaccaagacactaacaaaggctcctgctgtgacatgtctgttagggaggcactcaagatgaaaactacttcaactaaaagccaaccacttgaacaagaaccagaagagtgtgttaattgcacagatgaatgccgagtgcttggtcattctgacaggtgctggatgccacagttccctgcagccaatcaggctgaaaatgcagattaccgcacaaatctctttgtacctacagttgaagctaatgttgagactgagacttacgaaactgtgaatcccactgggaaaaagactttttgtacatttggaaaagacaagcgagagcacactattctcattgccaacgttaaaccttatttaaaagccaaacgtgccctgagccctctcctccaagaggtcccctcagcatcaagcagcccaaccaaggcgtgcatcgagccttgcacctcaacaaaaggctccctggatggctgtgaagcaaaaccaggagccctggctgaagcaagcagtcagtacttgcccactgacagtcaatatctgtcacctagtaagcaaccaagagaccctcccttcatggcttccgatcagatggcaagggtctttgcagatgtgcattccagagccagccgggattccagtgagatgggtgctgttcttgagcagcttgaccaccccaacagggatctgggcagagagtctgtggatgcagaggaagttgtgagagaaattgataagcttttgcaagactgccggggaaacgaccctgtggctgtgagaaagtgaaaaaagaaaaaaaaaaaggcattggcattttcttgtctcttctgttgatttaaaaatgatccctcctggtgataacccattttacagggatgaagaaagaccaatgctgctttaaggcttttagtgaacatctgaagtgcccacaagtatgttctttccactgctgatttctttttcagagataacaatggtttcgttttgaccaaacttgtattaggacagaattaatgatgcttaaagagaaaagaaaaaaagagagaagaaaaaggagagatgaaaaaggaggatgaggagaagaattaccttttgacaatctgttaggaaggtatgcagtgtgagaactgaagtatttctgatcactctcagactgtcctccgtgatttatgctgacttaactgtttacctataaaccccatacaaagcagggtcataatttgtgatctgtggtggatttctagcagtcatcacaggcttctactgaaagtcctgaaaagaccttgcagtagtccaagctacaccaaacattaacacatatttgtggtaaacatttctgtataaagttacctgacacacatataaacacaaggaacattccatatcattagtcgaaaacaaaaacaaaaaaaaaacctttggtcatttgtaagacatctcatgtcatataaaagttaaatgtaaaaagatacagtccattttgtcctgcacacacgtagactaattcacgtcaaaaaaaaaaaaaaa

SEQ ID NO: 61134 - DNA, 1116 bp, Homo sapiens
cagaattgtcaatttattaatgaaatatgacgtgtgttgaacaagacaagctgggtcaagcatttgaagatgcttttgaggttctgaggcaacattcaactggagatcttcagtactcgccagattacagaaattacctggctttaatcaaccatcgtcctcatgtcaaaggaaattccagctgctatggagtgttgcctacagaggagcctgtctataattggagaacggtaattaacagtgctgcggacttctattttgaaggaaatattcatcaatctctgcagaacataactgaaaaccagctggtacaacccactcttctccagcaaaaggggggaaaaggcaggaagaagctccgactgtttgaataccttcacgaatccctgtataatccggagatggcatcttgtattcagtgggtagataaaaccaaaggcatctttcagtttgtatcaaaaaacaaagaaaaacttgccgagctttgggggaaaagaaaaggcaacaggaagaccatgacttaccagaaaatggccagggcactcagaaattacggaagaagtggggaaattaccaaaatccggaggaagctgacttaccagttcagtgaggccattctccaaagactctctccatcctatttcctggggaaagagatcttctattcacagtgtgttcaacctgatcaagaatatctcagtttaaataactggaatgcaaattataattatacatatgccaattaccatgagctaaatcaccatgattgctaaatatactttcatatttcatggtttactggcatcggaaatctctacaagttttaatgatttctccctccctctctttttttcctcctctgaagaaatttaggatttttctcttaaagcaaatactaaagaggaaaaaaaattaactttattgttgcttttatcaaagagtatgtaatctatactaacttgttgggaaattctgccaatgaacaacttttttataataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 61135 - DNA, 2898 bp, Homo sapiens
cctctttcgaaccctgtaggattttacttcttgacgcatctgtttatttaaaccaaaggggtatgttgaggcatgggcaccctggcagcagaccccaaaccaaccctcttgacttgtgcctgccttcaggatatgttccttcctgaattgtctaagaaggctgagttgggggggtggttgctgatttttataacatatagcagttgttcataggcctgtgttttaaagaagggcaagcctgaactaccgtcctgcctaggcctggctccatacctgggagtagacagtcttctactttctaaaaactgacttaaatttgataaatctcctgttgagtgacagtgtttcgcagctgagcccttaaggagattctcagttgggcagagacatcccttcctcagacgccttgtgggctggactcctttggcccagttcaaagtgaggggagggctccaacaggccgggaagacagttgacttcaccctccttgggtttgtctgtctgtccgtctctgggaatggtcgcttcctgttttcccttttccttttaagcctcgccttgttccctcttctctctcttcatgaactactccgagtcttggtctccgtccctctatctctggctcctgcatctgtcctcggcttctggccttcctctccccctcccctcccctccctcgcgctgtcattcaccccgctcctctccgcgcacagccaatggagagacccagtcgaaacgcgaagctctcttgcaccgggctttttcgcctggtgattgatgtcccagagtcaacagcgagcgagcagccggagcggggaagcagaagccagagaggggaagaatacggcgccccctctctccctcccctcccccttctactttagcctttctgcgcacttcgcttccaagtctccgcgcagccaggagccgctgttgcctcccagcccctgctagctgccccccgagccgagcgcagcgagcgccgccgcccgggccccccggtggggccagggccagcatggagcacctgggtccgcaccacctccacccgggtcacgcagagcccattagcttcggcatcgaccagatcctcaacagcccggaccagggtggctgcatgggacccgcctcgcgcctccaggacggagaatacggccttggctgcttggtcggaggcgcctacacttacggcggcgggggctccgcggccgcgacgggggctggaggagcgggggcctatggtactggaggtcccggcggccccggaggcccggcaggcggcggcggcgcctgcagcatgggtcctctgaccggctcctacaacgtgaacatggccttggcaggcggccccggtcctggcggcggcggcggcagcagcggcggtgccggggcactcagcgctgcgggggtaatccgggtgccggcacacaggccgctcgccggagctgtggcccacccccagcccctggccaccggcttgcccaccgtgccctctgtgcctgccatgccgggcgtcaacaacctcactggcctcaccttcccctggatggagagtaaccgcagatacacaaaggacaggttcacaggtcacccctatcagaaccggacgccccccaagaagaagaagccgcgcacgtccttcacacgcctgcagatctgcgagctggagaagcgcttccaccgccagaagtacctggcctcggccgagcgcgccgccctggccaaggcgctcaaaatgaccgatgcgcaggtcaaaacctggttccagaaccggcggacaaagtggagacggcagactgcggaggaacgggaggccgagaggcagcaagcgaaccgcatcctcctgcagttgcagcaggaggccttccagaagagcctggcacagccgctgcccgctgaccctctgtgcgtgcacaactcgtcgctcttcgccctgcagaatctgcagccgtggtctgacgactcgaccaaaatcactagcgtcacgtcggtggcgtcggcctgcgagtgagcctgcccattctgccctgtgggaccccaggcccactcaggggtcactgaggcctgagacccaggactcctccccaccctcctggcctcagactgcacccaggaggggaacactgccctcgcacgccccaaagggcccccacatttgtgccgacactgttctccttcggtggaagagctcaagggacaaggacacgcgcccccctcccagaggcgtcccgcacctgtctgaactgttaagaaatctgtttttgtttatttcattttattttaatttttaacgtgggattcagagaaaggcaagggaggtaagggaggaggagcttctggggtccccagggctgtcatctgaatttgccctgggaaaccccttctctgtgacccacttctcatcacacacacatggaaacccataggtccacacacaggtggtgttactgtccctcctggtgtcaccccagagccacacatgggcatctatgggagagtgtcaaccagacagagggtcacagtgtttacactttggaccttacgatcaggcacaggtcaggggtgacacagactcatcctgaacagcatggcactgggtccagcacaaacacaaggtcatggccacactgtgacacactacaccacacacaacagccaacagctacaacagcctcacttggtctgccaggcccccaccacacatcccagcccaatccaggtacgcacagacaggttttcacataaatgcagcccatttctccagaacccatttgaggggtgggggggtgttaatttatgcacttataaggtgttttctgtgtaaccattttataaagtgcttgtgtaatttatgtgaaaaaaataaataaaagcctcaaaagcctccggaaaaaaaaa

SEQ ID NO: 61136 - DNA, 3180 bp, Homo sapiens
atggagcccactgtggctgacgtacacctcgtgcccaggacaaccaaggaagtccccgctctggatgccgcgtgctgtcgagcggccagcattggcgtggtggccaccagccttgtcgtcctcaccctgggagtccttttggccttcctctctacacagggcttccacgtggaccacacggccgagctgcggggaatccggtggaccagcagtttgcggcgggagacctcggactatcaccgcacgctgacgcccaccctggaggcactgctgcactttctgctgcgacccctccagacgctgagcctgggcctggaggaggagctattgcagcgagggatccgggcaaggctgcgggagcacggcatctccctggctgcctatggcacaattgtgtcggctgagctcacagggagacataagggacccttggcagaaagagacttcaaatcaggccgctgtccagggaactccttttcctgcgggaacagccagtgtgtgaccaaggtgaacccggagtgtgacgaccaggaggactgctccgatgggtccgacgaggcgcactgcgagtgtggcttgcagcctgcctggaggatggccggcaggatcgtgggcggcatggaagcatccccgggggagtttccgtggcaagccagccttcgagagaacaaggagcacttctgtggggccgccatcatcaacgccaggtggctggtgtctgctgctcactgcttcaatgagttccaagacccgacgaagtgggtggcctacgtgggtgcgacctacctcagcggctcggaggccagcaccgtgcgggcccaggtggtccagatcgtcaagcaccccctgtacaacgcggacacggccgactttgacgtggctgtgctggagctgaccagccctctgcctttcggccggcacatccagcccgtgtgcctcccggctgccacacacatcttcccacccagcaagaagtgcctgatctcaggctggggctacctcaaggaggacttcctggtcaagccagaggtgctgcagaaagccactgtggagctgctggaccaggcactgtgtgccagcttgtacggccattcactcactgacaggatggtgtgcgctggctacctggacgggaaggtggactcctgccagggtgactcaggaggacccctggtctgcgaggagccctctggccggttctttctggctggcatcgtgagctggggaatcgggtgtgcggaagcccggcgtccaggggtctatgcccgagtcaccaggctacgtgactggatcctggaggccaccaccaaagccagcatgcctctggcccccaccatggctcctgcccctgccgcccccagcacagcctggcccaccagtcctgagagccctgtggtcagcacccccaccaaatcgatgcaggccctcagtaccgtgcctcttgactgggtcaccgttcctaagctacaagaatgtggggccaggcctgcaatggagaagcccacccgggtcgtgggcgggttcggagctgcctccggggaggtgccctggcaggtcagcctgaaggaagggtcccggcacttctgcggagcaactgtggtgggggaccgctggctgctgtctgccgcccactgcttcaaccacacgaaggtggagcaggttcgggcccacctgggcactgcgtccctcctgggcctgggcgggagcccggtgaagatcgggctgcggcgggtagtgctgcaccccctctacaaccctggcatcctggacttcgacctggctgtcctggagctggccagccccctggccttcaacaaatacatccagcctgtctgcctgcccctggccatccagaagttccctgtgggccggaagtgcatgatctccggatggggaaatacgcaggaaggaaatgccaccaagcccgagctcctgcagaaggcgtccgtgggcatcatagaccagaaaacctgtagtgtgctctacaacttctccctcacagaccgcatgatctgcgcaggcttcctggaaggcaaagtcgactcctgccagggtgactctgggggccccctggcctgcgaggaggcccctggcgtgttttatctggcagggatcgtgagctggggtattggctgcgctcaggttaagaagccgggcgtgtacacgcgcatcaccaggctaaagggctggatcctggagatcatgtcctcccagccccttcccatgtctcccccctcgaccacaaggatgctggccaccaccagccccaggacgacagctggcctcacagtcccgggggccacacccagcagacccacccctggggctgccagcagggtgacgggccaacctgccaactcaaccttatctgccgtgagcaccactgctaggggacagacgccatttccagacgccccggaggccaccacacacacccagctaccagactgtggcctggcgccggccgcgctcaccaggattgtgggcggcagcgcagcgggccgtggggagtggccgtggcaggtgagcctgtggctgcggcgccgggaacaccgttgcggggccgtgctggtggcagagaggtggctgctgtcggcggcgcactgcttcgacgtctacggggaccccaagcagtgggcggccttcctaggcacgccgttcctgagcggcgcggaggggcagctggagcgcgtggcgcgcatctacaagcacccgttctacaatctctacacgctcgactacgacgtggcgctgctggagctggcggggccggtgcgtcgcagccgcctggtgcgtcccatctgcctgcccgagcccgcgccgcgacccccggacggcacgcgctgcgtcatcaccggctggggctcggtgcgcgaaggaggctccatggcgcggcagctgcagaaggcggccgtgcgcctcctcagcgagcagacctgccgccgcttctacccagtgcagatcagcagccgcatgctgtgtgccggcttcccgcagggtggcgtggacagctgctcgggtgacgctgggggacccctggcctgcagggagccctctggacggtgggtgctaactggggtcactagctggggctatggctgtggccggccccacttcccaggtgtctatacccgggtggcagctgtgagaggctggataggacagcacatccaggagtga

SEQ ID NO: 61137 - DNA, 10244 bp, Homo sapiens
gcagccatgagcggcagcagcggcggagccgccgcccccgccgcgtcctccggccccgccgcggcggccagcgcggctggctcgggctgcgggggcggtgccggcgagggggcagaggaggcggccaaggacctggccgacatcgcggccttcttccgatccgggtttcgaaaaaacgatgaaatgaaagctatggatgttttaccaattttgaaggaaaaagttgcatacctttcaggtgggagagataaacgtggaggtcccattttaacgtttccggcccgcagcaatcatgacagaatacgacaggaggatctcaggagactcatttcctatctagcctgtattcccagcgaggaggtctgcaagcgtggcttcacggtgatcgtggacatgcgtgggtccaagtgggactccatcaagccccttctgaagatcctgcaggagtccttcccctgctgcatccatgtggccctgatcatcaagccagacaacttctggcagaaacagaggactaattttggcagttctaaatttgaatttgagacaaatatggtctctttagaaggccttaccaaagtagttgatccttctcagctaactcctgagtttgatggctgcctggaatacaaccacgaagaatggattgaaatcagagttgcttttgaagactacattagcaatgccacccacatgctgtctcggctggaggaacttcaggacatcctagctaagaaggagctgcctcaggatttagagggggctcggaatatgatcgaggaacattctcagctgaagaagaaggtgattaaggcccccatcgaggacctggatttggagggacagaagctgcttcagaggatacagagcagtgaaagctttcccaaaaagaactcaggctcaggcaatgcggacctgcagaacctcttgcccaaggtgtccaccatgctggaccggctgcactcgacacggcagcatctgcaccagatgtggcatgtgaggaagctgaagctggaccagtgcttccagctgaggctgtttgaacaggatgctgagaagatgtttgactggatcacacacaacaaaggcctgtttctaaacagctacacagagattgggaccagccaccctcatgccatggagcttcagacgcagcacaatcactttgccatgaactgtatgaacgtgtatgtaaatataaaccgcatcatgtcggtggccaatcgtctggtggagtctggccactatgcctcgcagcagatcaggcagatcgcgagtcagctggagcaggagtggaaggcgtttgcggcagccctggatgagcggagcaccttgctggacatgtcctccattttccaccagaaggccgaaaagtatatgagcaacgtggattcatggtgtaaagcttgcggtgaggtagaccttccctcagagctgcaggacctagaagatgccattcatcaccaccagggaatatatgaacatatcactcttgcttattctgaggtcagccaagatgggaagtcgctccttgacaagctccagcggcccttgactcccggcagctccgattccctgacagcctctgccaactactccaaggccgtgcaccatgtcctggatgtcatccacgaggtgctgcaccaccagcggcagctggagaacatctggcaacaccgcaaggtccggctgcatcagaggctgcagctgtgtgttttccagcaggacgttcagcaggtgctagactggatcgagaaccacggagaagcatttctgagcaaacatacaggtgtggggaaatctcttcatcgggccagagcattgcagaaacgtcatgaagattttgaagaagtggcacagaacacatacaccaatgcggataaattactggaagcagcagaacagctggctcagactggggaatgtgaccccgaagagatttatcaggctgcccatcagctggaagaccggattcaagatttcgttcggcgtgttgagcagcgaaagatcctactggacatgtcagtgtcctttcacacccatgtgaaagagctgtggacgtggctggaggagctgcagaaggagctgctggacgacgtgtatgccgagtcggtggaggccgtgcaggacctcatcaagcgctttggccagcagcagcagaccaccctgcaggtgactgtcaacgtgatcaaggaaggggaggacctcatccagcagctcagggactctgccatctccagtaacaagaccccccacaacagctccatcaaccacattgagacggtgctgcagcagctggacgaggcgcagtcgcagatggaggagctcttccaggagcgcaagatcaagctggagctcttcctgcagctgcgcatcttcgagagggacgccatcgacattatctcagacctcgagtcttggaatgatgagctttctcagcaaatgaatgacttcgacacagaagatctcacgattgcagagcagcgcctccagcaccatgcagacaaagccttgaccatgaacaacttgacttttgacgtcatccaccaagggcaagatcttctgcagtatgtcaatgaggtccaggcctctggtgtggagctgctgtgtgatagagatgtagacatggcaactcgggtccaggacctgctggagtttcttcatgaaaaacagcaggaattggatttagccgcagagcagcatcggaaacacctggagcagtgcgtgcagctgcgccacctgcaggcagaagtgaaacaggtgctgggttggatccgcaacggagagtccatgttaaatgccggacttatcacagccagctcgttacaagaggcagagcagctccagcgagagcacgagcagttccagcatgccattgagaaaacacatcagagcgcgctgcaggtgcagcagaaggcagaagccatgctacaggccaaccactacgacatggacatgatccgggactgcgccgagaaggtggcgtctcactggcaacagctcatgctcaagatggaagatcgcctcaagctcgtcaacgcctctgtcgctttctacaaaacctcagagcaggtctgcagcgtcctcgagagcctggaacaggagtacaagagagaagaagactggtgtggcggggcggataagctgggcccaaactctgagacggaccacgtgacgcccatgatcagcaagcacctggagcagaaggaggcattcctgaaggcttgcacccttgctcggaggaatgcagacgtcttcctgaaatacctgcacaggaacagcgtgaacatgccaggaatggtgacgcacatcaaagctcctgaacagcaagtgaaaaatatcttgaatgaactcttccaacgggagaacagggtattgcattactggaccatgaggaagagacggctggaccagtgtcagcagtacgtggtctttgagaggagtgccaagcaggctttggaatggatccatgacaatggcgagttctacctttccacacacacctccacgggctccagtatacagcacacccaggagctcctgaaagagcacgaggagttccagataactgcaaagcaaaccaaagagagagtgaagctattgatacagctggctgatggcttttgtgaaaaagggcatgcccatgcggcagagataaaaaaatgtgttactgctgtggataagaggtacagagatttctctctgcggatggagaagtacaggacctctttggaaaaagccctggggatttcttcagattccaacaaatcgagtaaaagtctccagctagatatcattccagccagtatccctggctcagaggtgaaacttcgagatgctgctcatgaacttaatgaagagaagcggaaatctgcccgcaggaaagagttcataatggctgagctcattcaaactgaaaaggcttatgtaagagacctccgggaatgtatggatacgtacctgtgggaaatgaccagtggcgtggaagagattccacctggcattgtaaacaaagaactcatcatcttcggaaacatgcaagaaatctacgaatttcataataacatattcctaaaggagctggaaaaatatgaacagttgccagaggatgttggacattgttttgttacttgggcagacaagtttcagatgtatgtcacatattgcaaaaataagcctgattctactcagctgatattggaacatgcagggtcctattttgacgagatacagcagcgacatggattagccaattccatttcttcctaccttattaaaccagttcagcgaataacgaagtatcagctccttttaaaagagctgctgacgtgctgtgaggaaggaaagggagagattaaagatggcctggaggtgatgctcagcgtgccgaagcgagccaatgatgccatgcacctcagcatgctggaagggtttgatgaaaacattgagtctcagggagaactcatcctacaggaatccttccaagtgtgggacccaaaaaccttaattcgaaagggtcgagaacggcatctcttcctttttgaaatgtccttagtatttagtaaagaagtgaaagattccagtgggagaagcaagtacctttataaaagcaaattgtttacctcagagttgggtgtcacagaacatgttgaaggagacccttgcaaatttgcactgtgggtggggagaacaccaacttcagataataaaattgtccttaaggcttccagcatagagaacaagcaggactggataaagcatatccgcgaagtcatccaggagcggacgatccacctgaagggagccctgaaggagcccattcacatccctaagaccgctcccgccacaagacagaagggaaggagggatggagaggatctggacagccaaggagacggcagcagccagcctgatacgatttccatcgcctcacggacgtctcagaacacgctggacagcgataagctctctggtggctgtgagctgacagtggtgatccatgacttcaccgcttgcaacagcaacgagctgaccatccgacggggccagaccgtggaagttctggagcggccgcatgacaagcctgactggtgtctggtgcggacaactgaccgctccccagcggcagaaggcctggtcccctgtggttcactgtgcatcgcccactccagaagtagcatggaaatggagggcatcttcaaccacaaagactcgctctccgtctccagcaatgacgccagtccacccgcatccgtggcttccctccagccccacatgatcggggcccagagctcgccgggccccaagcggccgggcaacaccctgcgcaagtggctcaccagccccgtgcggcggctcagcagcggcaaggccgacgggcacgtgaagaagctggcgcacaagcacaagaagagccgcgaggtccgcaagagcgccgacgccggctcgcagaaggactccgacgacagtgcggccaccccgcaggacgagacggtcgaggagagaggccggaacgagggcctgagcagcggtactctctccaaatcctcctcctcggggatgcagagctgtggagaagaggaaggcgaggagggggccgacgccgtgcccctgccgccacccatggccatccagcagcacagcctcctccagccagactcacaggatgacaaggcctcttctcggttattagtccgccccaccagctccgaaacaccgagtgcagccgagctcgtcagtgcaattgaggaactcgtgaaaagcaagatggcactggaggatcgccccagctcactccttgttgaccagggagatagtagcagcccttccttcaacccttcggataattcccttctctcttcctcctcgcccattgatgagatggaagaaaggaaatccagctctttaaagagaagacactacgttttgcaagaactagtggagacagagcgtgactatgtgcgggaccttggctatgtggttgagggctacatggcacttatgaaagaagatggtgttcctgatgacatgaaaggaaaagacaaaattgtgttcggcaacatccatcagatttacgactggcacagagacttttttttaggagagttagagaagtgccttgaagatccagaaaaactaggatccctttttgttaaacacgagagaaggttgcacatgtacatagcttattgtcaaaataaaccaaagtctgagcacattgtctcagaatacattgataccttttttgaggacttaaagcagcgtcttggccacaggttacagctcacagatctgttgatcaaaccagtgcagagaatcatgaagtatcagctgttactgaaggacttcctcaagtattccaaaaaggccagcctggatacatcagaattagagagagctgtggaagtcatgtgcatagtacccaggcggtgcaacgacatgatgaacgtggggcggctgcaaggattcgacgggaaaatcgttgcccagggtaaactgctcttgcaggacacattcttggtcacagaccaagatgcaggacttctgcctcgctgcagagagaggcgcatcttcctctttgagcagatcgtcatattcagcgaaccacttgataaaaagaagggcttctccatgccgggattcctgtttaagaacagtatcaaggtgagttgcctttgcctggaggaaaatgtggaaaatgatccctgtaaatttgctctgacatcgaggacgggtgacgtggtagagaccttcattttgcattcatctagtccaagtgtccggcaaacttggatccatgaaatcaaccaaattttagaaaaccagcgcaattttttaaatgccttgacatcgccaatcgagtaccagaggaaccacagcgggggcggcggcggcggcggcagcgggggcagcggcgggggtgggggcagcggcggcggcggggcccccagtggcggcagcggccacagtggcggccccagcagctgcggcggcgcccccagcacgagcaggagccggccctcccggatcccccagcctgtccgacaccacccccccgtgctggtctcctctgcagcctcgagccaggcagaggcagacaagatgtcaggtacgtccacccccgggccctccctgcctccccctggcgcggcccccgaggccggccccagcgcgcccagcaggcggccccccggcgcggacgccgaggggtccgagcgagaagcggagccgatccccaagatgaaggtgctggagagccccaggaaaggcgccgcgaacgcctcggggtcgagcccagacgcccccgccaaggacgcgcgcgctagcctgggcaccctgccgcttgggaagccccgggccggggccgcttcgccgctgaactcgccgctctccagcgcggtcccttctctcggcaaggagcccttcccccccagcagccccctgcagaaggggggctccttctggagctccatccccgcctcccccgccagccgacccggctccttcaccttcccgggggacagcgactccctccagcggcagacaccccgccacgcggcccctggcaaggatactgaccgcatgagcacgtgctcctcggccagcgagcagtccgtgcagtccacccagagcaacgggagtgaaagcagcagcagtagcaacatctccaccatgttggtgacacacgattacacggcagtgaaggaggatgagatcaacgtctaccaaggagaggtcgttcaaattctggccagcaaccagcagaacatgtttctggtgttccgagccgccactgaccagtgccccgcagctgagggctggattccaggctttgtcctgggccacaccagtgcagtcatcgtggagaacccggacgggactctcaagaagtcaacatcttggcacacagcactccgtttaaggaaaaaatctgagaaaaaagataaagacggcaaaagggaaggcaagttagagaacggttatcggaagtcacgggaaggactcagcaacaaggtatctgtgaagcttctcaatcccaactacatttatgacgttcccccagaattcgtcattccattgagtgaggtcacgtgtgagacaggggagaccgttgttcttagatgtcgagtctgtggccgccccaaagcctcaattacctggaagggccctgaacacaacaccttgaacaacgatggtcactacagcatctcctacagtgacctgggagaggccacgctgaagattgtgggcgtgaccacggaagatgacggcatctacacgtgcatcgctgtcaatgacatgggttcagcctcatcgtcggccagcctgagggtcctaggtccagggatggatgggatcatggtgacctggaaagacaactttgactccttctacagtgaagtggctgagcttggcaggggcagattctctgtcgttaagaaatgtgatcagaaaggaaccaagcgagcagtggccactaagtttgtgaacaagaagttgatgaagcgcgaccaggtcacccatgagcttggcatcctgcagagcctccagcaccccctgcttgtcggcctcctcgacacctttgagacccccaccagctacatcctggtcttagaaatggctgaccagggtcgcctcctggactgcgtggtgcgatggggaagcctcactgaagggaagatcagggcgcacctgggggaggttctggaagctgtccggtacctgcacaactgcaggatagcacacctggacctaaagcctgagaatatcctggtggatgagagtttagccaagccaaccatcaaactggctgactttggagatgctgttcagctcaacacgacctactacatccaccagttactggggaaccctgaattcgcagcccctgaaatcatcctcgggaaccctgtctccctgacctcggatacgtggagtgttggagtgctcacatacgtacttcttagtggcgtgtcccccttcctggatgacagtgtggaagagacctgcctgaacatttgccgcttagactttagcttcccagatgactactttaaaggagtgagccagaaggccaaggagttcgtgtgcttcctcctgcaggaggaccccgccaagcgtccctcggctgcgctggccctccaggagcagtggctgcaggccggcaacggcagaagcacgggcgtcctcgacacgtccagactgacttccttcattgagcggcgcaaacaccagaatgatgttcgacctatccgtagcattaaaaactttctgcagagcaggcttctgcctagagtttgacctatccagaagttctttctcattctctttcacctgccaatcagctgttaatctgaattttcaagagaaaacaagcaaacataactgatcagctgccggtatgttcatcgtgtgaaattgcattccaagtgagctgtgctcagcagtgcttggacacagagctgcaagctgcgctggggtggaggaccgtcacttacactctgcccaaggcagaggtcgcattgctgtatcacagtattttattcaggtttctgcaaaaaaataaaaagataacttttttaaacaaacatgaatagaattttgcaaatttaacgttttcaagatttattcaaggaaacaaaatgcctatgttcaaccactggtgttaatgaacaaagatactgtgcgtctctggggaagacgcacctaggtggcggccactcccatggccttgtctaggactcagagaccactcggctctgagcttccaggcgcctcgtctgtgtgcatctcacgcccgacgtggcttctgaaacgtgcattcaacctcaaacttttgcataaaatagaatgaatcgttttgctctgatgaaatgtaggccttacttgtatataagactgttcctgccttcggtctgtcattttcccacctgcctcccctacccaccccccacccaccacctggggcttcctctgggggtccgagggtcttcccatcacatgaagacatcaggttgggtcctgccccactgcccctccccctgttcctgccccaagccgtcaatcagattgtggagcagtacacagtcagatgaaaatactgtaaatgcactcattgggggttttttggttttacttcatatcatgtgcaatgttgtggctttaacattttatgcaactatttatgaagacctctgttgtacctgtaataaatatatagaaaaagcaaaaaaaaaaaaaaaaaa

SEQ ID NO: 61138 - protein, 366 aa, Homo sapiens
MAELQQLQEFEIPTGREALRGNHSALLRVADYCEDNYVQATDKRKALEETMAFTTQALASVAYQVGNLAGHTLRMLDLQGAALRQVEARVSTLGQMVNMHMEKVARREIGTLATVQRLPPGQKVIAPENLPPLTPYCRRPLNFGCLDDIGHGIKDLSTQLSRTGTLSRKSIKAPATPASATLGRPPRIPEPVHLPVVPDGRLSAASSASSLASAGSAEGVGGAPTPKGQAAPPAPPLPSSLDPPPPPAAVEVFQRPPTLEELSPPPPDEELPLPLDLPPPPPLDGDELGLPPPPPGFGPDEPSWVPASYLEKVVTLYPYTSQKDNELSFSEGTVICVTRRYSDGWCEGVSSEGTGFFPGNYVEPSC

SEQ ID NO: 61139 - protein, 587 aa, Homo sapiens
MVTAAMLLQCCPVLARGPTSLLGKVVKTHQFLFGIGRCPILATQGPNCSQIHLKATKAGGDSPSWAKGHCPFMLSELQDGKSKIVQKAAPEVQEDVKAFKTDLPSSLVSVSLRKPFSGPQEQEQISGKVTHLIQNNMPGNYVFSYDQFFRDKIMEKKQDHTYRVFKTVNRWADAYPFAQHFSEASVASKDVSVWCSNDYLGMSRHPQVLQATQETLQRHGAGAGGTRNISGTSKFHVELEQELAELHQKDSALLFSSCFVANDSTLFTLAKILPGCEIYSDAGNHASMIQGIRNSGAAKFVFRHNDPDHLKKLLEKSNPKIPKIVAFETVHSMDGAICPLEELCDVSHQYGALTFVDEVHAVGLYGSRGAGIGERDGIMHKIDIISGTLGKAFGCVGGYIASTRDLVDMVRSYAAGFIFTTSLPPMVLSGALESVRLLKGEEGQALRRAHQRNVKHMRQLLMDRGLPVIPCPSHIIPIRVGNAALNSKLCDLLLSKHGIYVQAINYPTVPRGEELLRLAPSPHHSPQMMEDFVEKLLLAWTAVGLPLQDVSVAACNFCRRPVHFELMSEWERSYFGNMGPQYVTTYA

SEQ ID NO: 61140 - protein, 550 aa, Homo sapiens
MVTAAMLLQCCPVLARGPTSLLGKVVKTHQFLFGIGRCPILATQGPNCSQIHLKATKAGGDSPSWAKGHCPFMLSELQDGKSKIVQKAAPEVQEDVKAFKTGNYVFSYDQFFRDKIMEKKQDHTYRVFKTVNRWADAYPFAQHFSEASVASKDVSVWCSNDYLGMSRHPQVLQATQETLQRHGAGAGGTRNISGTSKFHVELEQELAELHQKDSALLFSSCFVANDSTLFTLAKILPGCEIYSDAGNHASMIQGIRNSGAAKFVFRHNDPDHLKKLLEKSNPKIPKIVAFETVHSMDGAICPLEELCDVSHQYGALTFVDEVHAVGLYGSRGAGIGERDGIMHKIDIISGTLGKAFGCVGGYIASTRDLVDMVRSYAAGFIFTTSLPPMVLSGALESVRLLKGEEGQALRRAHQRNVKHMRQLLMDRGLPVIPCPSHIIPIRVGNAALNSKLCDLLLSKHGIYVQAINYPTVPRGEELLRLAPSPHHSPQMMEDFVEKLLLAWTAVGLPLQDVSVAACNFCRRPVHFELMSEWERSYFGNMGPQYVTTYA

SEQ ID NO: 61141 - protein, 574 aa, Homo sapiens
MRGGEVALGWNKKKRLFCEDFRFKMVTAAMLLQCCPVLARGPTSLLGKVVKTHQFLFGIGRCPILATQGPNCSQIHLKATKAGGDSPSWAKGHCPFMLSELQDGKSKIVQKAAPEVQEDVKAFKTGNYVFSYDQFFRDKIMEKKQDHTYRVFKTVNRWADAYPFAQHFSEASVASKDVSVWCSNDYLGMSRHPQVLQATQETLQRHGAGAGGTRNISGTSKFHVELEQELAELHQKDSALLFSSCFVANDSTLFTLAKILPGCEIYSDAGNHASMIQGIRNSGAAKFVFRHNDPDHLKKLLEKSNPKIPKIVAFETVHSMDGAICPLEELCDVSHQYGALTFVDEVHAVGLYGSRGAGIGERDGIMHKIDIISGTLGKAFGCVGGYIASTRDLVDMVRSYAAGFIFTTSLPPMVLSGALESVRLLKGEEGQALRRAHQRNVKHMRQLLMDRGLPVIPCPSHIIPIRVGNAALNSKLCDLLLSKHGIYVQAINYPTVPRGEELLRLAPSPHHSPQMMEDFVEKLLLAWTAVGLPLQDVSVAACNFCRRPVHFELMSEWERSYFGNMGPQYVTTYA

SEQ ID NO: 61142 - protein, 515 aa, Homo sapiens
MLSELQDGKSKIVQKAAPEVQEDVKAFKTDLPSSLVSVSLRKPFSGPQEQEQISGKVTHLIQNNMPGNYVFSYDQFFRDKIMEKKQDHTYRVFKTVNRWADAYPFAQHFSEASVASKDVSVWCSNDYLGMSRHPQVLQATQETLQRHGAGAGGTRNISGTSKFHVELEQELAELHQKDSALLFSSCFVANDSTLFTLAKILPGCEIYSDAGNHASMIQGIRNSGAAKFVFRHNDPDHLKKLLEKSNPKIPKIVAFETVHSMDGAICPLEELCDVSHQYGALTFVDEVHAVGLYGSRGAGIGERDGIMHKIDIISGTLGKAFGCVGGYIASTRDLVDMVRSYAAGFIFTTSLPPMVLSGALESVRLLKGEEGQALRRAHQRNVKHMRQLLMDRGLPVIPCPSHIIPIRVGNAALNSKLCDLLLSKHGIYVQAINYPTVPRGEELLRLAPSPHHSPQMMEDFVEKLLLAWTAVGLPLQDVSVAACNFCRRPVHFELMSEWERSYFGNMGPQYVTTYA

SEQ ID NO: 61143 - protein, 433 aa, Homo sapiens
MEYEVKKGKKGFVSPIRRLVFPKAGRRAACRSSVSRRPLHSMPLYPPDYLIDPQILLCDYLEKEVKFLGHLTWVTSSLNPSSRDELLQLLDTARQLKELPLKTTAEQDSILSLSARCLLLTWRDNEELILRIPTHEIAAASYLQDDALHLLVLKTGLGVDPVPAGVDASPGGAGRDPGPPGGAPEKRRVGTAERRHTICSLDWRMGWGGGAAEARAGGGGGGSLERQRAGARASGSWERRQTFSGSWERRHGGGGGGGGAGKPGGSWERRQAGSGGGGSWERRHPGPNPLDPQDPSPDAYCNLVILAVANRDAAEESCALICQVFQIIYGDQSIECVDRAGYHYTSTPERPWLCSRIMAPRTPLKHVTAARPHLLSMAPTAAAATTAVWAWSSYRITWSRCGVSWGPSRSSSLRCCCGSTGWGCPSRTIAQAC

SEQ ID NO: 61144 - protein, 349 aa, Homo sapiens
MGPISAPSCRWRIPWQGLLLTASLFTFWNPPTTAQLTIEAVPSNAAEGKEVLLLVHNLPQDPRGYNWYKGETVDANRRIIGYVISNQQITPGPAYSNRETIYPNASLLMRNVTRNDTGSYTLQVIKLNLMSEEVTGQFSVHPETPKPSISSNNSNPVEDKDAVAFTCEPETQNTTYLWWVNGQSLPVSPRLQLSNGNRTLTLLSVTRNDVGPYECEIQNPASANFSDPVTLNVLYGPDAPTISPSDTYYHAGVNLNLSCHAASNPPSQYSWSVNGTFQQYTQKLFIPNITTKNSGSYACHTTNSATGRNRTTVRMITVSDALVQGSSPGLSARATVSIMIGVLARVALI

SEQ ID NO: 61145 - protein, 97 aa, Homo sapiens
MRIIALLAAILLVALQVRAGPLQARGDEAPGQEQRGPEDQDISISFAWDKSSALQVSGSTRGMVCSCRLVFCRRTELRVGNCLIGGVSFTYCCTRVD

SEQ ID NO: 61146 - protein, 167 aa, Homo sapiens
MASAEPLTALSRWYLYAIHGYFCEVMFTAAWEFVVNLNWKFPGVTSVWALFIYGTSILIVERMYLRLRGRCPLLLRCLIYTLWTYLWEFTTGFILRQFNACPWDYSQFDFDFMGLITLEYAVPWFCGALIMEQFIIRNTLRLRFDKDAEPGEPSGALALANGHVKTD

SEQ ID NO: 61147 - protein, 229 aa, Homo sapiens
MGCLALSWGHEAWFAKWEPRDMCSKRHIQGLQSISKGPFLLSAMLLRKAMNHVPQESWENPRAWELVTDPHSERSLHSYTATPPPPAHQDGSAAAKGECLVPKAGPSSMVLLASLSSVSLRDPVATAPSVLPRVAVPTSGCEEPAWHSCVSAGRPCLKQTAIQRGIPGFHGNCSCPVFRPQLGLGSSCCVMGDPLVYRQPQGPGHGASFPCLGPEIWEAHRGRCFPQPH

SEQ ID NO: 61148 - protein, 342 aa, Homo sapiens
MNNAGHGPTRRLRGLGVLAGVALLAALWLLWLLGSAPRGTPAPQPTITILVWHWPFTDQPPELPSDTCTRYGIARCHLSANRSLLASADAVVFHHRELQTRRSHLPLAQRPRGQPWVWASMESPSHTHGLSHLRGIFNWVLSYRRDSDIFVPYGRLEPHWGPSPPLPAKSRVAAWVVSNFQERQLRARLYRQLAPHLRVDVFGRANGRPLCASCLVPTVAQYRFYLSFENSQHRDYITEKFWRNALVAGTVPVVLGPPRATYEAFVPADAFVHVDDFGSARELAAFLTGMNESRYQRFFAWRDRLRVRLFTDWRERFCAICDRYPHLPRSQVYEDLEGWFQA

SEQ ID NO: 61149 - protein, 923 aa, Homo sapiens
MDSIGSSGLRQGEETLSCSEEGLPGPSDSSELVQECLQQFKVTRAQLQQIQASLLGSMEQALRGQASPAPAVRMLPTYVGSTPHGTEQGDFVVLELGATGASLRVLWVTLTGIEGHRVEPRSQEFVIPQEVMLGAGQQLFDFAAHCLSEFLDAQPVNKQGLQLGFSFSFPCHQTGLDRSTLISWTKGFRCSGVEGQDVVQLLRDAIRRQGAYNIDVVAVVNDTVGTMMGCEPGVRPCEVGLVVDTGTNACYMEEARHVAVLDEDRGRVCVSVEWGSLSDDGALGPVLTTFDHTLDHESLNPGAQRFEKMIGGLYLGELVRLVLAHLARCGVLFGGCTSPALLSQGSILLEHVAEMEDPSTGAARVHAILQDLGLSPGASDVELVQHVCAAVCTRAAQLCAAALAAVLSCLQHSREQQTLQVAVATGGRVCERHPRFCSVLQGTVMLLAPECDVSLIPSVDGGGRGVAMVTAVAARLAAHRRLLEETLAPFRLNHDQLAAVQAQMRKAMAKGLRGEASSLRMLPTFVRATPDGSERGDFLALDLGGTNFRVLLVRVTTGVQITSEIYSIPETVAQGSGQQLFDHIVDCIVDFQQKQGLSGQSLPLGFTFSFPCRQLGLDQGILLNWTKGFKASDCEGQDVVSLLREAITRRQAVELNVVAIVNDTVGTMMSCGYEDPRCEIGLIVGTGTNACYMEELRNVAGVPGDSGRMCINMEWGAFGDDGSLAMLSTRFDASVDQASINPGKQRFEKMISGMYLGEIVRHILLHLTSLGVLFRGQQIQRLQTRDIFKTKFLSEIESDSLALRQVRAILEDLGLPLTSDDALMVLEVCQAVSQRAAQLCGAGVAAVVEKIRGNRGLEELAVSVGVDGTLYKLHPRFSSLVAATVRELAPRCVVTFLQSEDGSGKGAALVTAVACRLAQLTRV

SEQ ID NO: 61150 - protein, 1161 aa, Homo sapiens
MTFGTVLLLSVLASYHGFNLDVEEPTIFQEDAGGFGQSVVQFGGSRLVVGAPLEVVAANQTGRLYDCAAATGMCQPIPLHIRPEAVNMSLGLTLAASTNGSRLLACGPTLHRVCGENSYSKGSCLLLGSRWEIIQTVPDATPECPHQEMDIVFLIDGSGSIDQNDFNQMKGFVQAVMGQFEGTDTLFALMQYSNLLKIHFTFTQFRTSPSQQSLVDPIVQLKGLTFTATGILTVVTQLFHHKNGARKSAKKILIVITDGQKYKDPLEYSDVIPQAEKAGIIRYAIGVGHAFQGPTARQELNTISSAPPQDHVFKVDNFAALGSIQKQLQEKIYAVEGTQSRASSSFQHEMSQEGFSTALTMDGLFLGAVGSFSWSGGAFLYPPNMSPTFINMSQENVDMRDSYLGYSTELALWKGVQNLVLGAPRYQHTGKAVIFTQVSRQWRKKAEVTGTQIGSYFGASLCSVDVDSDGSTDLILIGAPHYYEQTRGGQVSVCPLPRGRVQWQCDAVLRGEQGHPWGRFGAALTVLGDVNEDKLIDVAIGAPGEQENRGAVYLFHGASESGISPSHSQRIASSQLSPRLQYFGQALSGGQDLTQDGLMDLAVGARGQVLLLRSLPVLKVGVAMRFSPVEVAKAVYRCWEEKPSALEAGDATVCLTIQKSSLDQLGDIQSSVRFDLALDPGRLTSRAIFNETKNPTLTRRKTLGLGIHCETLKLLLPDCVEDVVSPIILHLNFSLVREPIPSPQNLRPVLAVGSQDLFTASLPFEKNCGQDGLCEGDLGVTLSFSGLQTLTVGSSLELNVIVTVWNAGEDSYGTVVSLYYPAGLSHRRVSGAQKQPHQSALRLACETVPTEDEGLRSSRCSVNHPIFHEGSNGTFIVTFDVSYKATLGDRMLMRASASSENNKASSSKATFQLELPVKYAVYTMISRQEESTKYFNFATSDEKKMKEAEHRYRVNNLSQRDLAISINFWVPVLLNGVAVWDVVMEAPSQSLPCVSERKPPQHSDFLTQISRSPMLDCSIADCLQFRCDVPSFSVQEELDFTLKGNLSFGWVRETLQKKVLVVSVAEITFDTSVYSQLPGQEAFMRAQMEMVLEEDEVYNAIPIIMGSSVGALLLLALITATLYKLGFFKRHYKEMLEDKPEDTATFSGDDFSCVAPNVPLS

SEQ ID NO: 61151 - protein, 746 aa, Homo sapiens
MDSAAKDEMQPALSPGPEWPEQERAEQLARGAALKWASGIFYRPEQLARLGQYRSREVQRTCSLESRLKSVMQSYLEGVQTGVWQLAQAIEVVQGTREALSQARGLLQGMSQALQTLEPLRERVAQHKQLQALSHLLPRLRAVPAAVSHTQTLIDGQQFLEAYVSLRELEQLREDTWAPLGGLELPVFQGLDLLFEALGQAVEAAAGAAGKLAREDPALLVAAVRVAEVETGRTTPLGQVPRDWRQRCLRALQEGLEQAHFGSPLLPAPGALPGWLEALRVALPVELATAEALVAPCCPPQYNVVQLWAHTLHSGLRRSLQNLLAGPELEAADAFALLHWALHVYLGQEMMGSLELGPEADVSQLEPLLTLENIEQLEATFVANIQASVSQWLQNALDGEVAEWGREHGPNTDPSGSYYSPMPAIVLQILEENIRVASLVSESLQQRVHGMALSELGTFLRSFSDALIRFSRDHFRGKSMAPHYVPYLLAALNHKSALGSSVSVLQLDGAPSGALAPVEAALDELQRRIYRLVLEALQAELQPLFADLPSRQWLSSPELLQSVCERTGRFCRDFWRVRNPTVQLLLAEAERAVVLQYLSALMQGRLVCRGADERTQAAERLRHDAAQLQQLFLSLGLEENAHCAPVLLALRELLNLRDPALLGLEVAGLRQQFPDVSEDHVSALLGLRGDLSREQHLAALSSLQAALPPSPRASRRVLFSLVPAPALAPASCLPSGSCARALLLAE

SEQ ID NO: 61152 - protein, 109 aa, Homo sapiens [sequence omitted]

SEQ ID NO: 61153 - protein, 109 aa, Homo sapiens
MSYKPTTPAPSSTPGFSTPGPGTPVPTGSVPSPSGSGPGATAPCRPLFKDFGPPTVGCVQAMKPPGAQGSQSTYTELLLVTGEMGKGIRPTYAGSKSAAERLKRGIIHP

SEQ ID NO: 61154 - protein, 109 aa, Homo sapiens [sequence omitted]

SEQ ID NO: 61155 - protein, 52 aa, Homo sapiens
MKKDQCCFKAFSEHLKCPQDNNKSSIHCMDLSQRYCLMAVFNVIYLENEDSE

SEQ ID NO: 61156 - protein, 52 aa, Homo sapiens; identical to SEQ ID NO: 61155

SEQ ID NO: 61157 - protein, 125 aa, Homo sapiens
MDMRVPAQLLGLLLLWLPGARCAIQLTQSPSSLSASVGDRVTITCRASQGISSALAWYQQKPGKAPKLLIYDASSLESGVPSRFSGSGSGTDFTLTISSLQPEDFATYYCQQFNNYPHIVLQTRT

SEQ ID NO: 61158 - protein, 120 aa, Homo sapiens
MDCTWRILLLVAAATGTHAEVQLVQSGAEVKKPGATVKISCKVSGYTFTDYYMHWVQQAPGKGLEWMGLVDPEDGETIYAEKFQGRVTITADTSTDTAYMELSSLRSEDTAVYYCATDTV

SEQ ID NO: 61159 - protein, 242 aa, Homo sapiens
MPRGFTWLRYLGIFLGVALGNEPLEMWPLTQNEECTVTGFLRDKLQYRSRLQYMKHYFPINYKISVPYEGVFRIANVTRLQRAQVSERELRYLWVLVSLSATESVQDVLLEGHPSWKYLQEVQTLLLNVQQGLTDVEVSPKVESVLSLLNAPGPNLKLVRPKALLDNCFRVMELLYCSCCKQSSVLNWQDCEVPSPQSCSPEPSLQYAATQLYPPPPWSPSSPPHSTGSVRPVRAQGEGLLP

SEQ ID NO: 61160 - protein, 562 aa, Homo sapiens
MRLRLRLLALLLLLLAPPARAPKPSAQDVSLGVDWLTRYGYLPPPHPAQAQLQSPEKLRDAIKVMQRFAGLPETGRMDPGTVATMRKPRCSLPDVLGVAGLVRRRRRYALSGSVWKKRTLTWRVRSFPQSSQLSQETVRVLMSYALMAWGMESGLTFHEVDSPQGQEPDILIDFARAFHQDSYPFDGLGGTLAHAFFPGEHPISGDTHFDDEETWTFGSKDGEGTDLFAVAVHEFGHALGLGHSSAPNSIMRPFYQGPVGDPDKYRLSQDDRDGLQQLYGKAPQTPYDKPTRKPLAPPPQPPASPTHSPSFPIPDRCEGNFDAIANIRGETFFFKGPWFWRLQPSGQLVSPRPARLHRFWEGLPAQVRVVQAAYARHRDGRILLFSGPQFWVFQDRQLEGGARPLTELGLPPGEEVDAVFSWPQNGKTYLVRGRQYWRYDEAAARPDPGYPRDLSLWEGAPPSPDDVTVSNAGDTYFFKGAHYWRFPKNSIKTEPDAPQPMGPNWLDCPAPSSGPRAPRPPKATPVSETCDCQCELNQAAGRWPAPIPLLLLPLLVGGVASR

SEQ ID NO: 61161 - protein, 562 aa, Homo sapiens; identical to SEQ ID NO: 61160

SEQ ID NO: 61162 - protein, 287 aa, Homo sapiens
MSQAWWHTSVSPATQEAKAGGLLQPRRQRLWLKRCRISSSACEDLSAALIANKNLTRMDLSGNGVGFPGMMLLCEGLRHPQCRLQMIQLRKCQLESGACQEMASVLGTNPHLVELDLTGNALEDLGLRLLCQGLRHPVCRLRTLWLKICRLTAAACDELASTLSVNQSLRELDLSLNELGDLGVLLLCEGLRHPTCKLQTLRLDSCGLTAKACENLYFTLGINQTLTDLYLTNNALGDTGVRLLCKRLSHPGCKLRVLWLFGMDLNKMTHSRLAALRVTKPYLDIGC

SEQ ID NO: 61163 - protein, 1061 aa, Homo sapiens
MLRTAGRDGLCRLSTYLEELEAVELKKFKLYLGTATELGEGKIPWGSMEKAGPLEMAQLLITHFGPEEAWRLALSTFERINRKDLWERGQREDLVRDTPPGGPSSLGNQSTCLLEVSLVTPRKDPQETYRDYVRRKFRLMEDRNARLGECVNLSHRYTRLLLVKEHSNPMQVQQQLLDTGRGHARTVGHQASPIKIETLFEPDEERPEPPRTVVMQGAAGIGKSMLAHKVMLDWADGKLFQGRFDYLFYINCREMNQSATECSMQDLIFSCWPEPSAPLQELIRVPERLLFIIDGFDELKPSFHDPQGPWCLCWEEKRPTELLLNSLIRKKLLPELSLLITTRPTALEKLHRLLEHPRHVEILGFSEAERKEYFYKYFHNAEQAGQVFNYVRDNEPLFTMCFVPLVCWVVCTCLQQQLEGGGLLRQTSRTTTAVYMLYLLSLMQPKPGAPRLQPPPNQRGLCSLAADGLWNQKILFEEQDLRKHGLDGEDVSAFLNMNIFQKDINCERYYSFIHLSFQEFFAAMYYILDEGEGGAGPDQDVTRLLTEYAFSERSFLALTSRFLFGLLNEETRSHLEKSLCWKVSPHIKMDLLQWIQSKAQSDGSTLQQGSLEFFSCLYEIQEEEFIQQALSHFQVIVVSNIASKMEHMVSSFCLKRCRSAQVLHLYGATYSADGEDRARCSAGAHTLLVQLPERTVLLDAYSEHLAAALCTNPNLIELSLYRNALGSRGVKLLCQGLRHPNCKLQNLRLKRCRISSSACEDLSAALIANKNLTRMDLSGNGVGFPGMMLLCEGLRHPQCRLQMIQLRKCQLESGACQEMASVLGTNPHLVELDLTGNALEDLGLRLLCQGLRHPVCRLRTLWLKICRLTAAACDELASTLSVNQSLRELDLSLNELGDLGVLLLCEGLRHPTCKLQTLRLGICRLGSAACEGLSVVLQANHNLRELDLSFNDLGDWGLWLLAEGLQHPACRLQKLWLDSCGLTAKACENLYFTLGINQTLTDLYLTNNALGDTGVRLLCKRLSHPGCKLRVLWLFGMDLNKMTHSRLAALRVTKPYLDIGC

SEQ ID NO: 61164 - protein, 270 aa, Homo sapiens
MENQPVRWRALPGLPRPPGLPAAPWLLLGVLLLPGTLRLAGGQSVTHTGLPIMASLANTAISFSCRITYPYTPQFKVFTVSYFHEDLQGQRSPKKPTNCHPGLGTENQSHTLDCQVTLVLPGASATGTYYCSVHWPHSTVRGSGTFILVRDAGYREPPQSPQKLLLFGFTGLLSVLSVVGTALLLWNKKRMRGPGKDPTRKCPDPRSASSPKQHPSESVYTALQRRETEVYACIENEDGSSPTAKQSPLSQERPHRFEDDGELNLVYENL

SEQ ID NO: 61165 - protein, 373 aa, Homo sapiens
MSPCPPQQSRNRVIQLSTSELGEMELTWQEIMSITELQGLNAPSEPSFEPQAPAPYLGPPPPTTYCPCSIHPDSGFPLPPPPYELPASTSHVPDPPYSYGNMAIPVSKPLSLSGLLSEPLQDPLALLDIGLPAGPPKPQEDPESDSGLSLNYSDAESLELEGTEAGRRRSEYVEMYPVEYPYSLMPNSLAHSNYTLPAAETPLALEPSSGPVRAKPTARGEAGSRDERRALAMKIPFPTDKIVNLPVDDFNELLARYPLTESQLALVRDIRRRGKNKVAAQNCRKRKLETIVQLERELERLTNERERLLRARGEADRTLEVMRQQLTELYRDIFQHLRDESGNSYSPEEYALQQAADGTIFLVPRGTKMEATD

SEQ ID NO: 61166 - protein, 293 aa, Homo sapiens
MMLPSPVTSTPFSVKDILNLEQQHQHFHGAHLQADLEHHFHSAPCMLAAAEGTQFSDGGEEDEEDEGEKLSYLNSLAAADGHGDSGLCPQGYVHTVLRDSCSEPKEHEEEPEVVRDRSQKSCQLKKSLETAGDCKAAEESERPKPRSRRKPRVLFSQAQVFELERRFKQQRYLSAPEREHLASSLKLTSTQVKIWFQNRRYKCKRQRQDKSLELGAHAPPPPPRRVAVPVLVRDGKPCVTPSAQAYGAPYSVGASAYSYNSFPAYGYGNSAAGPPRRPLPCSPPAARPEAAPL

SEQ ID NO: 61167 - protein, 889 aa, Homo sapiens
MYLSICCCFLLWAPALTLKNLNYSVPEEQGAGTVIGNIGRDARLQPGLPPAERGGGGRSKSGSYRVLENSAPHLLDVDADSGLLYTKQRIDRESLCRHNAKCQLSLEVFANDKEICMIKVEIQDINDNAPSFSSDQIEMDISENAAPGTRFPLTSAHDPDAGENGLRTYLLTRDDHGLFGLDVKSRGDGTKFPELVIQKALDREQQNHHTLVLTALDGGEPPRSATVQINVKVIDSNDNSPVFEAPSYLVELPENAPLGTVVIDLNATDADEGPNGEVLYSFSSYVPDRVRELFSIDPKTGLIRVKGNLDYEENGMLEIDVQARDLGPNPIPAHCKVTVKLIDRNDNAPSIGFVSVRQGALSEAAPPGTVIALVRVTDRDSGKNGQLQCRVLGGGGTGGGGGLGGPGGSVPFKLEENYDNFYTVVTDRPLDRETQDEYNVTIVARDGGSPPLNSTKSFAIKILDENDNPPRFTKGLYVLQVHENNIPGEYLGSVLAQDPDLGQNGTVSYSILPSHIGDVSIYTYVSVNPTNGAIYALRSFNFEQTKAFEFKVLAKDSGAPAHLESNATVRVTVLDVNDNAPVIVLPTLQNDTAELQVPRNAGLGYLVSTVRALDSDFGESGRLTYEIVDGNDDHLFEIDPSSGEIRTLHPFWEDVTPVVELVVKVTDHGKPTLSAVAKLIIRSVSGSLPEGVPRVNGEQHHWDMSLPLIVTLSTISIILLAAMITIAVKCKRENKEIRTYNCRIAEYSHPQLGGGKGKKKKINKNDIMLVQSEVEERNAMNVMNVVSSPSLATSPMYFDYQTRLPLSSPRSEVMYLKPASNNLTVPQGHAGCHTSFTGQGTNASETPATRMSIIQTDNFPAEPNYMGSRQQFVQSISVAPRLRTQKEPA

SEQ ID NO: 61168 - protein, 248 aa, Homo sapiens
MTCVEQDKLGQAFEDAFEVLRQHSTGDLQYSPDYRNYLALINHRPHVKGNSSCYGVLPTEEPVYNWRTVINSAADFYFEGNIHQSLQNITENQLVQPTLLQQKGGKGRKKLRLFEYLHESLYNPEMASCIQWVDKTKGIFQFVSKNKEKLAELWGKRKGNRKTMTYQKMARALRNYGRSGEITKIRRKLTYQFSEAILQRLSPSYFLGKEIFYSQCVQPDQEYLSLNNWNANYNYTYANYHELNHHDC

SEQ ID NO: 61169 - protein, 330 aa, Homo sapiens
MEHLGPHHLHPGHAEPISFGIDQILNSPDQGGCMGPASRLQDGEYGLGCLVGGAYTYGGGGSAAATGAGGAGAYGTGGPGGPGGPAGGGGACSMGPLTGSYNVNMALAGGPGPGGGGGSSGGAGALSAAGVIRVPAHRPLAGAVAHPQPLATGLPTVPSVPAMPGVNNLTGLTFPWMESNRRYTKDRFTGHPYQNRTPPKKKKPRTSFTRLQICELEKRFHRQKYLASAERAALAKALKMTDAQVKTWFQNRRTKWRRQTAEEREAERQQANRILLQLQQEAFQKSLAQPLPADPLCVHNSSLFALQNLQPWSDDSTKITSVTSVASACE

SEQ ID NO: 61170 - protein, 1059 aa, Homo sapiens
MEPTVADVHLVPRTTKEVPALDAACCRAASIGVVATSLVVLTLGVLLAFLSTQGFHVDHTAELRGIRWTSSLRRETSDYHRTLTPTLEALLHFLLRPLQTLSLGLEEELLQRGIRARLREHGISLAAYGTIVSAELTGRHKGPLAERDFKSGRCPGNSFSCGNSQCVTKVNPECDDQEDCSDGSDEAHCECGLQPAWRMAGRIVGGMEASPGEFPWQASLRENKEHFCGAAIINARWLVSAAHCFNEFQDPTKWVAYVGATYLSGSEASTVRAQVVQIVKHPLYNADTADFDVAVLELTSPLPFGRHIQPVCLPAATHIFPPSKKCLISGWGYLKEDFLVKPEVLQKATVELLDQALCASLYGHSLTDRMVCAGYLDGKVDSCQGDSGGPLVCEEPSGRFFLAGIVSWGIGCAEARRPGVYARVTRLRDWILEATTKASMPLAPTMAPAPAAPSTAWPTSPESPVVSTPTKSMQALSTVPLDWVTVPKLQECGARPAMEKPTRVVGGFGAASGEVPWQVSLKEGSRHFCGATVVGDRWLLSAAHCFNHTKVEQVRAHLGTASLLGLGGSPVKIGLRRVVLHPLYNPGILDFDLAVLELASPLAFNKYIQPVCLPLAIQKFPVGRKCMISGWGNTQEGNATKPELLQKASVGIIDQKTCSVLYNFSLTDRMICAGFLEGKVDSCQGDSGGPLACEEAPGVFYLAGIVSWGIGCAQVKKPGVYTRITRLKGWILEIMSSQPLPMSPPSTTRMLATTSPRTTAGLTVPGATPSRPTPGAASRVTGQPANSTLSAVSTTARGQTPFPDAPEATTHTQLPDCGLAPAALTRIVGGSAAGRGEWPWQVSLWLRRREHRCGAVLVAERWLLSAAHCFDVYGDPKQWAAFLGTPFLSGAEGQLERVARIYKHPFYNLYTLDYDVALLELAGPVRRSRLVRPICLPEPAPRPPDGTRCVITGWGSVREGGSMARQLQKAAVRLLSEQTCRRFYPVQISSRMLCAGFPQGGVDSCSGDAGGPLACREPSGRWVLTGVTSWGYGCGRPHFPGVYTRVAAVRGWIGQHIQE

SEQ ID NO: 61171 - protein, 3097 aa, Homo sapiens
MSGSSGGAAAPAASSGPAAAASAAGSGCGGGAGEGAEEAAKDLADIAAFFRSGFRKNDEMKAMDVLPILKEKVAYLSGGRDKRGGPILTFPARSNHDRIRQEDLRRLISYLACIPSEEVCKRGFTVIVDMRGSKWDSIKPLLKILQESFPCCIHVALIIKPDNFWQKQRTNFGSSKFEFETNMVSLEGLTKVVDPSQLTPEFDGCLEYNHEEWIEIRVAFEDYISNATHMLSRLEELQDILAKKELPQDLEGARNMIEEHSQLKKKVIKAPIEDLDLEGQKLLQRIQSSESFPKKNSGSGNADLQNLLPKVSTMLDRLHSTRQHLHQMWHVRKLKLDQCFQLRLFEQDAEKMFDWITHNKGLFLNSYTEIGTSHPHAMELQTQHNHFAMNCMNVYVNINRIMSVANRLVESGHYASQQIRQIASQLEQEWKAFAAALDERSTLLDMSSIFHQKAEKYMSNVDSWCKACGEVDLPSELQDLEDAIHHHQGIYEHITLAYSEVSQDGKSLLDKLQRPLTPGSSDSLTASANYSKAVHHVLDVIHEVLHHQRQLENIWQHRKVRLHQRLQLCVFQQDVQQVLDWIENHGEAFLSKHTGVGKSLHRARALQKRHEDFEEVAQNTYTNADKLLEAAEQLAQTGECDPEEIYQAAHQLEDRIQDFVRRVEQRKILLDMSVSFHTHVKELWTWLEELQKELLDDVYAESVEAVQDLIKRFGQQQQTTLQVTVNVIKEGEDLIQQLRDSAISSNKTPHNSSINHIETVLQQLDEAQSQMEELFQERKIKLELFLQLRIFERDAIDIISDLESWNDELSQQMNDFDTEDLTIAEQRLQHHADKALTMNNLTFDVIHQGQDLLQYVNEVQASGVELLCDRDVDMATRVQDLLEFLHEKQQELDLAAEQHRKHLEQCVQLRHLQAEVKQVLGWIRNGESMLNAGLITASSLQEAEQLQREHEQFQHAIEKTHQSALQVQQKAEAMLQANHYDMDMIRDCAEKVASHWQQLMLKMEDRLKLVNASVAFYKTSEQVCSVLESLEQEYKREEDWCGGADKLGPNSETDHVTPMISKHLEQKEAFLKACTLARRNADVFLKYLHRNSVNMPGMVTHIKAPEQQVKNILNELFQRENRVLHYWTMRKRRLDQCQQYVVFERSAKQALEWIHDNGEFYLSTHTSTGSSIQHTQELLKEHEEFQITAKQTKERVKLLIQLADGFCEKGHAHAAEIKKCVTAVDKRYRDFSLRMEKYRTSLEKALGISSDSNKSSKSLQLDIIPASIPGSEVKLRDAAHELNEEKRKSARRKEFIMAELIQTEKAYVRDLRECMDTYLWEMTSGVEEIPPGIVNKELIIFGNMQEIYEFHNNIFLKELEKYEQLPEDVGHCFVTWADKFQMYVTYCKNKPDSTQLILEHAGSYFDEIQQRHGLANSISSYLIKPVQRITKYQLLLKELLTCCEEGKGEIKDGLEVMLSVPKRANDAMHLSMLEGFDENIESQGELILQESFQVWDPKTLIRKGRERHLFLFEMSLVFSKEVKDSSGRSKYLYKSKLFTSELGVTEHVEGDPCKFALWVGRTPTSDNKIVLKASSIENKQDWIKHIREVIQERTIHLKGALKEPIHIPKTAPATRQKGRRDGEDLDSQGDGSSQPDTISIASRTSQNTLDSDKLSGGCELTVVIHDFTACNSNELTIRRGQTVEVLERPHDKPDWCLVRTTDRSPAAEGLVPCGSLCIAHSRSSMEMEGIFNHKDSLSVSSNDASPPASVASLQPHMIGAQSSPGPKRPGNTLRKWLTSPVRRLSSGKADGHVKKLAHKHKKSREVRKSADAGSQKDSDDSAATPQDETVEERGRNEGLSSGTLSKSSSSGMQSCGEEEGEEGADAVPLPPPMAIQQHSLLQPDSQDDKASSRLLVRPTSSETPSAAELVSAIEELVKSKMALEDRPSSLLVDQGDSSSPSFNPSDNSLLSSSSPIDEMEERKSSSLKRRHYVLQELVETERDYVRDLGYVVEGYMALMKEDGVPDDMKGKDKIVFGNIHQIYDWHRDFFLGELEKCLEDPEKLGSLFVKHERRLHMYIAYCQNKPKSEHIVSEYIDTFFEDLKQRLGHRLQLTDLLIKPVQRIMKYQLLLKDFLKYSKKASLDTSELERAVEVMCIVPRRCNDMMNVGRLQGFDGKIVAQGKLLLQDTFLVTDQDAGLLPRCRERRIFLFEQIVIFSEPLDKKKGFSMPGFLFKNSIKVSCLCLEENVENDPCKFALTSRTGDVVETFILHSSSPSVRQTWIHEINQILENQRNFLNALTSPIEYQRNHSGGGGGGGSGGSGGGGGSGGGGAPSGGSGHSGGPSSCGGAPSTSRSRPSRIPQPVRHHPPVLVSSAASSQAEADKMSGTSTPGPSLPPPGAAPEAGPSAPSRRPPGADAEGSEREAEPIPKMKVLESPRKGAANASGSSPDAPAKDARASLGTLPLGKPRAGAASPLNSPLSSAVPSLGKEPFPPSSPLQKGGSFWSSIPASPASRPGSFTFPGDSDSLQRQTPRHAAPGKDTDRMSTCSSASEQSVQSTQSNGSESSSSSNISTMLVTHDYTAVKEDEINVYQGEVVQILASNQQNMFLVFRAATDQCPAAEGWIPGFVLGHTSAVIVENPDGTLKKSTSWHTALRLRKKSEKKDKDGKREGKLENGYRKSREGLSNKVSVKLLNPNYIYDVPPEFVIPLSEVTCETGETVVLRCRVCGRPKASITWKGPEHNTLNNDGHYSISYSDLGEATLKIVGVTTEDDGIYTCIAVNDMGSASSSASLRVLGPGMDGIMVTWKDNFDSFYSEVAELGRGRFSVVKKCDQKGTKRAVATKFVNKKLMKRDQVTHELGILQSLQHPLLVGLLDTFETPTSYILVLEMADQGRLLDCVVRWGSLTEGKIRAHLGEVLEAVRYLHNCRIAHLDLKPENILVDESLAKPTIKLADFGDAVQLNTTYYIHQLLGNPEFAAPEIILGNPVSLTSDTWSVGVLTYVLLSGVSPFLDDSVEETCLNICRLDFSFPDDYFKGVSQKAKEFVCFLLQEDPAKRPSAALALQEQWLQAGNGRSTGVLDTSRLTSFIERRKHQNDVRPIRSIKNFLQSRLLPRV

SEQ ID NO: 61172 - DNA, 20 bp, Homo sapiens
gatccccactggccgggagg

SEQ ID NO: 61173 - DNA, 20 bp, Homo sapiens
gatcacacctaccgtgtgtt

SEQ ID NO: 61174 - DNA, 20 bp, Homo sapiens
gatctcctgctctccaagca

SEQ ID NO: 61175 - DNA, 20 bp, Homo sapiens
gatctggagcctctatctgg

SEQ ID NO: 61176 - DNA, 20 bp, Homo sapiens
gatcatctgtaaggagagca

SEQ ID NO: 61177 - DNA, 20 bp, Homo sapiens
gatcagggagggctaaagtt

SEQ ID NO: 61178 - DNA, 20 bp, Homo sapiens
gatccctttgacttgagact

SEQ ID NO: 61179 - DNA, 20 bp, Homo sapiens
gatccttgccatttgcacca

SEQ ID NO: 61180 - DNA, 20 bp, Homo sapiens
gatctctttctgcctctttc

SEQ ID NO: 61181 - DNA, 20 bp, Homo sapiens
gatcttcacattcgacccac

SEQ ID NO: 61182 - DNA, 20 bp, Homo sapiens
gatcctttagtccacccaat

SEQ ID NO: 61183 - DNA, 20 bp, Homo sapiens
gatctgtgaccccagccatg

SEQ ID NO: 61184 - DNA, 20 bp, Homo sapiens
gatcaagaaagatgttaagg

SEQ ID NO: 61185 - DNA, 20 bp, Homo sapiens
gatcggggaccaagaggaca

SEQ ID NO: 61186 - DNA, 20 bp, Homo sapiens
gatctccttaacggatgtct

SEQ ID NO: 61187 - DNA, 20 bp, Homo sapiens
gatcatagaaacgtggtctg

SEQ ID NO: 61188 - DNA, 20 bp, Homo sapiens
gatctaagactaccagtctt

SEQ ID NO: 61189 - DNA, 20 bp, Homo sapiens
gatctgttgaatgaacccta

SEQ ID NO: 61190 - DNA, 20 bp, Homo sapiens
gatctggatttagttgagct

SEQ ID NO: 61191 - DNA, 20 bp, Homo sapiens
gatcccctgaatccaggagt

SEQ ID NO: 61192 - DNA, 20 bp, Homo sapiens
gatccgctggccgggggagg

SEQ ID NO: 61193 - DNA, 20 bp, Homo sapiens
gatcaacaatttcatgatgg

SEQ ID NO: 61194 - DNA, 20 bp, Homo sapiens
gatccttgtcagcagcactg

SEQ ID NO: 61195 - DNA, 20 bp, Homo sapiens
gatcttgcctagaaccggct

SEQ ID NO: 61196 - DNA, 20 bp, Homo sapiens
gatccacgtgcagcttgtca

SEQ ID NO: 61197 - DNA, 20 bp, Homo sapiens
gatccccaaaggactcaaag

SEQ ID NO: 61198 - DNA, 20 bp, Homo sapiens
gatcctgagaacttcaggct

SEQ ID NO: 61199 - DNA, 20 bp, Homo sapiens
gatctgtccactcctgatgc

SEQ ID NO: 61200 - DNA, 20 bp, Homo sapiens
gatcctggactgtttcctga

SEQ ID NO: 61201 - DNA, 20 bp, Homo sapiens
gatctcaatggtacttgtga

SEQ ID NO: 61202 - DNA, 20 bp, Homo sapiens
gatctactccattcccgaga

SEQ ID NO: 61203 - DNA, 20 bp, Homo sapiens
gatcaaattgctataacgtg

SEQ ID NO: 61204 - DNA, 20 bp, Homo sapiens
gatcagcaaggactccctgc

SEQ ID NO: 61205 - DNA, 20 bp, Homo sapiens
gatcatgtgttaattctatg

SEQ ID NO: 61206 - DNA, 20 bp, Homo sapiens
gatctgcactggcctaagca

SEQ ID NO: 61207 - DNA, 20 bp, Homo sapiens
gatctgccctcgcgccaatg

SEQ ID NO: 61208 - DNA, 20 bp, Homo sapiens
gatccggcccacctatgctg

SEQ ID NO: 61209 - DNA, 20 bp, Homo sapiens
gatccagtggggacattgtg

SEQ ID NO: 61210 - DNA, 20 bp, Homo sapiens
gatctatctggaaaatgagg

SEQ ID NO: 61211 - DNA, 20 bp, Homo sapiens
gatctatgatgcctccagtt

SEQ ID NO: 61212 - DNA, 20 bp, Homo sapiens
gatccagtggggatgttgtg

SEQ ID NO: 61213 - DNA, 20 bp, Homo sapiens
gatccagtggggatattgtg

SEQ ID NO: 61214 - DNA, 20 bp, Homo sapiens
gatcctgaagatggtgaaac

SEQ ID NO: 61215 - DNA, 20 bp, Homo sapiens
gatctgagactactcacccc

SEQ ID NO: 61216 - DNA, 20 bp, Homo sapiens
gatcctgggaaggtggaaga

SEQ ID NO: 61217 - DNA, 20 bp, Homo sapiens
gatcagtgtgccttacgagg

SEQ ID NO: 61218 - DNA, 20 bp, Homo sapiens
gatcagcatgaggacagaag

SEQ ID NO: 61219 - DNA, 20 bp, Homo sapiens
gatcattcctcagtgccgga

SEQ ID NO: 61220 - DNA, 20 bp, Homo sapiens
gatccaccatctgcgccttc

SEQ ID NO: 61221 - DNA, 20 bp, Homo sapiens
gatccccggagcgccagcga

SEQ ID NO: 61222 - DNA, 20 bp, Homo sapiens
gatcaaattaatgtttgaca

SEQ ID NO: 61223 - DNA, 20 bp, Homo sapiens
gatctggaggcccaggacat

SEQ ID NO: 61224 - DNA, 20 bp, Homo sapiens
gatcatgtccatcaccgagc

SEQ ID NO: 61225 - DNA, 20 bp, Homo sapiens
gatcccccatactcctatgg

SEQ ID NO: 61226 - DNA, 20 bp, Homo sapiens
gatcaaaagttgggggtggg

SEQ ID NO: 61227 - DNA, 20 bp, Homo sapiens
gatcaacagagaccagcggt

SEQ ID NO: 61228 - DNA, 20 bp, Homo sapiens
gatcaatttccatcggactc

SEQ ID NO: 61229 - DNA, 20 bp, Homo sapiens
gatcaccccagcccccacag

SEQ ID NO: 61230 - DNA, 20 bp, Homo sapiens
gatcagaggtcatcccttcc

SEQ ID NO: 61231 - DNA, 20 bp, Homo sapiens
gatcccctctctgtggctcc

SEQ ID NO: 61232 - DNA, 20 bp, Homo sapiens
gatccttaagggcacttctc

SEQ ID NO: 61233 - DNA, 20 bp, Homo sapiens
gatctacaggcccgtgcccc

SEQ ID NO: 61234 - DNA, 20 bp, Homo sapiens
gatcccaacatggtcctagc

SEQ ID NO: 61235 - DNA, 20 bp, Homo sapiens
gatctgggcagagagtctgt

SEQ ID NO: 61236 - DNA, 20 bp, Homo sapiens
gatctgtggtggatttctag

SEQ ID NO: 61237 - DNA, 20 bp, Homo sapiens
gatccgcaccccattcctcc

SEQ ID NO: 61238 - DNA, 20 bp, Homo sapiens
gatcccatccctccatgtac

SEQ ID NO: 61239 - DNA, 20 bp, Homo sapiens
gatcaagaatatctcagttt

SEQ ID NO: 61240 - DNA, 20 bp, Homo sapiens
gatctttcttccctgttaga

SEQ ID NO: 61241 - DNA, 20 bp, Homo sapiens
gatcaggcacaggtcagggg

SEQ ID NO: 61242 - DNA, 20 bp, Homo sapiens
gatcgtaaggtccaaagtgt

SEQ ID NO: 61243 - DNA, 20 bp, Homo sapiens
gatcagcagccgcatgctgt

SEQ ID NO: 61244 - DNA, 20 bp, Homo sapiens
gatcggaggcttcgcaggtc

SEQ ID NO: 61245 - DNA, 20 bp, Homo sapiens
gatcccatccatccctggac

SEQ ID NO: 61246 - DNA, 3582 bp, Homo sapiens
gttgggtgggagcacaggcaccgggcaccatggggaaggccgagaactatgagctctactcggtggagctgggtcctggccctggcggggacatggctgccaagatgagcaagaagaagaaggcgggtggcgggggtggcaagaggaaggagaagctggagaacatgaagaaggagatggagattaacgaccaccagctgtcagtggcggagctggaacagaaataccagaccagtgccaccaagggcctctctgcgagcctggctgctgagctgctgctgcgggatgggcccaacgcactgcggccaccacggggcaccccagagtacgtcaagttcgcgaggcagctggccgggggcctgcagtgcctcatgtgggttgccgccgccatctgcctcatcgcctttgccatccaggctagtgagggggacctcaccaccgacgacaatctgtacctggcaatcgctctcattgctgtggttgtcgtcaccggctgctttggctactaccaggaattcaagagcaccaacatcatcgccagctttaagaaccttgtgccacagcaagccactgtcatccgcgatggagacaaattccagatcaacgctgaccaactggtggtgggcgacctggtggagatgaaaggtggggacagagtgcccgccgacatccgcatcctggcggcccagggctgcaaggtggacaactcctcgctgacaggggagtctgagccacagacccgctcacccgagtgcacgcacgagagccctctggagacccgcaacatcgccttcttctccaccatgtgccttgagggcaccgtgcagggcctggtggtgaacacgggcgaccgcaccatcattgggcgcatcgcatcgctggcgtcgggggtggaaaacgagaagacacccatcgctatcgagatcgagcattttgtggacatcatcgcgggcctggccattctcttcggtgccacattttttattgtggccatgtgcattggctacaccttcctgcgggccatggtcttcttcatggccatcgtggtggcctatgtgcctgaggggctgctggccactgtcacagtctgcctgtccctgacagccaagcgcctggccagtaagaactgcgtggtcaagaacctggaggcggtggagacattgggctccacttcggtgatctgctcggacaagacagggactctcactcagaaccgcatgactgtgtcccatctgtggtttgacaaccacatccacacagctgacaccacggaagaccagtcagggcagacgtttgaccagtcctcggagacgtggcgggcgctgtgccgggtgctcaccctgtgcaaccgcgccgccttcaagtccggccaggatgcagtgcctgtgcccaagcgcatcgtgattggagacgcatcggagacggcgctgctcaagttctcggagctgacgctgggcaacgccatgggctaccgggaccgcttcccaaaagtctgcgagatacccttcaactccaccaacaagttccagctgtccatccatacgctggaggacccgcgggacccgcgacacttgctggtgatgaagggcgcccccgagcgcgtgctggagcgctgcagctccatccttatcaagggccaggagctgccgctggacgagcagtggcgcgaggccttccagaccgcctacctcagcctgggaggcctgggcgaacgcgtgctcggcttctgccagctctacctgaatgagaaggactacccgcctggctatgccttcgacgtagaggccatgaactttccatctagcggcctctgctttgcgggacttgtatccatgattgacccaccccgggccaccgtccctgatgctgtgctcaagtgtcgcaccgcaggcatccgggtgatcatggtaacgggtgaccaccccatcaccgccaaggccattgcagccagtgtgggcatcatctcggaaggcagcgagacagtggaggacatcgctgcccgcctccgtgtgcccgtagaccaggttaatcgcaaggatgcccgtgcctgtgtgatcaatggcatgcagctgaaggacatggacccatcggaactggtcgaggccctgcgcacccaccccgagatggtgtttgcgcgcaccagcccccagcagaagctggtgatcgtggagagctgccagcggctgggtgcgattgtggccgtcacgggggatggtgtgaatgactccccagctctgaagaaggcagacatcggagtagccatgggcatcgctggctcagatgctgccaaaaatgcagctgacatgatcctgctggatgacaactttgcctccattgtgacaggcgtggagcagggtcgactgatcttcgacaacctgaagaagtctattgcctacacattgaccaagaacatcccagagctgacaccctacctcatctacatcaccgtcagcgtgcccctgcccctcgggtgcatcaccatcctcttcatcgaactctgcactgacattttcccatctgtgtccctggcatatgaaaaggccgagagtgacatcatgcacctgcgtccacgcaacccaaagcgtgacagattggtcaacgagcccctggctgcctactcctacttccagattggtgccattcagtcctttgctggcttcactgactacttcacggcaatggcccaggagggctggttcccactgctgtgcgtggggctgcgggcgcagtgggaggaccaccacctacaagatctgcaggacagctacggccaggagtggacattcgggcagcgcctgtaccagcagtacacctgctacaccgtgttcttcatcagcattgaggtgtgccagatcgccgatgtcctcatccgcaagacgcgccgtctctctgccttccagcaaggcttcttcaggaataagatcctggtgatcgccatcgtgttccaggtctgcatcggctgcttcctgtgctactgccccggcatgcccaacatcttcaacttcatgcccattcggttccagtggtggctggtccccctgccctacggcatcctcatcttcgtctatgatgagatccggaagcttggagttcgctgttgcccagggagctggtgggaccaggaactctactattagagggacgactgccttcaagcatccctgcaactgccacagcaggtgggggcagggctcgtgggaccctctggacagccaccaagatatctgagcaaccaagagtcccagccccaccagtatctgcttctgtagcccacggcaccccaaacttggagggacctgcccactcccctcccccattcccaaggttcgcacctcctggagcagcagcgcctgggcagtcctctgggctggcctcgggaaagccgccacctgtggtggcggtggggctctgacagggagtacagctgaccgcttctggagggtgtttctgttcttaggactccagtccaggctggacggctgcctgagggcccttcgttaaagacacgcttgtgtcctgggcgatggtaataaaaccagctcatgctgactgtgctgtaaaaaaaaaaaaaaaaaaaaaaaa

SEQ ID NO: 61247 - DNA, 1496 bp, Homo sapiens
gagggtgcagggagcagacgggaggatctcaggccagggacgatggcggctctgcaggagaagaagacgtgtggccagcgcatggaggagttccagcgttactgctggaacccggacacggggcagatgctgggccgcaccctgtcccggtgggtgtggatcagcctgtactacgtggccttctacgtggtgatgactgggctcttcgccctgtgcctctatgtgctgatgcagacagtggacccgtacacaccggactaccaagaccagctacggtcaccaggggtaaccttaaggccggatgtttacggggagaaaggcctggaaattgtctacaacgtctctgataacagaacctgggcagacctcacacagactctccacgccttcctagcaggctactctccagcagcccaggaggacagcatcaactgcacctccgagcagtacttcttccaggagagtttccgcgctcccaaccacaccaagttctcctgcaagttcacggcagatatgctgcagaactgctcaggcctggcggatcccaacttcggctttgaagaaggaaagccatgttttattattaaaatgaacaggatcgtcaagttcctccccagcaacggctcggcccccagagtggactgcgccttcctggaccagccccgcgagctcggccagccgctgcaggtcaagtactaccctcccaacggcaccttcagtctgcactacttcccttattacgggaagaaagcccagccccactacagcaaccccctggtggcagcgaagctcctcaacatccccaggaacgctgaggtcgccatcgtgtgcaaggtcatggcggagcacgtgaccttcaacaatccccacgacccgtatgaagggaaagtggagttcaaactcaagattgagaagtgaaacggtttgcgcaggggtcctgggcacgcctgcggggtcgctcaaggacaccctcctggttgggcttaccttgcccgtcagttccctgccaaatcatccccaaagtggtttggagcaacggtgttgtcagtgtgcgaactccagagaagcgcccacatctgaaggacctgctcgcgagtatcagttcttccttgttgaattcttacagtttttagatggaatttgctgctataagaatgtccagctaccatgggaacgcaaggcagcaactctctaattaaccaggtcataaaaacgattcgtcttctatgtagacatcactttcttactataatttatttttctacacttcaatatgaactgccccccccacattaatataaaaactactaatgcactgatatgaaacacggcttacactaatgacattctgaattcttgcttttaaaattgcaattcctaagttgtaaacataaaatatattaaagttactcttattgtatgtaaaaaaagaaatcgtgtttcctgatatgggagaaattaaataaaaaccaaacgcttccttaaaaaaaaaaaaa

SEQ ID NO: 61248 - DNA, 9972 bp, Homo sapiens
atgggggcagaggataacttctacctgcgcaacctgccgccccagcccacgctgctgccggccaaccacaacttccccagcgtggcccgggccgcccctgcccaccccatgggctcctgcagccgggatcgagaccggggtgaggcaggctccctgcagaagggccccaaggacttcgaccgcttcctcgtgggcaaagagctgggcagagagaaggcgggcaaggccgctgagggcaaggagcggccagcggcagaggaggacggtggcaaggagcggcacaagctggtgctgcccgtgccagccgacgggcactgcagggagggcggccccgcaccccgaggggcctgcgagggccgccccaagcacctcacctcctgcctcctcaacaccaaggtgctcaacggcgagatgggcagggctgcgctagccagctgtgcagggggcatgctggggcggcctggcacgggggtggtgacctccgggcgctgtgcaaaggaggcagcaggccccccggagcccgggccggccttcagcgagtgcctggagcggcggcagatgctacaccacaccgcatcctacgccgggccacccccgcccctcagcacagccgccggctccttcccctgcctgcagctgcacgggggccctgacgggctctgcccgctgcaggacaaagccccccgggacctaaaggccagcgggcccaccttcgtgccttctgtgggacacctggccgacaagggccgccccttccaggccgccgaggcctgtgccgtggcaggggagggcaaggaccggcacctggagggaaccatggcccccgaccacgctgcaccctatggagtctcctatgcccacctgaaggccgagggcaagggcgagcggcggcctgggggctttgaggcggccctcaacccccggctaaagggcctcgactatctcagcagcgcaggccccgaggcctccttccccggactccctaaaagcggtctggacaaaagcggctacttcgagttgcccacctcttcacaggactgtgcccggcctggtcaccaggacccgctgggcgggaaggccccccaggcctgctgcactttagataagactgttggcaaggaagccccggccggccccccaggggcacagaaggtggcccgcatcaggcaccagcagcacttgatggccgccgaggtggagcaggggggcattggggctgaggccaagcgcaagtccctggagctggcatccctgggctacagtgggccccacctgcccccatggggtgtccaggcaggccagggcaccgccatggccatcagcgaggagcgcaaggctggcgcctacctggacccctttggcagtggcctgcagcaggcggctcttctgccccaggaactgcctgcgccgccggacgaggtctcagccatgaagaacctgctcaaatacagcagccaggccctggtggtgggccagaaagcacccttggtgggcctgggtggcctcaaggccagctgcatccagcaggaagcaaagttcctgtcctctaagggcccaggccagtcggagaggccggactgtgcccgcagcagggagcacgacaccacgcacggcgacggggaggtgcggcagccccctgtgggcattgcagtggccttggcccggcagaaggacacagtgagccggtctgaggcagcctacggcaccaacactgcgcggcagggccgggccgcccccgccttcaaaggtggcggtgggccccgttccacacacgcgctggacctggaggctgaggaggagaggacgaggctatgtgatgaccgcctggggcttgccagccgcgagctgctgctgcaggacagcaaagaccgcgtagagttcgcccggatccacccaccgagcagctgccctggggacctggccccccacctcatgatgcagagcggccagctgggcggggacccagccccccacacccacccccatcccccctggctgccccgcacccgcagcccctccctgtggatgggggggcactcctacggcctggggcaccctgccctgcaccagaacctgccccccggcttccccgcctccgtggctggccctgtgccctctgtcttccccctcccacaggacgcccccacacagctggtcatcctgccctcagagcccacaccccacagcgccccccacgcacttgcggatgtcatggaccaggcgtcactgtggccccccatgtacgggggccggggccccgcctctcacatgcagcacccgggccagctccctgtgtactcgaggccgcagctcctccggcagcaggagctctatgctttgcagcagcagagggccgcccagttccagcggaagcccgaagaccagcacctggatctggaggagcccgcccaggagaaggccccaaagtccacccacaagccagttgccttaacccccacggccccgggcgccccctcacccgctgcaggccccaccaagctgccaccttgctgccatccgcccgacccaaagccccccgccagctcccccaccccaccacctcggcccagcgccccgtgcactttaaatgtctgccctgccagcagccccgggcctggctcccgggtgcgcagcgccgaggaaaagaatggggagggtcagcagtccacggccgacatcatcacatccgaaccagtggcacgtgctcactctgttgcccacgctggtctcgaattcctggcctcaaatgatccatccacctcagcctcccaaagttttgggattacagacctgcctcccggatacctgcgccccatggctggcctgggcttctccctaccctcagacgtgcactcttctaacctcgaggaccctgaaactatgcaaaccaccgccccgggggcccagcctgagcccacaaggacattcctgcctggggagccgcctccctgcagccccaggagcctggaggagcccgggctgctctcaggggccagggaggccacccaggaccttgccgccaccccctaccctaccgagcggggaccccaggggaaggcagcggaccccagcccactagaggggctacaagaactgcaatgtgcggccctcctggaggcagggggccccgaggccaccggccaggctcattctactcagggaggggcacgagaagagaggagcagggaggagggggagcaggggccctcgtcaggggcctcctcccaagtcctggagcagcgagcagggagtccgggtgcccttgaggacgagggggagcagccggcccctgaggaggacgagctggaggaagacgagctggggcagcagagcatggaggactcagaggaggactgtggcggagctcccgacaacagccacccacccagggcgctaccaggcctggatgccttggtggccgccaccatcaacctgggggacctgcccagcgacagcccaccggaccctcagcccccagcggcctctgggccccccagcacagtccccctgcctcatagctcagggattcatgggatcgctctgctcagcgagctggctgacctggcaatccagcggcagaggagtgagaggactgtgccagaggaggaagaggacgtgctagccttcaacctgcagcacctggccacgctggccacagcctggtccctggtggaggccgctggcctggacagctccactgccccagcgcagccgcccacagccaacccctgcagcggccccaggctcaccccccgcatgcagatcctgcagcgcaaggacacctggacccccaagaccaagcctgtgtgccccctgaaggccgccatcgaccggctggacacgcaggaggtggggatgcgcgtgcggctggcggagctgcagcggcgctacaaggagaagcagcgggagctggcccgcctgcagcgcaagcacgaccatgagagagacgagagttcacggagccctgcacggcgggggcctggccggccgaggaagcgcaaacactcaagctcgctgcctgccccacgtcccacggggccgctccccaggagcgatggcaagaaagtcaaggcggtgcggacaagcctgggtctgctgtgtgcggagctgcgaggaggcagtgggggcgagcctgcgaagaagcgaagcaagctggagaggagcgtctatgcgggcctgcagactgcctccgtggagaaggcgcagtgtaagaagagcagctgtcagggcgggctggcgccctccgtggcccacagggtggcccagctgaaacccaaggtcaagagcaaagggctgcccacaggcctcagctctttccagcagaaggaggctacccccggggggcgcatccgggagaagctgtcccgagccaagagtgccaaggtgtctggggccacacggcacccacagcccaagggccacggcagccgggagacacccaggtgcccagcccagccctccgtggctgcgtcccaggaggcaggcaatggctatgacagtgaggactgcgagggtctcctggggacagaggcaccacccagggaagcagggctgctgctgcacaccggggccagtgtggccgtgctggggccctcaccctcctctgtggtcaagatggaggccaaccagaaggccaagaagaagaaggagaggcaggggttgctaggggcctgccgcctgtccagccctgagagtgaggtcaagatcaagaggcggtcggtgaaggccaaggtgggcaccaccctggagcgggccccagggcagaggcccccaggtgcgctgggcaagaagaaagccaagggcaaggccaagggcagcctgcgggcagagccgggggccacccccagcagggacgccctcttcaacccctctcgggccttcgcctgccgtgaggagggcagccagctggccagtgagcgcctcaagagggccacgcgcaagggcacagtgctgcagccagtgctgcggcggaagaacggggccctgtccatcacgctggccacacgcaacgccaaggccatcctggggaagggccggaagctgagcaaggtgaagcacaaggccggcaagcagggcaagggccgggccgtgagccgcctgctggaaagcttcgccgtggaggaagactttgagttcgacgacaacagcagcttctcggaagaggaggaggacgaggaggaagaggaggaggacagcggccctctgagcgcagagcagagcgccgccctagcgcgctcgtgtgccatccacaaggaggacctgcgggacgggctgcccgtgctcatccccaaggaggatagcctgctgtacgcgggcagcgtcaggaccctgcagccacccgacatctatagcatcgtcatcgagggcgagaggggcaaccggcagaggatctactcactggagcagctgctgcaggaagcggttctcgatgtgcggccacagtccagccggtacctcccgcccggcacgcgggtctgcgcctactggagtcagaagtctcgatgtctgtacccgggcaacgtggtccggggggcctccggtgacgaagatgaggacctggactcagtagtggtggaatttgacgatggggatacaggccacatcgccgtctccaacgtcaggctgctgccccctgacttcaagatccagtgcacagagccctctccagccctgctagtgtctagcagctgccggaggaccaagaaggtatccagtgaggcacccccgcctagtgaagccgccacccccagcctgtcccccaaagcacaggacggccccgaagctttgaagacacctgggaaaaaatccattagcaaagacaaagctggtaaagccgaactcctaacctcaggtgccaaatcccccacgggggcctccgaccacttcctgggccgccgtggcagccccttgctgagctggtccgcggtggcgcagaccaagcggaaggcggtggcagcggccagcaaggggccgggggtgctgcagaacctcttccagctcaacggcagcagcaagaagctgcgggcccgcgaggccctgttccccgtgcacagcgtggccacacccatatttggcaacggcttccgcgccgactccttcagcagcctggccagctcctacgcgcccttcgtcggggggaccgggccgggcctccccaggggagcccacaagctgctgcgggctaagaaggccgagagggtggaggccgagaagggtgggcggcggcgggcgggcggtgagttcctggtcaagctggaccacgagggtgtgacctcccccaagaacaagacctgcaaggcgttgctcatgggggacaaggacttcagccccaagctcgggcggcccctgcccagccccagctatgtgcacccggcccttgtgggcaaggacaagaaggggcgggcacccatccccccgctgcccatggggctggcgctgcgcaagtacgcgggccaggcagagttcccgctgccctacgacagcgactgccacagctccttctcggacgaggacgaggacgggccggggctggcggccggcgtgccctcccgcttcctcgcccgcctgtccgtgtcctcttcctcctctggctcgtccacctcctcctcctcaggctccgtgtccacctccagcctctgctcctccgacaacgaggactcgtcctacagctcagacgacgaggacccggctctgctgctgcagacctgcctcacccaccccgtgcccaccctcctggcccagcccgaggccctgcgctccaagggcagcggccctcacgcgcatgcccagcgctgcttcctgtccagggccacggtggctggcaccggtgcgggctcaggccccagcagcagcagcaaatccaagctcaagcgcaaagaggccctgagcttctccaaagccaaagagctctcccggaggcagcggccgccctccgtggaaaaccggccaaagatctcagccttcctgcccgcccggcagctctggaagtggtcggggaatcccacacagcggcgtggcatgaaggggaaggcccggaagctgttctacaaggccatcgtgcggggcgaggagaccctgcgtgtcggggactgtgccgtcttcctgtcagctgggcggcccaacctcccctacatcggccgcatcgagagcatgtgggagtcgtggggcagcaacatggtggtcaaggtcaagtggttctaccaccctgaggagaccaagctgggcaagaggcagtgcgacggcaagaatgcgctgtaccagtcctgccacgaggatgagaacgacgtgcagaccatctcccacaagtgccaggtcgtggcgcgcgagcagtatgagcagatggcccggagccgcaagtgccaggaccggcaggacctctactacctggcgggcacctacgaccccaccaccgggcgcctggtgacggctgatggcgtgcccatcctatgctgagccgcccaccgcagatgcctcccacgtgcgccagggaccctgtgtgcggagcctggcgtcggccaagccaccgggcaggaggcagccccggcctcccaagggcgcatctgagcaaatatgcaaaagcccacagggcaagacccaggctttcttacggttttccctggaaagagcgctccaggtgtcggaatccagtcccgtcccatcctctgcggagggtcgggctgtggccctcatgggtccccggcccgccccacccacagcgccctccgtttcccgcaccggcagttcacgggagatttgaatccaagccatattccctagtacctccgactgtctcccaccagggaaagcagaaatcaggtgtgttgtctatttatttctctatgtaaatattgtatttctgcggggaaattttatggtaaaaagtggaaaagggtttttccccatccgcgtgacaaggtgtgtgtgagcgtgtatgtgtgtgcgcgtgtgtggcgatttttgtcctggggtttcctttggaaatgcactgttctcagcccagctgggttccaacgggggcacctgggacgacagaggcatctcggggcagggggcagaggccacgggagggtcaggtgggacccttgacggcaccctctgatctcttggggggacgaccgtgtaagatgaaagtcggtcaagtttatttgctttcagtgcatctcctagaaaagaagtgttggagcagggggtggtgatgaggggcccgtggggaaaggattcaagaggcaaagcccagaccagggagtgtgacaacagccgtgagcatctcacctgtgttcaaaacaagacaaagacgaacaaatattttaaagtattgataagaaaaagcaatgtttggattgtatctgctgaatcatattccaacctatatctgatttctgtttccggggccagttggtctgaggccaaggagtctggcctccacccagagcagggaggggctggcccctcgcccccctcaccctcgccgccctggcacactcgggaagcagggcccagctctgagcccctcctcacccctggggtcctaactttcctgaaagtagtaggtgccgtgagaaggggcagtttggccaggttcctgaactgggcagggctcggggcctatgagggcaggttcacagtcccaccagattctctcctcacccccaagcagaatgcatgcaaaagacaccccttttcccacccaccttattggtgcccccaaacccctggcctgctgcgtagatggtggtgaggccaggccagcagtgctgtggccaggggagaagaaaataaaacgcaggccctgcccttggggaaggcccctttctgggcccccttttccaccagccaaatctgcctggccctcggacccctctgcctgccccaacccctttggaggtttctcggccttttctgtgccacttggtggggcagatggcctgatgggctagtgcttggggcatagaatgagggtccccctgaccacctgagcccaaatcctggccccaggtgcaagcagcacccctcgagggctctgccccagtatccccagggaattcacacccctccccttctcccacagccaaggacagacaggctgcctggacctgagcccaacagccttcagcctcagaaacgcatggggggccacacactccttatatcctcccacactaaggttcccctggccccacgggagcttcaggaaagccccccaagttagccactgctctaggacgagctctgtgtcccccacaccacaggcctcgaagcagggtgctggtgggtgccctgtaccccaatcccaggtccccttggccccctatttttctcgggcccattggggcctgtttctcacctgctggctggaccccctgaagggccgttcccagaggctccccaggaggctcaaggctgggggcttatgttgtggtcgggggtccccgcctccagccccccgctcccacccccgagcctaccctttgtctcgcatgagtgcaatatttcattcccggtggttgtctggggaggtggttggacgaggtcctgcttgaggctcggggatcagaacgatgtcaagtgaagaaaaatgcacgggggcatgctgagccactggagttccagagagggccgaggagggtgcagccacggaggttggatcctctgctccgccgcctcgtcctcgtcccgcttctgctgggttccgctttgtccctggttttttcctttctttttctgtgtgcgtgcgaatggtgcggcccctcccctctcaccgtggttaacgtgacgaaggcacgattcctgtaaatgtgtaaactaaggggatggttggattttttttcaatgtaaacactaaaaacaaaatggacaaaaaaacacacaaaggttttatgaacagcagactctatgtaaaggcattttagtatcaaattttttattgataacttgcttaagaataaatatatggactattgtacagaaaaaaaa

SEQ ID NO: 61249 - DNA, 9873 bp, Homo sapiens
atgggggcagaagataacttctacctgcgcaacctgccgccccagcccacgctgctgccggccaaccacaacttccccagcgtggcccgggccgcccctgcccaccccatgggctcctgcagccgggatcgagaccggggtgaggcaggctccctgcagaagggccccaaggacttcgaccgcttcctcgtgggcaaagagctgggcagagagaaggcgggcaaggccgctgagggcaaggagcggccagcggcagaggaggacggtggcaaggagcggcacaagctggtgctgcccgtgctcaacggcgagatgggcagggctgcgctagccagctgtgcagggggcatgctggggcggcctggcgcgggggtggtgacctccgggcgctgtgcaaaggaggcagcaggccccccggagcccgggccggccttcagcgagtgcctggagcggcggcagatgctacaccacaccgcatcctacgccgggccacccccgcccctcagcacagccgccggctccttcccctgcctgcagctgcacgggggccctgacgggctctgcccgctgcaggacaaagccccccgggacctaaaggccagcgggcccaccttcgtgccttctgtgggacacctggccgacaagggccgccccttccaggccgccgaggcctgtgccgtggcaggggagggcaaggaccggcacctggagggaaccatggcccccgaccacgctgcaccctatggagtctcctatgcccacctgaaggccgagggcaagggcgagcggcggcctgggggctttgaggcggccctcaacccccggctaaagggcctcgactatctcagcagcgcaggccccgaggcctccttccccggactccctaaaagcggtctggacaaaagcggctacttcgagttgcccacctcttcacaggactgtgcccggcctggtcaccaggacccgctgggcgggaaggccccccaggcctgctgcactttagataagactgttggcaaggaagccccggccggccccccaggggcacagaaggtggcccgcatcaggcaccagcagcacttgatggccgccgaggtggagcaggggggcattggggctgaggccaagcgcaagtccctggagctggcatccctgggctacagtgggccccacctgcccccatggggtgtccaggcaggccagggcaccgccatggccatcagcgaggagcgcaaggctggcgcctacctggacccctttggcagtggcctgcagcaggcggctcttctgccccaggaactgcctgcgccgccggacgaggtctcagccatgaagaacctgctcaaatacagcagccaggccctggtggtgggccagaaagcacccttggtgggcctgggtggcctcaaggccagctgcatccagcaggaagcaaagttcctgtcctctaagggcccaggccagtcggagaggccggactgtgcccgcagcagggagcacgacaccacgcacggcgacggggaggtgcggcagccccctgtgggcattgcagtggccttggcccggcagaaggacacagtgagccggtctgaggcagcctacggcaccaacactgcgcggcagggccgggccgcccccgccttcaaaggtggcggtgggccccgttccacacacgcgctggacctggaggctgaggaggagaggacgaggctatgtgatgaccgcctggggcttgccagccgcgagctgctgctgcaggacagcaaagaccgcgtagagtgcgcccggatccacccaccgagcagctgccctggggacctggccccccacctcatgatgcagcagcggccagctgggcggggacccagccccccacacccacccccatcccccctggctgccccgcacccgcagcccctccctgtggatgggggggcactcctacggcctggggcaccctgccctgcaccagaacctgccccccggcttccccgcctccgtggctggccctgtgccctctgtcttccccctcccacaggacgcccccacacagctggtcatcctgccctcagagcccacaccccacagcgccccccacgcacttgcggatgtcatggaccaggcgtcactgtggccccccatgtacgggggccggggccccgcctctcacatgcagcacccgggccagctccctgtgtactcgaggccgcagctcctccggcagcaggagctctatgctttgcagcagcagagggccgcccagttccagcggaagcccgaagaccagcacctggatctggaggagcccgcccaggagaaggccccaaagtccacccacaagccagttgccttaacccccacggccccgggcgccccctcacccgctgcaggccccaccaagctgccaccttgctgccatccgcccgacccaaagccccccgccagctcccccaccccaccacctcggcccagcgccccgtgcactttaaatgtctgccctgccagcagccccgggcctggctcccgggtgcgcagcgccgaggaaaagaatggggagggtcagcagtccacggccgacatcatcacatccgaaccagtggcacgtgctcactctgttgcccacgctggtctcgaattcctggcctcaaatgatccatccacctcagcctcccaaagttttgggattacagacctgcctcccggatacctgcgccccatggctggcctgggcttctccctaccctcagacgtgcactcttctaacctcgaggaccctgaaactatgcaaaccaccgccccgggggcccagcctgagcccacaaggacattcctgcctggggagccgcctccctgcagccccaggagcctggaggagcccgggctgctctcaggggccagggaggccacccaggaccttgccgccaccccctaccctgccgagcggggaccccaggggaaggcagcggaccccagcccactagaggggctacaagaactgcaatgtgcggccctcctggaggcagggggccccgaggccaccggccaggctcattctactcagggaggggcacgagaagagaggagcagggaggagggggagcaggggccctcgtcaggggcctcctcccaagtcctggagcagcgagcagggagtccgggtgcccttgaggacgagggggagcagccggcccctgaggaggacgagctggaggaagacgagctggggcagcagagcatggaggactcagaggaggactgtggcggagctcccgacaacagccacccacccagggcgctaccaggcctggatgccttggtggccgccaccatcaacctgggggacctgcccagcgacagcccaccggaccctcagcccccagcggcctctgggccccccagcacagtccccctgcctcatagctcagggattcatgggatcgctctgctcagcgagctggctgacctggcaatccagcggcagaggagtgagaggactgtgccagaggaggaagaggacgtgctagccttcaacctgcagcacctggccacgctggccacagcctggtccctggtggaggccgctggcctggacagctccactgccccagcgcagccgcccacagccaacccctgcagcggccccaggctcaccccccgcatgcagatcctgcagcgcaaggacacctggacccccaagaccaagcctgtgtgccccctgaaggccgccatcgaccggctggacacgcaggaggtggggatgcgcgtgcggctggcggagctgcagcggcgctacaaggagaagcagcgggagctggcccgcctgcagcgcaagcacgaccatgagagagacgagagttcacggagccctgcacggcgggggcctggccggccgaggaagcgcaaacactcaagctcgctgcctgccccacgtcccacggggccgctccccaggagcgatggcaagaaagtcaaggcggtgcggacaagcctgggtctgctgtgtgcggagctgcgaggaggcagtgggggcgagcctgcgaagaagcgaagcaagctggagaggagcgtctatgcgggcctgcagactgcctccgtggagaaggcgcagtgtaagaagagcagctgtcagggcgggctggcgccctccgtggcccacagggtggcccagctgaaacccaaggtcaagagcaaagggctgcccacaggcctcagctctttccagcagaaggaggctacccccggggggcgcatccgggagaagctgtcccgagccaagagtgccaaggtgtctggggccacacggcacccacagcccaagggccacggcagccgggagacacccaggtgcccagcccagccctccgtggctgcgtcccaggaggcaggcaatggctatgacagtgaggactgcgagggtctcctggggacagaggcaccacccagggaagcagggctgctgctgcacgccggggccagtgtggccgtgttggggccctcaccctcctctgtggtcaagatggaggccaaccagaaggccaagaagaagaaggagaggcaggggttgctaggggcctgccgcctgtccagccctgagagtgaggtcaagatcaagaggcggtcggtgaaggccaaggtgggcaccaccctggagcgggccccagggcagaggcccccaggtgcgctgggcaagaagaaagccaagggcaaggccaagggcagcctgcgggcagagccgggggccacccccagcagggacgccctcttcaacccctctcgggccttcgcctgccgtgaggagggcagccagctggccagtgagcgcctcaagagggccacgcgcaagggcacagtgctgcagccagtgctgcggcggaagaacggggccctgtccatcacgctggccacacgcaacgccaaggccatcctggggaagggccggaagctgagcaaggtgaagcacaaggccggcaagcagggcaagggccgggccgtgagccgcctgctggaaagcttcgccgtggaggaagactttgagttcgacgacaacagcagcttctcggaagaggaggaggacgaggaggaagaggaggaggacagcggccctctgagcgcagagcagagcgccgccctagcgcgctcgtgtgccatccacaaggaggacctgcgggacgggctgcccgtgctcatccccaaggaggatagcctgctgtacgcgggcagcgtcaggaccctgcagccacccgacatctatagcatcgtcatcgagggcgagaggggcaaccggcagaggatctactcactggagcagctgctgcaggaagcggttctcgatgtgcggccacagtccagccggtacctcccgcccggcacgcgggtctgcgcctactggagtcagaagtctcgatgtctgtacccgggcaacgtggtccggggggcctccggtgacgaagatgaggacctggactcagtagtggtggaatttgacgatggggatacaggccacatcgccgtctccaacgtcaggctgctgccccctgacttcaagatccagtgcacagagccctctccagccctgctagtgtctagcagctgccggaggaccaagaaggtatccagtgaggcacccccgcctagtgaagccgccacccccagcctgtcccccaaagcacaggacggccccgaagctttgaagacacctgggaaaaaatccattagcaaagacaaagctggtaaagccgaactcctaacctcaggtgccaaatcccccacgggggcctccgaccacttcctgggccgccgtggcagccccttgctgagctggtccgcggtggcgcagaccaagcggaaggcggtggcagcggccagcaaggggccgggggtgctgcagaacctcttccagctcaacggcagcagcaagaagctgcgggcccgcgaggccctgttccccgtgcacagcgtggccacacccatatttggcaacggcttccgcgccgactccttcagcagcctggccagctcctacgcgcccttcgtcggggggaccgggccgggcctccccaggggagcccacaagctgctgcgggctaagaaggccgagagggtggaggccgagaagggtgggcggcggcgggcgggcggtgagttcctggtcaagctggaccacgagggtgtgacctcccccaagaacaagacctgcaaggcgttgctcatgggggacaaggacttcagccccaagctcgggcggcccctgcccagccccagctatgtgcacccggcccttgtgggcaaggacaagaaggggcgggcacccatccccccgctgcccatggggctggcgctgcgcaagtacgcgggccaggcagagttcccgctgccctacgacagcgactgccacagctccttctcggacgaggacgaggacgggccggggctggcggccggcgtgccctcccgcttcctcgcccgcctgtccgtgtcctcttcctcctctggctcgtccacctcctcctcctcaggctccgtgtccacctccagcctctgctcctccgacaacgaggactcgtcctacagctcagacgacgaggacccggctctgctgctgcagacctgcctcacccaccccgtgcccaccctcctggcccagcccgaggccctgcgctccaagggcagcggccctcacgcgcatgcccagcgctgcttcctgtccagggccacggtggctggcaccggtgcgggctcaggccccagcagcagcagcaaatccaagctcaagcgcaaagaggccctgagcttctccaaagccaaagagctctcccggaggcagcggccgccctccgtggaaaaccggccaaagatctcagccttcctgcccgcccggcagctctggaagtggtcggggaatcccacacagcggcgtggcatgaaggggaaggcccggaagctgttctacaaggccatcgtgcggggcgaggagaccctgcgtgtcggggactgtgccgtcttcctgtcagctgggcggcccaacctcccctacatcggccgcatcgagagcatgtgggagtcgtggggcagcaacatggtggtcaaggtcaagtggttctaccaccctgaggagaccaagctgggcaagaggcagtgcgacggcaagaatgcgctgtaccagtcctgccacgaggatgagaacgacgtgcagaccatctcccacaagtgccaggtcgtggcgcgcgagcagtatgagcagatggcccggagccgcaagtgccaggaccggcaggacctctactacctggcgggcacctacgaccccaccaccgggcgcctggtgacggctgatggcgtgcccatcctatgctgagccgcccaccgcagatgcctcccacgtgcgccagggaccctgtgtgcggagcctggcgtcggccaagccaccgggcaggaggcagccccggcctcccaagggcgcatctgagcaaatatgcaaaagcccacagggcaagacccaggctttcttacggttttccctggaaagagcgctccaggtgtcggaatccagtcccgtcccatcctctgcggagggtcgggctgtggccctcatgggtccccggcccgccccacccacagcgccctccgtttcccgcaccggcagttcacgggagatttgaatccaagccatattccctagtacctccgactgtctcccaccagggaaagcagaaatcaggtgtgttgtctatttatttctctatgtaaatattgtatttctgcggggaaattttatggtaaaaagtggaaaagggtttttccccatccgcgtgacaaggtgtgtgtgagcgtgtatgtgtgtgcgcgtgtgtggcgatttttgtcctggggtttcctttggaaatgcactgttctcagcccagctgggttccaacgggggcacctgggacgacagaggcatctcggggcagggggcagaggccacgggagggtcaggtgggacccttgacggcaccctctgatctcttggggggacgaccgtgtaagatgaaagtcggtcaagtttatttgctttcagtgcatctcctagaaaagaagtgttggagcagggggtggtgatgaggggcccgtggggaaaggattcaagaggcaaagcccagaccagggagtgtgacaacagccgtgagcatctcacctgtgttcaaaacaagacaaagacgaacaaatattttaaagtattgataagaaaaagcaatgtttggattgtatctgctgaatcatattccaacctatatctgatttctgtttccggggccagttggtctgaggccaaggagtctggcctccacccagagcagggaggggctggcccctcacccccctcaccctcgccgccctggcacactcgggaagcagggcccagctctgagcccctcctcacccctggggtcctaactttcctgaaagtagtaggtgccgtgagaaggggcagtttggccaggttcctgaactgggcagggctcggggcctatgagggcaggttcacagtcccaccagattctctcctcacccccaagcagaatgcatgcaaaagacaccccttttcccacccaccttattggtgcccccaaacccctggcctgctgcgtagatggtggtgaggccaggccagcagtgctgtggccaggggagaagaaaataaaacgcaggccctgcccttggggaaggccccttcctgggcccccttttccaccagccaaatctgcctggccctcggacccctctgcctgccccaacccctttggaggtttctcggccttttctgtgccacttggtggggcagatggcctgatgggctagtgcttggggcatagaatgagggtccccctgaccacctgagcccaaatcctggccccaggtgcaagcagcacccctcgagggctctgccccagtatccccagagaattcacacccctccccttctcccacagccaaggacagacaggctgcctggacctgagcccaacagccttcagcctcagaaacgcatggggggccacacactccttatatcctcccacactaaggttcccctggccccacgggagcttcaggaaagccccccaagttagccactgctctaggacgagctctgtgtcccccacaccacaggcctcgaagcagggtgctggtgggtgccctgcaccccaatcccaggtccccttggccccctatttttctcgggcccattggggcctgtttctcacctgctggctggaccccctgaagggccgttcccagaggctccccaggaggctcaaggctgggggcttatgttgtggtcgggggtccccgcctccagccccccgctcccacccccgagcctaccctttgtctcgcatgagtgcaatatttcattcccggtggttgtctggggaggtggttggacgaggtcctgcttgaggctcggggatcagaacgatgtcaagtgaagaaaaatgcacgggggcatgctgagccactggagttccagagagggccgaggagggtgcagccacggaggttggatcctctgctccgccgcctcgtcctcgtcccgcttctgctgggttccgctttgtccctggttttttcctttttttttctgtgtgcgtgcgaatggtgcggcccctcccctctcaccgtggttaacgtgacgaaggcacgattcctgtaaatgtgtaaactaaggggatggttggattttttttcaatgtaaacactaaaaacaaaatggacaaaaaaacacacaaaggttttatgaacagcagactctatgtaaaggcattttagtatcaaattttttattgataacttgcttaagaataaatatatggactattgtacagaaaaaaa

SEQ ID NO: 61250 - DNA, 1475 bp, Homo sapiens
gcggccgcccgcccggcccctgcgcctccgcccggccggccgcggggagggggcatgagccggcgcccgccggcccccgagctgcgggccggcctagagccccgcgcggcgccccgcggagccaagccgtcgccgccgccgccgccaaaccgcgggcgcacgagtgggccgcggatgcagcggccgggggagccggcggccgcgcgcttcggcgcccccgagggctgccggaccaccggccgcagcctatcgcagcttcatgattgaggagatcctcacggagccacccgggcccaagggcgccgcgcccgcagccgccgctgccgcggcgggcgagctgctgaagttcggcgtgcaggcgctgctggcggcgcggcccttccacagccacctggccgtgctgaaggccgagcaggcggcggtgttcaagttcccactggcgccgctgggctgttcagggctgagctctgcgttgctggcggcagggcccgggctgcccggcgccgcgggtgcgccacacctgccgctcgagttgcagctccgcgggaagctggaggcggcaggccctggggagccaggcaccaaagccaagaaggggcgtcggagccgcactgtgttcaccgagctgcagctgatgggcctggagaaacgcttcgagaagcagaagtacctttccacgccggacagaatagatcttgctgagtccctgggcctgagccagttgcaggtgaagacgtggtaccagaatcggaggatgaagtggaagaaaatagtgctgcagggcggcggcctggagtctcccaccaagcccaaggggcggcccaagaagaactcaattccaacgagcgagcagcttactgagcaggagcgcgccaaggatgcagagaaaccggcggaggtgccgggcgagcccagcgacaggagccgcgaggactgagggcggtatacggtgcggggcctgggatgcccgcgccacccgcagccccctcactcggcggaaacccgcgagccggcccttccgcgtccaagaagtttacttcctaagcctttttattatgatcttgaatgcggacaattggggccaaacgaggaaggacacagacccaaaagccagacccaggtcccagcgcgcttctgggctctaacctgggagactcgcatccagcccggcggaagctacagtctctaccctgagctccggtgcgcagagcgctccacgcgtattcacgccccgctcctcgcctgcacccccaccccgtctggggcctgccctcccggccggggagcctccaggcacacacccgcttctggacgtcggggacccagcggttgggctcaggccacaacggcctgagattgccccggggcaacccgtcggctatgcctggaggccgggtccccgatgtcgctggggcccctaccccctgttgcgaagacggtgactttttttccaataaaatattttatgacacaaa

SEQ ID NO: 61251 - DNA, 1552 bp, Homo sapiens
gcccgtacacaccgtgtgctgggacaccccacagtcagccgcatggctcccctgtgccccagcccctggctccctctgttgatcccggcccctgctccaggcctcactgtgcaactgctgctgtcactgctgcttctgatgcctgtccatccccagaggttgccccggatgcaggaggattcccccttgggaggaggctcttctggggaagatgacccactgggcgaggaggatctgcccagtgaagaggattcacccagagaggaggatccacccggagaggaggatctacctggagaggaggatctacctggagaggaggatctacctgaagttaagcctaaatcagaagaagagggctccctgaagttagaggatctacctactgttgaggctcctggagatcctcaagaaccccagaataatgcccacagggacaaagaaggggatgaccagagtcattggcgctatggaggcgacccgccctggccccgggtgtccccagcctgcgcgggccgcttccagtccccggtggatatccgcccccagctcgccgccttctgcccggccctgcgccccctggaactcctgggcttccagctcccgccgctcccagaactgcgcctgcgcaacaatggccacagtgtgcaactgaccctgcctcctgggctagagatggctctgggtcccgggcgggagtaccgggctctgcagctgcatctgcactggggggctgcaggtcgtccgggctcggagcacactgtggaaggccaccgtttccctgccgagatccacgtggttcacctcagcaccgcctttgccagagttgacgaggccttggggcgcccgggaggcctggccgtgttggccgcctttctggaggagggcccggaagaaaacagtgcctatgagcagttgctgtctcgcttggaagaaatcgctgaggaaggctcagagactcaggtcccaggactggacatatctgcactcctgccctctgacttcagccgctacttccaatatgaggggtctctgactacaccgccctgtgcccagggtgtcatctggactgtgtttaaccagacagtgatgctgagtgctaagcagctccacaccctctctgacaccctgtggggacctggtgactctcggctacagctgaacttccgagcgacgcagcctttgaatgggcgagtgattgaggcctccttccctgctggagtggacagcagtcctcgggctgctgagccagtccagctgaattcctgcctggctgctggtgacatcctagccctggtttttggcctcctttttgctgtcaccagcgtcgcgttccttgtgcagatgagaaggcagcacagaaggggaaccaaagggggtgtgagctaccgcccagcagaggtagccgagactggagcctagaggctggatcttggagaatgtgagaagccagccagaggcatctgagggggagccggtaactgtcctgtcctgctcattatgccacttccttttaactgccaagaaattttttaaaataaatatttataat

SEQ ID NO: 61252 - DNA, 2120 bp, Homo sapiens
cgggaacccaggcggggcgagccgcgggagagtggagggcaggcgcctgggctgggggcggggaccaggcggggcagggggcagggagaggagggcggcgggagcctgagccggaatcgcagcgtgagcaggtggagccgcggtgggagcccgccgggtcgagctgagtaaggcggcgggctcggcgggggccatggagctgctaaagctgaaccggagcgtgcagggaaccggacccgggccgggggcttccctgtgccgcccgggggcgcctctcctcaacagcagcagtgtgggcaacctcagctgcgagccccctcgcattcgcggagccgggacacgagaattggagctggccattagaatcactctttacgcagtgatcttcctgatgagcgttggaggaaatatgctcatcatcgtggtcctgggactgagccgccgcctgaggactgtcaccaatgccttcctcctctcactggcagtcagcgacctcctgctggctgtggcttgcatgcccttcaccctcctgcccaatctcatgggcacattcatctttggcaccgtcatctgcaaggcggtttcctacctcatgggggtgtctgtgagtgtgtccacgctaagcctcgtggccatcgcactggagcggtacagcgccatctgccgaccactgcaggcacgagtgtggcagacgcgctcccacgcggctcgcgtgattgtagccacgtggctgctgtccggactactcatggtgccctaccccgtgtacactgtcgtgcaaccagtggggcctcgtgtgctgcagtgcgtgcatcgctggcccagtgcgcgggtccgccagacctggtccgtactgctgcttctgctcttgttcttcatcccgggtgtggttatggccgtggcctacgggcttatctctcgcgagctctacttagggcttcgctttgacggcgacagtgacagcgacagccaaagcagggtccgaaaccaaggcgggctgccaggggctgttcaccagaacgggcgttgccggcctgagactggcgcggttggcgaagacagcgatggctgctacgtgcaacttccacgttcccggcctgccctggagctgacggcgctgacggctcctgggccgggatccggctcccggcccacccaggccaagctgctggctaagaagcgcgtggtgcgaatgttgctggtgatcgttgtgcttttttttctgtgttggttgccagtttatagtgccaacacgtggcgcgcctttgatggcccgggtgcacaccgagcactctcgggtgctcctatctccttcattcacttgctgagctacgcctcggcctgtgtcaaccccctggtctactgcttcatgcaccgtcgctttcgccaggcctgcctggaaacttgcgctcgctgctgcccccggcctccacgagctcgccccagggctcttcccgatgaggaccctcccactccctccattgcttcgctgtccaggcttagctacaccaccatcagcacactgggccctggctgaggagtagaggggccgtgggggttgaggcagggcaaatgacatgcactgacccttccagacatagaaaacacaaaccacaactgacacaggaaaccaacacccaaagcatggactaaccccaacgcacaggaaaaggtagcttacctgacacaagaggaataagaatggagcagtacatgggaaaggaggcatgcctctgatatgggactgagcctggcccatagaaacatgacactgaccttggagagacacagcgtccctagcagtgaactatttctacacagtgggaactctgacaagggctgacctgcctctcacacacatagattaatggcactgattgttttagagactatggagcctggcacaggactgactctgggatgctcctagtttgacctcacagtgacccttcccaatcagcactgaaaataccatcaggcctaatctcatacctctgaccaacaggctgttctgcactgaaaaggttcttcatccctttccagttaaggaccgtggccctgccctctccttccttacccaaactgttcaagaaataataaattgtttggcttcctcctga

SEQ ID NO: 61253 - DNA, 1360 bp, Homo sapiens
gaaacctcctcgtctgtgcacgaacaggtggccgactctggagcccaggctgttgctttccagtctggtggtgaatcctccatagtctggaacagccagctgaaaactctcctggccattggaggctggaacttcgggactgcccctttcactgccatggtttctactcctgagaaccgccagactttcatcacctcagtcatcaaattcctgcgccagtatgagtttgacgggctggactttgactgggagtaccctggctctcgtgggagccctcctcaggacaagcatctcttcactgtcctggtgcaggaaatgcgtgaagcttttgagcaggaggccaagcagatcaacaagcccaggctgatggtcactgctgcagtagctgctggcatctccaatatccagtctggctatgagatcccccaactgtcacagtacctggactacatccatgtcatgacctacgacctccatggctcctgggagggctacactggagagaacagccccctctacaaatacccgactgacaccggcagcaacgcctacctcaatgtggattatgtcatgaactactggaaggacaatggagcaccagctgagaagctcatcgttggattccctacctatggacacaacttcatcctgagcaacccctccaacactggaattggtgcccccacctctggtgctggtcctgctgggccctatgccaaggagtctgggatctgggcttactacgagatctgtaccttcctgaaaaatggagccactcagggatgggatgcccctcaggaagtgccttatgcctatcagggcaatgtgtgggttggctatgacaacatcaagagcttcgatattaaggctcaatggcttaagcacaacaaatttggaggcgccatggtctgggccattgatctggatgacttcactggcactttctgcaaccagggcaagtttcccctaatctccaccctgaagaaggccctcggcctgcagagtgcaagttgcacggctccagctcagcccattgagccaataactgctgctcccagtggcagcgggaacgggagcgggagtagcagctctggaggcagctcgggaggcagtggattctgtgctgtcagagccaacggcctctaccccgtggcaaataacagaaatgccttctggcactgcgtgaatggagtcacgtaccagcagaactgccaggccgggcttgtcttcgacaccagctgtgattgctgcaactgggcataaacctgacctggtctatattccctagagttccagtctcttttgcttaggacatgttgcccctacctaaagtcctgcaataaaatcagcagtcaaaaca

SEQ ID NO: 61254 - DNA, 1448 bp, Homo sapiens
gaaacctcctcgtctgtgcacgaacaggtggccgactctggagcccaggctgttgctttccagtctggtggtgaatcctccatagtctgtgcaaccatgacaaagcttattctcctcacaggtcttgtccttatactgaatttgcagctcggaacagccagctgaaaactctcctggccattggaggctggaacttcgggactgcccctttcactgccatggtttctactcctgagaaccgccagactttcatcacctcagtcatcaaattcctgcgccagtatgagtttgacgggctggactttgactgggagtaccctggctctcgtgggagccctcctcaggacaagcatctcttcactgtcctggtgcaggaaatgcgtgaagcttttgagcaggaggccaagcagatcaacaagcccaggctgatggtcactgctgcagtagctgctggcatctccaatatccagtctggctatgagatcccccaactgtcacagtacctggactacatccatgtcatgacctacgacctccatggctcctgggagggctacactggagagaacagccccctctacaaatacccgactgacaccggcagcaacgcctacctcaatgtggattatgtcatgaactactggaaggacaatggagcaccagctgagaagctcatcgttggattccctacctatggacacaacttcatcctgagcaacccctccaacactggaattggtgcccccacctctggtgctggtcctgctgggccctatgccaaggagtctgggatctgggcttactacgagatctgtaccttcctgaaaaatggagccactcagggatgggatgcccctcaggaagtgccttatgcctatcagggcaatgtgtgggttggctatgacaacatcaagagcttcgatattaaggctcaatggcttaagcacaacaaatttggaggcgccatggtctgggccattgatctggatgacttcactggcactttctgcaaccagggcaagtttcccctaatctccaccctgaagaaggccctcggcctgcagagtgcaagttgcacggctccagctcagcccattgagccaataactgctgctcccagtggcagcgggaacgggagcgggagtagcagctctggaggcagctcgggaggcagtggattctgtgctgtcagagccaacggcctctaccccgtggcaaataacagaaatgccttctggcactgcgtgaatggagtcacgtaccagcagaactgccaggccgggcttgtcttcgacaccagctgtgattgctgcaactgggcataaacctgacctggtctatattccctagagttccagtctcttttgcttaggacatgttgcccctacctaaagtcctgcaataaaatcagcagtcaaaacaaaaaaaaaaaaaaaaaaaaaaaaaaa

SEQ ID NO: 61255 - DNA, 3756 bp, Homo sapiens
cacgcgccccgatacccggcacaggagccacctcccagagccccgcagtccatgcctcagtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttattctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttc

SEQ ID NO: 61256 - DNA, 3198 bp, Homo sapiens
agtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttattctgcttatccacattcaccaggtcaggtcatcactggatgtcagttgcttgtatataattatcaggaatatcctacttatcccgattcaccatttcaggtcaccactggatatcagttgcctgtatataattatcagccatttcctgcttatccaagttcaccatttcaggtcactgctggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaaagtgtttaaaagcaaattactgactttcaaaaaagtttttaaaacctgatttgaaagctaacaattttggatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttca

SEQ ID NO: 61257 - DNA, 3759 bp, Homo sapiens
gcgctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttattctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttca

SEQ ID NO: 61258 - DNA, 3391 bp, Homo sapiens
gcgggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttactctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttca

SEQ ID NO: 61259 - DNA, 1989 bp, Homo sapiens
acatggagaaaggaccacatcacccaatgacaagatcacctcatctgcagcagagtctacagaacatagagatagggctacatcagccaatgtgatcacaccagccccagcagagcctataaaacatgcaaaaaggaccacattggcccatgagaagatgacacaagtcacagaaaagtccacagaacacccagaaaagaccacgtcaaccacagagaaaaccacaagaaccccagaaaagcctacgctatactcagagaagaccatatgcaccaaagggaaaaacacaccagtcccagaaaagcctacagaaaacctggggaacaccacactgaccactgagaccataaaagccccagtaaagtccacagaaaacccagaaaaaacagcagcagtcacaaagactataaaaccttcagtcaaggtcacaggagacaaatctctcactactacctcttctcatctaaataaaactgaagttactcatcaggtgcccactggttctttcaccctcattacatctagaacgaagctgagttctatcacatcagaagccacaggaaacgagagccatccatacctcaataaagatggctcacagaaaggtatccacgctggacagatgggagagaatgattcattccctgcatgggccatagttattgtggtcctggtggctgtgattctcctcctggtgttccttggcctgatcttcttggtctcctatatgatgcggacacgccgcacactaacccagaacacccagtacaatgatgcagaggatgagggtggccccaattcctacccggtctacctgatggagcagcagaatcttggcatgggccagatcccttccccacggtgatcttggagtaggcgcccagccctggctcttccatgctctgcccctttcctggatgaggaaccggactcacaatttctatttccgggactacaggaagggcagagaatactgacggttaccagtattaacccttcatctgttcttgaaactggttggggaatgaggtgataagcaaggagggtgtaagtttaggggacaaagaagaaagaatgaataatacgagcagacattctctgtagaaggtaatggtctgagaatgaaaaggtgtttgatggacatgttgtgggggcaccaatgcagaacactgcactgagtcctaaaggaaggacaggagccttataggcaatgccccagactgacttgtgagtggggtttatggggaaagggagggactgagggcagagtctctgggtttcaggacagcattatgttatttccattcactattacttaagagtttgtgtgtaaacaggctcatctctgagttctcaggacccttgcccccacccccatttttttaatgaaaaaaaaaaacaaaaaaaacggatccaagaagaaaagagaatttatttccttctccactctctccatgccctggagaaaaaaaagtccagaagaaatcataaatatctctcatctacatggttgcttcctcttcctcccaaatcccttagttttcctaaatgtctacagtggacgccctgttggtttggcttgctgggttgtgggtggacacgcaaggaggggatttttatttggccagcagtctcacccactgatctccaccccagaccttccctgattggtgtctcagcatttattttcctgtctcttccaccaaaagccagctgtagctttatctcgtaaaagttacccatcttctctactgtccccattctctctcctcccaccttcaccccagattcaagttttcctccttgtaggcatttcatctgtgtgtgttttctggattttctctctctcttcttatggccatttcaccttattactgattgggtagagggggaaaaggagaatgatgatgatagtttccttctgtctattgaccttttttataataaagtataacatgtttataaagggaaaaaaaaaaaaaaaaaaaa

SEQ ID NO: 61260 - DNA, 6376 bp, Homo sapiens
ggtctgtcctgagccgacacctgcacagtggcgagaccaaggacccagagagaaaggtgagagtgcagccggggaggctgaggatcggcggagctggaagagtgagggtgaaggcaagaagtagagcacagaagcaaagattttaagaggaaagaagacatctgaacccaacaccaccctaaaccacaggctgcagggttggcatgctccgtgcaagaccagaggcactgatgctcctgggagctcttctgactggatccctgggtccatcgggcagtcaggacgcactctcactgccctgggaagtgcagcgctatgacggctggtttaacaacctgaggcaccacgagcgtggtgctgttggctgccggttgcagcgccgcgtaccagccaattacgccgacggtgtgtatcaggctctggaggagccgcagctgcccaacccgcgccggctcagcaacgcagccacgcggggcatagccggcctgccgtcgctccacaaccgcaccgtactgggggtcttctttggctaccatgttctttccgacgtggtgagcgtggaaacgcccggttgccccgccgagttcctcaacatccgcatcccacctggagaccccgtgttcgaccccgaccagcgcggggacgtggtgctgcccttccagaggagccgctgggaccccgagaccggacggagtcccagcaacccccgggacctggccaaccaggtgacgggctggctggacggcagcgccatctatggctcctcgcactcctggagcgacgcgctgcggagcttctcggggggacagctggcgtcggggcccgaccccgctttcccccgagactcgcagaaccccctgctcatgtgggcggcgcccgaccccgccaccgggcagaacgggccccgggggctgtacgccttcggggcagagagagggaaccgggaacccttcctgcaggcgctgggcctgctctggttccgctaccacaacctgtgggcgcagaggctggcccgccagcacccagactgggaggacgaggagctgttccagcacgcacgcaagagggtcatcgccacctaccagaacatcgctgtgtatgagtggctgcccagcttcctgcagaaaacactcccggagtatacaggataccgtcctttcctagaccccagcatctccccggaatttgtggtggcctctgagcagttcttctctaccatggtgccccctggtgtctacatgagaaatgccagctgtcatttccggaaggtcctgaacaagggttttcaaagctcccaagctctcagggtctgcaacaactactggattcgggagaaccccaatctgaacagtacccaggaggtgaatgagctgctgctgggaatggcctcccagatttcggagttggaggacaacatagtggttgaagatctgagggattactggcctggccctggcaaattctcccgtacagactatgtggccagcagcatccaacgtggccgagatatggggctgcccagctatagccaggccctgctggcctttgggctggacatcccaaggaactggagtgatctcaaccctaatgtggacccccaggtgctggaggccacagctgccctgtacaaccaggacctatcccagctagagctgctccttggggggctcctggagagccatggggaccctggacccctgttcagtgccattgtcctcgaccagtttgtacggctgcgggatggtgaccgctactggtttgagaacaccaggaatgggctgttctccaagaaggagattgaagacatccgaaataccaccctgcgggacgtgctggtcgctgttatcaacattgaccccagtgccctgcagcccaatgtctttgtctggcataaaggtgcaccctgccctcaacctaagcagctcacaactgacggcctgccccagtgtgcacccctgactgtgcttgacttctttgaaggcagcagccctggttttgccatcaccatcattgctctctgctgccttcccttagtgagtctgcttctctctggagtggtggcctatttccggggccgagaacacaagaagctacaaaagaaactcaaagagagcgtgaagaaggaagcagccaaagatggagtgccagcgatggagtggccaggccccaaggagaggagcagtcccatcatcatccagctgctgtcagacaggtgtctgcaggtcctgaacaggcatctcactgtgctccgtgtggtccagctgcagcctctgcagcaggtcaacctcatcctgtccaacaaccgaggatgccgcaccctgctgctcaagatccctaaggagtatgacctggtgctgctgtttagttctgaagaggaacggggcgcctttgtgcagcagctatgggacttctgcgtgcgctgggctctgggcctccatgtggctgagatgagcgagaaggagctatttaggaaggctgtgacaaagcagcagcgggaacgcatcctggagatcttcttcagacacctttttgctcaggtgctggacatcaaccaggccgacgcagggaccctgcccctggactcctcccagaaggtgcgggaggccctgacctgcgagctgagcagggccgagtttgccgagtccctgggcctcaagccccaggacatgtttgtggagtccatgttctctctggctgacaaggatggcaatggctacctgtccttccgagagttcctggacatcctggtggtcttcatgaaaggctccccagaggataagtcccgtctaatgtttaccatgtatgacctggatgagaatggcttcctctccaaggacgaattcttcaccatgatgcgatccttcatcgagatctccaacaactgcctgtccaaggcccagctggccgaggtggtggagtctatgttccgggagtcgggattccaggacaaggaggagctgacatgggaggattttcacttcatgctgcgggaccatgacagcgagctccgcttcacgcagctctgtgtcaaaggtggaggtggaggtggaaatggtattagagatatctttaaacaaaacatcagctgtcgagtctcgttcatcactcggacacctggggagcgctcccacccccagggactggggccccctgccccagaagccccagagctgggaggccctggactgaagaagaggtttggcaaaaaggcagcagtgcccactccccggctgtacacagaggcgctgcaagagaagatgcagcgaggcttcctagcccaaaagctgcagcagtacaagcgcttcgtggagaactaccggaggcacatcgtgtgtgtggcaatcttctcggccatctgtgttggcgtgtttgcagatcgtgcttactactatggctttgcctcgccaccctcggacattgcacagaccaccctcgtgggcatcatcctgtcacgaggcacggcggccagcgtctccttcatgttctcttatatcttgctcaccatgtgccgcaacctcataaccttcctgcgagagactttcctcaaccgctatgtgccttttgatgccgcagtggacttccaccgctggatcgccatggctgctgttgtcctggccattttgcacagtgctggccacgcagtcaatgtctacatcttctcagtcagcccactcagcctgctggcctgcatattccccaacgtctttgtgaatgatgggtccaagcttccccagaagttctattggtggttcttccagaccgtcccaggtatgacaggtgtgcttctgctcctggtcctggccatcatgtatgtcttcgcctcccaccacttccgccgccgcagcttccggggcttctggctgacccaccacctctacatcctgctctatgccctgctcatcatccatggcagctatgctctgatccagctgcccactttccacatctacttcctggtcccggcaatcatctatggaggtgacaagctggtgagcctgagccggaagaaggtggagatcagcgtggtgaaggcggagctgctgccctcaggagtgacctacctgcaattccagaggccccaaggctttgagtacaagtcaggacagtgggtgcggatcgcctgcctggctctggggaccaccgagtaccaccccttcacactgacctccgcgccccatgaggacacactcagcctgcacatccgggcagtggggccctggaccactcgcctcagggagatctactcatccccaaagggcaatggctgtgctggatacccaaagctgtaccttgatggaccgtttggagagggccatcaggagtggcataaatttgaggtgtcagtgttggtgggagggggcattggggtcaccccctttgcctccatcctcaaagacctggtcttcaagtcatccttgggcagccaaatgctgtgtaagaagatctacttcatctgggtgacacggacccagcgtcagtttgagtggctggctgacatcatccaagaggtggaggagaacgaccaccaggacctggtgtctgtgcacatttatgtcacccagctggctgagaagttcgacctcaggaccaccatgctatacatctgcgagcggcacttccagaaagtgctgaaccggagtctgttcacgggcctgcgctccatcacccactttggccgtccccccttcgagcccttcttcaactccctgcaggaggtccacccacaggtgcgcaagatcggggtgttcagctgcggccctccaggaatgaccaagaatgtagagaaggcctgtcagctcgtcaacaggcaggaccgagcccacttcatgcaccactatgagaacttctgagcctgtcctccctggctgctgcttccagtatcctgccttctcttctgtgcacctaagttgcccagccctgctggcaatctctccatcagaatccaccttaggcctcagctggagggctgcagagcccctcccaatattgggagaatattgacccagacaattatacaaatgagaaaaggcaggagactatgttctacaattgcagtgcatgatgattataagtccacctgtttatcaacggcaccattcctgcagccctccagacttcctgcccttagcaagtgcgcaaccagtcaggatctcccaaagaagataaagaccactcctcaccccagctcaagccatggcaggcgtggcaagcaaagtggggaggagacagtccctgcttgtgacaagtgtggaggtgaaaaggtacaatagtgcttgtctccgatagctccccacatctctaattgacttccacaaaatcgatgcgttgctttggtatttgcttggactgacatttgagggaggaggaggctgggatcctctggctgagaatctcctcagagcccagtgcagaagctgtgatgcttagaacctggacagcccgactgcctcaactctgtctccaggtctattccctccagctccaaaaggagcagccctacttctaccccttcccgtccccaaagtgtcagcaactttgaggagggcaccaggaaacaaagatgcctccccagccctgatattcttgatgtcaccagtgatacccactgccctgacccctgggcaggcccctctctgcatctactggagtggtccctgggctctggggctgaaggattccagcctctctgccagatattcagtactcgatctcaattcccctcttccacaagagttgggtgaccagctgtcctagtttgcccaggactctccctgttttagcactgaaagtctcttgccccaggaaaccccatcagtcccaggcagattgggacagctggtcaccttacgcaagagccaggctgaaacatcccctccatactcagctctttaacttttcttttcctttttcatcgggctctttcctaaaaagctgagctgtaaaatattttacatcgaggtataataaataatcatgtacatgttttaccaccacccaggtcaagacatagaatgtttcaacatttccatcaccccagaaactccccttgtacccccttccacttcgtctcccctagctcctagaagcaaccactgatgtgatttctaccaaatccagttttggtcctactaaatatactcttttgagactggcctcttttactcaccataatgcctttgtaattcatccatgctgttgtgtgtatcagcagtttgttccttttcattgctgagtagtattctattgtagagatgtaccacagtttgtttattcttctgttgatggacgtttgggttgtttctaattttgaatgattataaataaaaattctgtgagtgttcttgtaaaaaaaaaaaaaaaaaaaaaaaaaaaaaaa

SEQ ID NO: 61261 - DNA, 2148 bp, Homo sapiens
acactcagtctctgattttatccctgccctggcttaattaagtgctctgaagacataaataggttttttgtttactcaagcttgggagaagctggcagaaaaggccttttcagctaaaagctccttacagccggaaggtgtgaagcggcaagtttccagccgggaagaagcctctcagccgtaggcgtctttgcccggagctgtgagcccccctcccaactcccaaatcccccggcgtcggagatgaggccccggatgctgccagtgttctttggggagagcatcaaggtgagcccggaacccacgcatgagatccgctgcaactctgaggtcaagtacgcctcggagaagcatttccaggacaaggtcttctatgcgcccgtacccaccgtcacggcctacagcgagaccatcgtggcagcacccaactgcacgtggcgcaactaccgcagccagctgaccctggagccacgcccgcgcgccctgcgcttccgcagcaccaccatcatcttccccaagcatgccaggagcactttccggaccaccctgcactgcagcctgggccggcccagccgctggttcaccgccagcgtgcagctgcagctttgccaggaccctgcccccagcctcctgggccctgccacgctctgacggggctggggccggcccggggtgctggaggagccgggagccctggggagaagccgggaggatggacacgatgagctcggcctggcactcgggcaggaggcgggaagggaggctgccagaccaaggacccgtgtggaaggaggcggctccccgctgcctgccctgacctacaggctaggtggtggtctccttgttttggtgtcaaggactcagtaaaagcatctatttttttagcacttaagctggcaaggcggtaggggcatgcactgttaggtggtggccacccccagggtcaggggaaaagaatgggtccatggagtgcccttgaagcagagaacagccccgagcagtgtgaggacagaggcatcccagcctcagccggtggggacggctgccactcccccagagccctgccaccccatgtgtcctaggctggtggccaaggccatgtgtgagggaagaggggtacctctcttccctgctgctggcctggggtatttccaaaacagccttttcgcacacatgcaggttgcaccgagaggtctggagctgtggctgagccacctctggcggatgttgagccaggaggttgggcaaaggccggatgctgatgccagcgctggaggtggtgatactgggggcggggaaggcctagaaatactttgagccatggccttgccagtgtcccgtgccctccagtgtcaaagatttggggcactgcccgtcgaaatggaaaggttggtgctcagcctctggagcctcacctgcagggcgtccccagctaacacccatccacgcaccacctccaggacgagaacccttgatgtcaaaaccaagtgcccagtggaggcggtgaagctctcggaaatgctgccacctgtgtgaggccgggtctgaactcgagggagtcggagctcagctgtcggtttaaagagacactgaggggaccgggctgccgccctcagcctgcattcctgtgcgcaatcgattccgcaatgacagcaccttactccttcctgcggcaggctcacccctgcctgtgggatgttgtgagaggaacatgagccagacaaagacttggctcagggctccgtggaacaagccaggatgcacggggagctgggggagcccccagcctggggcagcccagcaggccgctgaacaaacaccccagaagccagcactgtggcagggtgctggggagatgcccctctgagccttcctcccccctcagacctgaatgcactccacagttgggggctgcccctgccactcccctggtaatgcataaaaggggaggggaaggttccctggggcttgagctccctctgtggaggtgaggaggggagattccgttcacatccaggaggggcaaaatgactgatgtatttttatgtatctacacagagagtgcattttctctccagagatgctgtctggttaacaaaggaataacttaagaaattgattgattatcttaataaactgtgcaaaccc

SEQ ID NO: 61262 - DNA, 7148 bp, Homo sapiens
atgggctgccaagccctcccgctttggctgctgttcttccatgccgttattctacctgaagcagtttgctacaggaaaaatgtgggaggatccagaggaaggctgtggaacccatgctctgagagaagcactgtccaaggtacacctgcgactcagcaagaagactggattgctgtgcaactcgtggaaggttctggaaggtgttcaggacgagtcgaggtgtattttgaaggcgtgtggggcatggtgtgcgatgacctgtgggatgagaaggaagtgcaggtggtgtgccggcagctgggctgtggggcagccatctctgcccctggagaggcccactttggccagggctccggccccattcttctggacgatgtgcagtgttccgggattgaggactacctggaggagtgctcccatgctggctggtccacccacaactgtgggcacggggaagacgctggtgtcatctgctcagagtatgaaaatgagcgcttgcaatcttttgatgctgagatcctaacgccatttcctggtgactggccacaattgcaactagtgaatggctcaggtaggtgttcggggcatgtggaagttttccaccatggccagtggggcagggtttgcgacgaccagcgggacatgaatgaagctgacgtggtgtgccggcagctgcactgtgggtgtgccctcgcagcccctgctgaggcccaatttggcgaaggcagaggcgaatttctactggatgatgtggactgtactgggaaagagagttttttgggacaatgtcctcatgccggctggggcctgcataactgtggccccagagaagatgccagcatcatctgcgcaggtgcttctttattacagttctacctgctgccatctcaactcaactctctcctacaactgctgcacattcggcatcgtcagcagttctgtcagcttccaccaccccggaagatgttaaccacccaaccatatcatcagtgctacctgtggctgactcagcatctgccagccgtagggccaacgtgcctgggcccagcccttcaggtgagcaaccttcctgaggatacctttttgctctccaaaccacagagtgaaggtgggctcatcccaatgagggaggagcctgggggagcagcaccgtttgcagcctctttggcttggggtcacttcggagacttcactggccataacccctgtgtcctccacacttccatcaacagtagcctggatggaggtgaggctgctgaatggcacagggaggtgctcaggccgcgtggaggttcttgtccagggcacatggaggaccgtgtgttgcgtgacgacctctggaatctggccaaggccactgtcgtgtgccgccagctacagtgtggacgggctgtggcagccccaacaggggctcacttcggggcaggctctgggaaaatcctgctggatgacgtgcagtgtgtggggagcgagagccacctggggcagtgcgtgcatgggggccgggccaggcacaactgtgggcacctggaggatgccagtgtcatctgttcaggtcaagcactgtcattaactaccacagagcccactgtgcttcccccaactcctccaacaggtgctgggttatctgcaaccatagccacaacagagcctgtgtccctgccatccacacccatgcccctggcaggagcctggatggaggtgaggctgctgaacggcacaggaaggtgctcaggccgtgtggaagttctcgtccagggcacgtgggggaccgtgtgtgatgatctctgggacctggctgaggccactgtcgtgtgccgccagctgcagtgtggccaggctgtggcagcccccacaggggcccactttcgggcaggctctgggaagatcttactggatgacatgcagtgtgtgggcagtgagagccatctgggtcaatgcatgcgtggggaccaggccaggcacaactgtgggcacctggaggatgccagtgtcatctgcacaggtgatggattatctgcaaccatagccacgacagccatgaccctgccatccacacccatgcccccagcaggctccaggaagatcctgctagatgactttcagcatgtgggcagtgagagccacctggggcagtgtgtgaacaggagctggaccaggcacaattgtgggcacctggagaatgccagcatcatctgcacaagtgaaggaatggctctcagtcctcacttagatggaaacaggcagcccagcaacttggataacctcagggagaaagcgtttttatatcaaaggcaccaacatcttctaaaattccaccatcagttaccagctgcaggagcctgcatggaggtgaggctgctgaatggcacagggaggtgcttaggccgcgtggaggttctcatccagggcacgtgggggacggtgtgtgaccacttctggaacctggccgaggccgccgttgtgtgccgccagctgcaatgtggccaggccatggcagcccacttcggggcaagctctgggaaagtcctgctggatgacatgcagtgtgtgggcagcaagagccacctggggcggtgcgtgcacaggggctgggccaggcacaactgtgggcacctggaggatgccagtgtcatctgtgcagccatcccgacagcaacacccagaacagtaacagcaagagcaggggactggccggagctgcagctggtgggtggctctggccggtgctcaggacgcgtggagattctccaccagggcgcctggggcaccgtgtgtgatgacctgtgggacctgaacgaagctgaggttgtgtgccggcagcttgggtgtggtcgagccatgtctgcccttggaaaggcccactttggccccggctcaggagacatcttcctggacaacctccagtgcgctggtgtggagcgctacctgggccagtgcacccactcgggctggtcagagcacaactggccaccacgaggatgccagtgtcatctgctcagagggctggccggagctgaggctgatgggcggctcaggccggtgcttggggcgcgtggagattctccaccagggtgcctggggcaccgtgtgcgacgacctgtgggacctgaatgaagccaaggttgtgtgccggcagttggggtgtgggcaggctgtttctggccctggcgaggcccactttggcccaggctcaggagacatcttcctggacaacctccagtgcactcgggtagagcactacctgggccagtgtacccacttgggctggtcagagcacaactgtggccaccacgaggatgccagtgtcatctgctcagatgcggaagacctacctccacccacacctccagattcttctacagcttctcaggatcacataaaaggaggaagtaactcttgtggaggggtcatttctagtctctctggctcattttctagtccacagtatccagaaaactacccaacagatatccagtgtgtttgggagatccacatgggtgcaaaatttcacatagaactcataattccaagtttgaaggttttgcaaacattaaattttaggaagtttctaatctgccactacccctccatgtctattcaccccaggttggaagatatccttggatgtccctatgactccgttgaaatcttcaatggtcccaggattgcctcgctctccatggggaagttctgtgcccctgaaactgtgatattcttctcctcctcacacatcatgacagtggtgttccaaagtgattctatgaaaaccaacactggcttttatgctcttttcaatgccattcctcagggtgaaagggagtcagaagatggaccagagttgcggctggtgggtggctctggccagtgctcaggacatggggaggtcctacacaagggctcctggggcactgtgtgtgatgacctgtgggatctgaatgaagctgaggttgtgtgccagcagctcgggtgtggtaaggccattgctgctcctggaaaggcccactttggcccaggttctggagacatccttctagacaacattcagtgttcaggaagtgagaaccaccttggccagtggcccagctccggctggtcagaccacaaccgtggccaccatgaggatgccaatgttgtctgctcaggtgcccttggtaccctacaaactaccccaccaacttggagtgcgtctgggtgatacacatctgttcttcttcatcctcatggtctgggactgcggctggtgaacgggtccagcagatgtgagggccgagtcgaggtctaccatgccaatgcctggggcaccgtgtgtgatgacagctggtctatagaggatgcccacgtggtctgcaggcagctgggctgtggcctggccgtgtctgccctcccaggagccagcttcagccctggatcaggcagcatcctccttgatgacgtcaactgcacgggaagggagtcctccctggggcagtgccctcacagaggttggtacacccacaactgtgggcaccatgaagatgctggcgtcatctgcttagattctgcagctgctggacatccaggtatctatgagtttgtgtccattttatttgctgactggtggctagccgtcacctctaattgcaaatgcgatttccctggccctggtgctgtgtgcaataagaactgtgctcatgagaggcaagctggtgacatggaggattctcgtggagtaggtgtctttccaagaagagagcccactcagccaccgccctctgcagcaacagcagcagcaggctactgctcctgcaggtccttctacaggggcctcgggaaccagccccagttcctggggatgcagatcctgagagtcagcttcatctgctttgggcgcagggccttgcccattgtcaagttggcagatgagaggagccaatgcaaagggcacattgaagtctaccacaatggcacatgggggactgtgtgcgacaacctctggggcgtcaacgctgcccacatggtgtgccagcagctgggttgtgggaagggtgttggccaccccagggaatggccacttggttgcaggggtggggggtggcggcgtgggacacatcctcctggacgatgggcagtgtcaaggcatggagaccacactaggccagcgtggctatctgggtctgtccatccacaactgtggccaccatgaggatgctgggctcatctgcacagatactgacttccagctttctcctgaggctgccagagccatgactctcagtgggggacctggaaaccaatttcctgcttcaatttcagccacagattttgcccttacacctgatgggcacctggatggtttctggatttgggctgttgtggaggcttctgctgtgtccaaatctttctgtggacatgcacattcgttcatcttgagtaaataccaaatggaagagctgggttgtacaatatggtttttagagcgaacgtatgagctcttcaccatcaagagtaaaaagccgcccctgcgcctggcgggcgggcggagccgctgtgagggccgggtagagctgcggcaccagggcgtgtggggcacggtgtgcgacgaccactggaacatcaggaacgcccgtgtggtgtgccgcctcctgggttgcggccgtgctctgggcgccccgggccgcggccgctttggccagggcaccgggcccatcctgctggacgacgtgcgctgcaccggccacgagaacgcgctggagcgctgcacccactcgggctgggcccggcacaactgccagcaccgcgaggacgcgggcgtggtgtgcgcaggtatcgcgtcctctgcccaccctgcctttcctctcctcacattcctggggtccaaattcaccatcctggggatatcagcccagctatcctgcttgcctcacctcttccaagccgtcattgaccgaggctatctccggaggctgggctactcctcctgggacatccacttaaatgatgagctatgtcgccccaaagtcatgggacgctgcctgatcttcaacattccctatggccactgtggcactatccagcaggagcaccttggctccctcagctactctaactccatcagaggccggaaacggggccaccctggccgagtcattgtgcggcacaaggtgcccaagctgaagttcacctgtagggcggacggcccatccacagttgaaatcattcatggggatgacgccccaacagagggtgctggctacaccgtgtctatatccttcctccagtcccctgagtcccagcatgtgggaggcatggtgccctactatgacagccagaggaaagaggtcttcctccaagccaccctccacagccccaatcccaacctgatgctcttcgtggatacctgtgtggcttctcctgatccccatgattttacagccatcaagtatgatttgatccggcaggggtgcatcaaagacaatacctacatcaacctccatccccgccagaagaacatggctcagttcaagttcaatgtcttcagctttcttgacagctatgatgtggtatatctgcagtgtaaggttgcagtgtgcaaggtgggggattatgcctctctctgctcctggggctgtacaggacagagtaggagaggtgcaggccccatggaggccaaggaaaagcagactgagcatttccaaatggtggggccactggagatccacaaagtcactgctcagaggaggactcttgagtgatttctgcaattttcatgtaaatctgtagaaagcaaagtctatttctcttcagtaatgtttgaccaatcagacgctatccgcatagagacaggtcaaagaaacagccagaggggattgcttctctgaggtttgttactaaacaaatcttctctgattactaaacttctaaggcaattactctctttgctgccacaaatgctacattttctaattcttgtcttaaagtgtacaaaatgttacaaagagcagggttatctctctataccgcattgtcaatttaaagattgtctttttaagttgactgtttaatcatcagatgctattaagtggatctctgtttttatcctctgacggtacgaggatttattttcaactcttgccaagagtcttaggtaaaataaaataagtgtctgt

SEQ ID NO: 61263 - DNA, 7036 bp, Homo sapiens
atgggctgccaagccctcccgctttggctgctgttcttccatgccgttattctacctgaagcagtttgctacaggaaaaatgtgggaggatccagaggaaggctgtggaacccatgctctgagagaagcactgtccaaggtacacctgcgactcagcaagaagactggattgctgtgcaactcgtggaaggttctggaaggtgttcaggacgagtcgaggtgtattttgaaggcgtgtggggcatggtgtgcgatgacctgtgggatgagaaggaagtgcaggtggtgtgccggcagctgggctgtggggcagccatctctgcccctggagaggcccactttggccagggctccggccccattcttctggacgatgtgcagtgttccgggattgaggactacctggaggagtgctcccatgctggctggtccacccacaactgtgggcacggggaagacgctggtgtcatctgctcagagtatgaaaatgagcgcttgcaatcttttgatgctgagatcctaacgccatttcctggtgactggccacaattgcaactagtgaatggctcaggtaggtgttcggggcatgtggaagttttccaccatggccagtggggcagggtttgcgacgaccagcgggacatgaatgaagctgacgtggtgtgccggcagctgcactgtgggtgtgccctcgcagcccctgctgaggcccaatttggcgaaggcagaggcgaatttctactggatgatgtggactgtactgggaaagagagttttttgggacaatgtcctcatgccggctggggcctgcataactgtggccccagagaagatgccagcatcatctgcgcaggtgcttctttattacagttctacctgctgccatctcaactcaactctctcctacaactgctgcacattcggcatcgtcagcagttctgtcagcttccaccaccccggaagatgttaaccacccaaccatatcatcagtgctacctgtggctgactcagcatctgccagccgtagggccaacgtgcctgggcccagcccttcaggtgagcaaccttcctgaggatacctttttgctctccaaaccacagagtgaaggtgggctcatcccaatgagggaggagcctgggggagcagcaccgtttgcagcctctttggcttggggtcacttcggagacttcactggccataacccctgtgtcctccacacttccatcaacagtagcctggatggaggtgaggctgctgaatggcacagggaggtgctcaggccgcgtggaggttcttgtccagggcacatggaggaccgtgtgttgcgtgacgacctctggaatctggccaaggccactgtcgtgtgccgccagctacagtgtggacgggctgtggcagccccaacaggggctcacttcggggcaggctctgggaaaatcctgctggatgacgtgcagtgtgtggggagcgagagccacctggggcagtgcgtgcatgggggccgggccaggcacaactgtgggcacctggaggatgccagtgtcatctgttcaggtcaagcactgtcattaactaccacagagcccactgtgcttcccccaactcctccaacaggtgctgggttatctgcaaccatagccacaacagagcctgtgtccctgccatccacacccatgcccctggcaggagcctggatggaggtgaggctgctgaacggcacaggaaggtgctcaggccgtgtggaagttctcgtccagggcacgtgggggaccgtgtgtgatgatctctgggacctggctgaggccactgtcgtgtgccgccagctgcagtgtggccaggctgtggcagcccccacaggggcccactttcgggcaggctctgggaagatcttactggatgacatgcagtgtgtgggcagtgagagccatctgggtcaatgcatgcgtggggaccaggccaggcacaactgtgggcacctggaggatgccagtgtcatctgcacaggtgatggattatctgcaaccatagccacgacagccatgaccctgccatccacacccatgcccccagcaggctccaggaagatcctgctagatgactttcagcatgtgggcagtgagagccacctggggcagtgtgtgaacaggagctggaccaggcacaattgtgggcacctggagaatgccagcatcatctgcacaagtgaaggaatggctctcagtcctcacttagatggaaacaggcagcccagcaacttggataacctcagggagaaagcgtttttatatcaaaggcaccaacatcttctaaaattccaccatcagttaccagctgcaggagcctgcatggaggtgaggctgctgaatggcacagggaggtgcttaggccgcgtggaggttctcatccagggcacgtgggggacggtgtgtgaccacttctggaacctggccgaggccgccgttgtgtgccgccagctgcaatgtggccaggccatggcagcccacttcggggcaagctctgggaaagtcctgctggatgacatgcagtgtgtgggcagcaagagccacctggggcggtgcgtgcacaggggctgggccaggcacaactgtgggcacctggaggatgccagtgtcatctgtgcagccatcccgacagcaacacccagaacagtaacagcaagagcaggggactggctggagctgcagctggtgggtggctctggccggtgctcaggacgcgtggagattctccaccagggcgcctggggcaccgtgtgtgatgacctgtgggacctgaacgaagctgaggttgtgtgccggcagcttgggtgtggtcgagccatgtctgcccttggaaaggcccactttggccccggctcaggagacatcttcctggacaacctccagtgcgctggtgtggagcgctacctgggccagtgcacccactcgggctggtcagagcacaactggccaccacgaggatgccagtgtcatctgctcagagggctggccggagctgaggctgatgggcggctcaggccggtgcttggggcgcgtggagattctccaccagggtgcctggggcaccgtgtgcgacgacctgtgggacctgaatgaagccaaggttgtgtgccggcagttggggtttgggcaggctgtttctggccctggcgaggcccactttggcccaggctcaggagacatcttcctggacaacctccagtgcactcgggtagagcactacctgggccagtgtacccacttgggctggtcagagcacaactgtggccaccacgaggatgccagtgtcatctgctcagacctacctccacccacacctccagaaaactacccaacagatatccacacccaacattctatagtttttccaaatggaccagagttgcggctggtgggtggctctggccagtgctcaggacatggggaggtcctacacaagggctcctggggcactgtgtgtgatgacctgtgggatctgaatgaagctgaggttgtgtgccagcagctcgggtgtggtaaggccattgctgctcctggaaaggcccactttggcccaggttctggagacatccttctagacaacattcagtgttcaggaagtgagaaccaccttggccagtggcccagctccggctggtcagaccacaaccgtggccaccatgaggatgccaatgttgtctgctcagatgctggggactgggctccagatgtgattcctccacccccaggaggaagtaactcttgtggaggagtgatttcaagtctctcaggttccttctccagcccttggtaccctacaaactaccccaccaacttggagtgcgtctgggtgatacacgtggctgagaaattccacatagaactgatgatcccaagcctgaaattagaggacatctatgggtgtccttacgactttatcgaagtgttcgatggacaacaggctgcctcactctccatgggcaggttttgtgctgggacagagctcacgttcctttcttcttcaaacatcatgaccacagtgttcagaagcaacgccatgatcaccaacacagggttttatgctctgtacaacaccgttcagcaagatgaaagggagaacgcatcttttccaaagccaacagaggtgcccacatggacaggtctgggactgcggctggtgaacgggtccagcagatgtgagggccgagtcgaggtctaccatgccaatgcctggggcaccgtgtgtgatgacagctggtctatagaggatgcccacgtcgtctgcaggcagctgggctgtggcctggccgtgtctgccctcccaggagccagcttcagccctggatcaggcagcatcctccttgatgacgtcaactgcacgggaagggagtcctccctggggcagtgccctcacagaggttggtacacccacaactgtgggcaccatgaagatgctggcgtcatctgcttagattctgcagctgctggacatccaggtatctatgagtttgtgtccattttatttgctgactggtggctagccgtcacctctaattgcaaatgcgatttccctggccctggtgctgtgtgcaataagaactgtgctcatgagaggcaagctggtgacatggaggattctcgtggagtaggtgtctttccaagaagagagcccactcagccaccgccctctgcagcaacagcagcagcaggctactgctcctgcaggtccttctacaggggcctcgggaaccagccccagttcctggggatgcagatcctgagagtcagcttcatctgctttgggcgcagggccttgcccattgtcaagttggcagatgagaggagccaatgcaaagggcacattgaagtctaccacaatggcacatgggggactgtgtgcgacaacctctggggcgtcaacgctgcccacatggtgtgccagcagctgggttgggtggggggtggcggcgtgggacacatcctcctggacgatgggcagtgtcaaggcatggagaccacactaggccagcgtggctatctgggtctgtccatccacaactgtggccaccatgaggatgctgggctcatctgcacagatactgacttccagctttctcctgaggctgccagagccatgactctcagtgggggacctggaaaccaatttcctgcttcaatttcagccacagattttgcccttacacctgatgggcacctggatggtttctggatttgggctgttgtggaggcttctgctgtgtccaaatctttctgtggacatgcacattcgttcatcttgagtaaataccaaatggaagagctgggttgtacaatatggtttttagagcgaacgtatgagctcttcaccatcaagagtaaaaagccgcccctgcgcctggcgggcgggcggagccgctgtgagggccgggtagagctgcggcaccagggcgtgtggggcacggtgtgcgacgaccactggaacatcaggaacgcccgtgtggtgtgccgcctcctgggttgcggccgtgctctgggcgccccgggccgcggccgctttggccagggcaccgggcccatcctgctggacgacgtgcgctgcaccggccacgagaacgcgctggagcgctgcacccactcgggctgggcccggcacaactgccagcaccgcgaggacgcgggcgtggtgtgcgcaggtatcgcgtcctctgcccaccctgcctttcctctcctcacattcctggggtccaaattcaccatcctggggatatcagcccagctatcctgcttgcctcacctcttccaagccgtcattgaccgaggctatctccggaggctgggctactcctcctgggacatccacttaaatgatgagctatgtcgccccaaagtcatgggacgctgcctgatcttcaacattccctatggccactgtggcactatccagcaggagcaccttggctccctcagctactctaactccatcagaggccggaaacggggccaccctggccgagtcattgtgcggcacaaggtgcccaagctgaagttcacctgtagggcggacggcccatccacagttgaaatcattcatggggatgacgccccaacagagggtgctggctacaccgtgtctatatccttcctccagtcccctgagtcccagcatgtgggaggcatggtgccctactatgacagccagaggaaagaggtcttcctccaagccaccctccacagccccaatcccaacctgatgctcttcgtggatacctgtgtggcttctcctgatccccatgattttacagccatcaagtatgatttgatccggcaggggtgcatcaaagacaatacctacatcaacctccatccccgccagaagaacatggctcagttcaagttcaatgtcttcagctttcttgacagctatgatgtggtatatctgcagtgtaaggttgcagtgtgcaaggtgggggattatgcctctctctgctcctggggctgtacaggacagagtaggagaggtgcaggccccatggaggccaaggaaaagcagactgagcatttccaaatggtggggccactggagatccacaaagtcactgctcagaggaggactcttgagtgatttctgcaattttcatgtaaatctgtagaaagcaaagtctatttctcttcagtaatgtttgaccaatcagacgctatccgcatagagacaggtcaaagaaacagccagaggggattgcttctctgaggtttgttactaaacaaatcttctctgattactaaacttctaaggcaattactctctttgctgccacaaatgctacattttctaattcttgtcttaaagtgtacaaaatgttacaaagagcagggttatctctctataccgcattgtcaatttaaagattgtctttttaagttgactgtttaatcatcagatgctattaagtggatctctgtttttatcctctgacggtacgaggatttattttcaactcttgccaagagtcttaggtaaaataaaataagtgtctgt

SEQ ID NO: 61264 - DNA, 826 bp, Homo sapiens
ccaaagtgatcatttgaaaaagagatatccacatcttcaagcccatataaaggatagaagctgcacagggcagctttacttactccagcaccttcctctcccaggcaaaatgaaaatacttgtggcatttctggtggtgctgaccatctttgggatacaatctcatggatacgaggtttttaacatcatcagcccaagcaacaatggtggcaatgttcaggagacagtgacaattgataatgaaaaaaataccgccatcattaacatccatgcaggatcatgctcttctaccacaatttttgactataaacatggctacattgcatccagggtgctctcccgaagagcctgctttatcctgaagatggaccatcagaacatccctcctctgaacaatctccaatggtacatctatgagaaacaggctctggacaacatgttctccagcaaatacacctgggtcaagtacaaccctctggagtctctgatcaaagacgtggattggttcctgcttgggtcacccattgagaaactctgcaaacatatccctttgtataagggggaagtggttgaaaacacacataatgtcggtgctggaggctgtgcaaaggctgggctcctgggcatcttgggaatttcaatctgtgcagacattcatgtttaggatgattagccctcttgttttatcttttcaaagaaatacatccttggtttacactcaaaagtcaaattaaattctttcccaatgccccaactaattttgagattcagtcagaaaatataaatgctgtatttatagaaaaaaaaaaaaaaaaaaaaaaaaaaa

SEQ ID NO: 61265 - DNA, 518 bp, Homo sapiens
ggaactgcaggcccacctgtctgcaacccagctgaggccatgccctccccagggaccgtctgcagcctcctgctcctcggcatgctctggctggacttggccatggcaggctccagcttcctgagccctgaacaccagagagtccagcagagaaaggagtcgaagaagccaccagccaagctgcagccccgagctctagcaggctggctccgcccggaagatggaggtcaagcagaaggggcagaggatgaactggaagtccggttcaacgccccctttgatgttggaatcaagctgtcaggggttcagtaccagcagcacagccaggccctggggaagtttcttcaggacatcctctgggaagaggccaaagaggccccagccgacaagtgatcgcccacaagccttactcacctctctctaagtttagaagcgctcatctggcttttcgcttgcttctgcagcaactcccacgactgttgtacaagctcaggaggcgaataaatgttcaaactgta

SEQ ID NO: 61266 - DNA, 1536 bp, Homo sapiens
ttgcaaatcgcggtacctgtggatgagagacatagacgagagagtgagatggcctggtttgccctctacctcctgagccttctctgggctacagctgggactagtacccagacccagagttcatgctccgttccctcagcacaggagcccttggtcaatggaatacaagtactcatggagaactcggtgacttcatcagcctacccaaaccccagcatcctgattgccatgaatctggccggagcctacaacttgaaggcccagaagctcctgacttaccagctcatgtccagcgacaacaacgatctaaccattgggcagctcggcctcaccatcatggccctcacctcctcctgccgagaccctggggataaagtatccattctacaaagacaaatggagaactgggcaccttccagccccaacgctgaagcatcagccttctatgggcccagtctagcgatcttggcactgtgccagaagaactctgaggcgaccttgccgatagccgtccgctttgccaagaccctgctggccaactcctctcccttcaatgtagacacaggagcaatggcaaccttggctctgacctgtatgtacaacaagatccctgtaggttcagaggaaggttacagatccctgtttggtcaggtactaaaggatattgtggagaaaatcagcatgaagatcaaagataatggcatcattggagacatctacagtactggcctcgccatgcaggctctctctgtaacacctgagccatctaaaaaggaatggaactgcaagaagactacggatatgatactcaatgagattaagcaggggaaattccacaaccccatgtccattgctcaaatcctcccttccctgaaaggcaagacatacctagatgtgccccaggtcacttgtagtcctgatcatgaggtacaaccaactctacccagcaaccctggccctggccccacctctgcatctaacatcactgtcatatacaccataaataaccagctgaggggggttgagctgctcttcaacgagaccatcaatgttagtgtgaaaagtgggtcagtgttacttgttgtcctagaggaagcacagcgcaaaaatcctatgttcaaatttgaaaccacaatgacatcttggggccttgtcgtctcttctatcaacaatatcgcggaaaatgttaatcacaagacatactggcagtttcttagtggtgtaacacctttgaatgaaggggttgctgactacatacccttcaaccacgagcacatcacagccaatttcacacagtactaacgaagaggtgggttcagcttctatcaaacatctccaaaggatgggtgaaattttttccacttcattttaaatctatgcaaaaaagcgaatgcctgtgatgctaccatattcctggtaaaaacatggagaaccactatgtagaataaaaatgcaaagttcactggagtctcaacatctatgactcatgaaaataaaattttcatcttctcaaaaaaaaaaaaaaaaaaaaaaaaa

SEQ ID NO: 61267 - DNA, 6142 bp, Homo sapiens
atgggccccgccgccagggggcgcagcgctcccttcccggccgttccacggcggttcgcggttcccgctgcccaggagctggaggcgggcccggcgccttgggtgtgcacccgggctggcgcgaggcctggccggccggccgcaaagctgaagcctggggcgctcgccgctcctcttctaaaaagtatcactgtgaaagtggagacagaggctgaagatgctgctctggactgctccgtgaattccaggacttctgagaagcactctgtggacagcgtcctcactgccctgcaggactccagcaaacgaaagcagctggtcagcgatggcctgctagactctgtccccggcgtgaagaggaggcggctgatccccgaggctctcctagcaggcatgcggaaccgtgagaacagctcgccctgccaaggcaatggtgagcaggccggcaggggcaggagcctgggcaatgtgtggcctggagaggaggagccctgcaacgatgccaccaccccttcctacaagaagcctctgtatggcatctcgcacaagatcatggagaagaagaatcctccctcgggggacctgctaaacgtgtacgagctctttgagaaggcaaacgccagcaacagcccctcgtcactgcggctcctgaatgagccacagaagcgggactgtggcagcaccggggcaggcactgacaacgaccccaacatctacttcctgatccagaagatgttctacatgctgaacaccctcacgtccaacatgtcccagctgcacagcaaggtggacctgctctcccttgaggtgagccgcatcaagaagcaggtgagccccactgagatggtggccaaattccagccgccccctgagtaccagctcacagccgcagagctcaagcagatcgtggaccagagcctgtcagggggggacctggcctgccgcttgctggtgcagctcttccccgagctcttcagcgacgtggacttctcccggggctgcagtgcctgtggctttgcggccaagcgcaagctggagtcgctgcacctgcagctcatccgcaactatgtggaggtctactacccctcggtgaaggacacggctgtgtggcaggccgagtgcctgccccagctgaacgacttcttcagccgcttctgggcccagcgggaaatggaggacagccagcccagcggccaggtcgccagcttctttgaggcagagcaggtggaccccggccacttcctggacaacaaagaccaggaggaggccctgtctcttgaccggagcagcaccatcgcctcagaccacgtggtggacacgcaggacctcactgagttcctggacgaagcctcctcaccaggcgagtttgccgtcttcctcctccaccggctcttccccgagctcttcgaccaccgcaagctgggtgaacagtacagctgctacggggacggtggaaagcaggagctggacccgcagcggctgcagatcatccgcaactacacggagatctacttccctgacatgcaggaggaggaggcctggctgcagcagtgtgcccagcgcatcaacgacgagctcgagggcctggggctggacgcgggcagtgaaggcgaccccccgcgtgatgactgctacgactcctccagtctgcccgacgacatctcagtggtcaaggtggaggacagcttcgagggcgagcggccgggtcgccgctccaagaagatctggctggtgcccatcgacttcgacaagttagagatcccccagcctgacttcgaggtgcccggtgccgactgcctgctcagcaaggagcagctacgcagcatctacgagagcagcctgtccatcggcaacttcgcctcgcgcctgctggtgcacctgttccccgagctcttcacgcacgagaacctgcgcaagcagtacaactgcagcggctccctgggcaagaagcagctggacccctcccgcatcaagctcatccgccactacgtgcagctgctctacccacgcgccaaaaacgaccgcgtctggaccctggagttcgtgggcaaactggatgagcgctgccggcgccgggacacggagcaaaggcgctcctaccagcagcagcgcaaggtccacgtgccgggccctgagtgcagagacttgaccagctatgcaatcaaccccgagaggttccgggaggagtttgaggggcccccactgccccccgagaggagcagcaaggacttttgcaagatccccttggacgagctggtggtcccctcgcctgacttcccggtgccttctccctacctgctgtctgacaaggaggtgcgtgagatcgtgcagcagagcctctccgtgggcaactttgccgcccggctcctcgtccgcctgtttcccgaactcttcaccgccgagaacctccggctgcagtacaaccattccggggcttgcaacaagaagcaactggaccccacgcggctgcggctcatccgccactacgtggaagccgtctacccggtggagaagatggaggaggtgtggcactacgaatgtatccccagcatcgatgagaggtgccgccgccccaacaggaaaaaatgcgacatcctcaagaaagcaaagaaagtggagaagtgaaggcccgtgacctgcccagagattcggggtcaccagaggctgagcgatgggcacccttgggactgagcaatacttgggagcacgcctatggcatccacagacaggcaccttatgtccgtggggagtggcttactacatttgcacacgtaaacacccacccaaccgcaagaaagaagccttgagtttggtctcttgtacttacaacttctgtcctatgtgccccggcggggcagcctgagtgtggggagagcaagctgtgagggcagggaccagaggttaggggtcctctctccctggttgtgccctccccagcccctcacagcttataatgcaaacccagcaactctcttgcccctcttcccatattttacatcttccattttgacccatttttttttaattaaaaagaaacccttaaaaaaaatcattgggctctttgggggccattttacttagaaaaaaatctctttaaaagtgccatgttcgtgcacagtggctaatcatagcttcaggtggcatggatactgattttactgaccttgttttttacatctgattttggaagagtcaagatgccccttggatggcagtagaggggatggaatagtgcgaagtcctttacgaccacatgcaagttttcccttctgctctggtgccagggaaggcttccgttcagcttggcctgtccttcaggcgcgttggtagaatgttgtgtcactctttaggcgagaacactggatgatgatgatatgaatgtagacagccgtggaaacacgttcgcagtgtctccatctgagccgtgtccttccgctgcccccattccttctccatacatggttgctggttggagggagtggacatgtttccttggaaaacagtgcaggggcttttggcttcttgttagatttaagggtgggcctctttgagctcaccatgaactgtttacttttccgtgtgtgtatttgtacaaaatccaggttccgggagctttgtggtgacttccccagacctcagtgttagctactccaggcagtactacatcctcattcctcagggcgggcccaggtctgggcccctcttggggataccatgcattggaaggacacaggccattttagatggggtacacatgtcccttcccagggtccactcagaactttcctcttggactctctagaaggtcctgctgtcctatacctggccaccccctgccttggggggcacatgtcttcgttccctcccgactgggaatgtcaggctcctgcaggccagctgcatgctctccaggagcaccaactgggaaatcccctgacaggtaaagtcctttaaaatgatacttttacctacctaactctgggggccaaatgcttaagagggaaaggaaacagtcgaatgcaaacagtgtgtcataccagagtcctggaaaatttattgaatcacacagggtagtcatagaacccctgtgggatggcttaatattttgctactttaaaatgcagagataacagaaacaatctggattttcttcattcagctgataagaacttcagttccagtggctgtatgacataattttgcctgtacccaggagcattttttaaaatacaggattttaaaagcaatgttaagttgctgatctaactagtaaatttgctcctaagtgtcatttacagattatttctgttgaaactgcaaacagatttagaaaggcacagggactgaatgactctctgtcttacacagctactcatgcacacacgcactgcttactaaaagctgaagtgagatgaagggggcctacacgaataacaagttcaacttctttgtgcctggaaaggagggactggagcagccaggagactcactttcccccctcgcttgggcccttctctatgccttagtctctccagcacatgcacacagcatgcacacacacgcaccctacccaaagacagctgtggccctctcccaccacctcccccttcccaccgctggttgttgggggctggaggcgggaggtcccatggaatttgttctggtttctaggatgtaaacgaggactccaagccatgaattgccctgctttctagagggtggaatgttgaccctgcaactttagaagcacaatcatttattaataatttttttgaaactcccatctacccctgttagagaaatcaacaggttctaggaattaaatatgtctctttgtaacccagagcatgttcaatttttggaaaccgtatttcagtgattttcttaataccttacatgtgtagggcatcttcccccagaatcttacagtccctttctgtgaagagaagtggacacacgtgggaactctcaccatctctggactgtcgtcaggaaacgcctgcaggtccttgccctgtctgtatggtgtcctcacttctccatccatacaggtggctccagtgggcatttttttattttaaattttttacatgaagcaatagaagtacaaaatacttattttttcaaaatttaatgtgttccatgaaacctgttggcagtcgctttccttcccccacatctaaattctttggtttttagttgtttgttttttggatttttttttttttttttttggccttgtatcccaaggactaaaagattagcacagacacgttttgatgttgaatgaactagtaagtcacagtaggtggtagtcttcattgatttctctgtaagtttttaaagaatgtatgaagatagtcacgaatgtactgagtgttcgcatcccccttcagttcaccttggctgtgtctacaggacaacaaatgtttgacagggaataaagtcgtgtctggtgtcatttgcgctagcgtgcccctcccctttcggtgttggctccaaaccttcctttccttttatgtttgtggggagtggggaaccacatcagcagcaatcatcaaccaaccaaccaatgggatctacttagtggtgaatagattggctatttaattggtaaaagttgctggtctgaccacaccacagcatgaccactgggttcatttagagatggcctccgtttccaacgttccccacaaatgtttgcttctttcccagtcaagaggggatctcgagactcccgagtggaggtcgtgagcttgcaccccgcctggctgtgtagatcgactgtatagatacatgaagtgggggtgagggccaaggggctattactgctgttgggaaatacttgcctctcgtagatccagccttaatgtttttctgacatcctagtaatagcagaccctgcacaaagtggatatcagacttaatactgtgaggagacaaaataatgagaatagttttaccaaagataatgaaatctcgcatcatgtctgcattttaccatagattggagtgcatccttaggaaactgaatgtaacaaaaacccaggacatttttggaaattgtatgctctctagcaactttgtgtgaatttttatacaaacactgttttatgagttatataaaatgttataaaaatag

SEQ ID NO: 61268 - DNA, 6004 bp, Homo sapiens
atgaactcaactgaattcaccgaagatgtagaagaagttctaaaaagtatcactgtgaaagtggagacagaggctgaagatgctgctctggactgctccgtgaattccaggacttctgagaagcactctgtggacagcgtcctcactgccctgcaggactccagcaaacgaaagcagctggtcagcgatggcctgctagactctgtccccggcgtgaagaggaggcggctgatccccgaggctctcctagcaggcatgcggaaccgtgagaacagctcgccctgccaaggcaatggtgagcaggccggcaggggcaggagcctgggcaatgtgtggcctggagaggaggagccctgcaacgatgccaccaccccttcctacaagaagcctctgtatggcatctcgcacaagatcatggagaagaagaatcctccctcgggggacctgctaaacgtgtacgagctctttgagaaggcaaacgccagcaacagcccctcgtcactgcggctcctgaatgagccacagaagcgggactgtggcagcaccggggcaggcactgacaacgaccccaacatctacttcctgatccagaagatgttctacatgctgaacaccctcacgtccaacatgtcccagctgcacagcaaggtggacctgctctcccttgaggtgagccgcatcaagaagcaggtgagccccactgagatggtggccaaattccagccgccccctgagtaccagctcacagccgcagagctcaagcagatcgtggaccagagcctgtcagggggggacctggcctgccgcttgctggtgcagctcttccccgagctcttcagcgacgtggacttctcccggggctgcagtgcctgtggctttgcggccaagcgcaagctggagtcgctgcacctgcagctcatccgcaactatgtggaggtctactacccctcggtgaaggacacggctgtgtggcaggccgagtgcctgccccagctgaacgacttcttcagccgcttctgggcccagcgggaaatggaggacagccagcccagcggccaggtcgccagcttctttgaggcagagcaggtggaccccggccacttcctggacaacaaagaccaggaggaggccctgtctcttgaccggagcagcaccatcgcctcagaccacgtggtggacacgcaggacctcactgagttcctggacgaagcctcctcaccaggcgagtttgccgtcttcctcctccaccggctcttccccgagctcttcgaccaccgcaagctgggtgaacagtacagctgctacggggacggtggaaagcaggagctggacccgcagcggctgcagatcatccgcaactacacggagatctacttccctgacatgcaggaggaggaggcctggctgcagcagtgtgcccagcgcatcaacgacgagctcgagggcctggggctggacgcgggcagtgaaggcgaccccccgcgtgatgactgctacgactcctccagtctgcccgacgacatctcagtggtcaaggtggaggacagcttcgagggcgagcggccgggtcgccgctccaagaagatctggctggtgcccatcgacttcgacaagttagagatcccccagcctgacttcgaggtgcccggtgccgactgcctgctcagcaaggagcagctacgcagcatctacgagagcagcctgtccatcggcaacttcgcctcgcgcctgctggtgcacctgttccccgagctcttcacgcacgagaacctgcgcaagcagtacaactgcagcggctccctgggcaagaagcagctggacccctcccgcatcaagctcatccgccactacgtgcagctgctctacccacgcgccaaaaacgaccgcgtctggaccctggagttcgtgggcaaactggatgagcgctgccggcgccgggacacggagcaaaggcgctcctaccagcagcagcgcaaggtccacgtgccgggccctgagtgcagagacttgaccagctatgcaatcaaccccgagaggttccgggaggagtttgaggggcccccactgccccccgagaggagcagcaaggacttttgcaagatccccttggacgagctggtggtcccctcgcctgacttcccggtgccttctccctacctgctgtctgacaaggaggtgcgtgagatcgtgcagcagagcctctccgtgggcaactttgccgcccggctcctcgtccgcctgtttcccgaactcttcaccgccgagaacctccggctgcagtacaaccattccggggcttgcaacaagaagcaactggaccccacgcggctgcggctcatccgccactacgtggaagccgtctacccggtggagaagatggaggaggtgtggcactacgaatgtatccccagcatcgatgagaggtgccgccgccccaacaggaaaaaatgcgacatcctcaagaaagcaaagaaagtggagaagtgaaggcccgtgacctgcccagagattcggggtcaccagaggctgagcgatgggcacccttgggactgagcaatacttgggagcacgcctatggcatccacagacaggcaccttatgtccgtggggagtggcttactacatttgcacacgtaaacacccacccaaccgcaagaaagaagccttgagtttggtctcttgtacttacaacttctgtcctatgtgccccggcggggcagcctgagtgtggggagagcaagctgtgagggcagggaccagaggttaggggtcctctctccctggttgtgccctccccagcccctcacagcttataatgcaaacccagcaactctcttgcccctcttcccatattttacatcttccattttgacccatttttttttaattaaaaagaaacccttaaaaaaaatcattgggctctttgggggccattttacttagaaaaaaatctctttaaaagtgccatgttcgtgcacagtggctaatcatagcttcaggtggcatggatactgattttactgaccttgttttttacatctgattttggaagagtcaagatgccccttggatggcagtagaggggatggaatagtgcgaagtcctttacgaccacatgcaagttttcccttctgctctggtgccagggaaggcttccgttcagcttggcctgtccttcaggcgcgttggtagaatgttgtgtcactctttaggcgagaacactggatgatgatgatatgaatgtagacagccgtggaaacacgttcgcagtgtctccatctgagccgtgtccttccgctgcccccattccttctccatacatggttgctggttggagggagtggacatgtttccttggaaaacagtgcaggggcttttggcttcttgttagatttaagggtgggcctctttgagctcaccatgaactgtttacttttccgtgtgtgtatttgtacaaaatccaggttccgggagctttgtggtgacttccccagacctcagtgttagctactccaggcagtactacatcctcattcctcagggcgggcccaggtctgggcccctcttggggataccatgcattggaaggacacaggccattttagatggggtacacatgtcccttcccagggtccactcagaactttcctcttggactctctagaaggtcctgctgtcctatacctggccaccccctgccttggggggcacatgtcttcgttccctcccgactgggaatgtcaggctcctgcaggccagctgcatgctctccaggagcaccaactgggaaatcccctgacaggtaaagtcctttaaaatgatacttttacctacctaactctgggggccaaatgcttaagagggaaaggaaacagtcgaatgcaaacagtatgtcataccagagtcctggaaaatttattgaatcacacagggtagtcatagaacccctgtgggatggcttaatattttgctactttaaaatgcagagataacagaaacaatctggattttcttcattcagctgataagaacttcagttccagtggctgtatgacataattttgcctgtacccaggagcattttttaaaatacaggattttaaaagcaatgttaagttgctgatctaactagtaaatttgctcctaagtgtcatttacagattatttctgttgaaactgcaaacagatttagaaaggcacagggactgaatgactctctgtcttacacagctactcatgcacacacgcactgcttactaaaagctgaagtgagatgaagggggcctacacgaataacaagttcaacttctttgtgcctggaaaggagggactggagcagccaggagactcactttcccccctcgcttgggcccttctctatgccttagtctctccagcacatgcacacagcatgcacacacacgcaccctacccaaagacagctgtggccctctcccaccacctcccccttcccaccgctggttgttgggggctggaggcgggaggtcccatggaatttgttctggtttctaggatgtaaacgaggactccaagccatgaattgccctgctttctagagggtggaatgttgaccctgcaactttagaagcacaatcatttattaataatttttttgaaactcccatctacccctgttagagaaatcaacaggttctaggaattaaatatgtctctttgtaacccagagcatgttcaatttttggaaaccgtatttcagtgattttcttaataccttacatgtgtagggcatcttcccccagaatcttacagtccctttctgtgaagagaagtggacacacgtgggaactctcaccatctctggactgtcgtcaggaaacgcctgcaggtccttgccctgtctgtatggtgtcctcacttctccatccatacaggtggctccagtgggcatttttttattttaaattttttacatgaagcaatagaagtacaaaatacttattttttcaaaatttaatgtgttccatgaaacctgttggcagtcgctttccttcccccacatctaaattctttggtttttagttgtttgttttttggatttttttttttttttttttggccttgtatcccaaggactaaaagattagcacagacacgttttgatgttgaatgaactagtaagtcacagtaggtggtagtcttcattgatttctctgtaagtttttaaagaatgtatgaagatagtcacgaatgtactgagtgttcgcatcccccttcagttcaccttggctgtgtctacaggacaacaaatgtttgacagggaataaagtcgtgtctggtgtcatttgcgctagcgtgcccctcccctttcggtgttggctccaaaccttcctttccttttatgtttgtggggagtggggaaccacatcagcagcaatcatcaaccaaccaaccaatgggatctacttagtggtgaatagattggctatttaattggtaaaagttgctggtctgaccacaccacagcatgaccactgggttcatttagagatggcctccgtttccaacgttccccacaaatgtttgcttctttcccagtcaagaggggatctcgagactcccgagtggaggtcgtgagcttgcaccccgcctggctgtgtagatcgactgtatagatacatgaagtgggggtgagggccaaggggctattactgctgttgggaaatacttgcctctcgtagatccagccttaatgtttttctgacatcctagtaatagcagaccctgcacaaagtggatatcagacttaatactgtgaggagacaaaataatgagaatagttttaccaaagataatgaaatctcgcatcatgtctgcattttaccatagattggagtgcatccttaggaaactgaatgtaacaaaaacccaggacatttttggaaattgtatgctctctagcaactttgtgtgaatttttatacaaacactgttttatgagttatataaaatgttataaaaatag

SEQ ID NO: 61269 - DNA, 1365 bp, Homo sapiens
agaaacagaatcctaactatttctgaggaaactgcaggtccaaaatgtggctgcttttaacaatggcaagtttgatatctgtactggggactacacatggtttgtttggaaaattacatcctggaagccctgaagtgactatgaacattagtcagatgattacttattggggatacccaaatgaagaatatgaagttgtgactgaagatggttatattcttgaagtcaatagaattccttatgggaagaaaaattcagggaatacaggccagagacctgttgtgtttttgcagcatggtttgcttgcatcagccacaaactggatttccaacctgccgaacaacagccttgccttcattctggcagatgctggttatgatgtgtggctgggcaacagcagaggaaacacctgggccagaagaaacttgtactattcaccagattcagttgaattctgggctttcagctttgatgaaatggctaaatatgaccttccagccacaatcgacttcattgtaaagaaaactggacagaagcagctacactatgttggccattcccagggcaccaccattggttttattgccttttccaccaatcccagcctggctaaaagaatcaaaaccttctatgctctagctcctgttgccactgtgaagtatacaaaaagccttataaacaaacttagatttgttcctcaatccctcttcaagtttatatttggtgacaaaatattctacccacacaacttctttgatcaatttcttgctactgaagtgtgctcccgtgagatgctgaatctcctttgcagcaatgccttatttataatttgtggatttgacagtaagaactttaacacgagtcgcttggatgtgtatctatcacataatccagcaggaacttctgttcaaaacatgttccattggacccaggctgttaagtctgggaaattccaagcttatgactggggaagcccagttcagaataggatgcactatgatcagtcccaacctccctactacaatgtgacagccatgaatgtaccaattgcagtgtggaacggtggcaaggacctgttggctgacccccaagatgttggccttttgcttccaaaactccccaatcttatttaccacaaggagattcctttttacaatcacttggactttatctgggcaatggatgcccctcaagaagtttacaatgacattgtttctatgatatcagaagataaaaagtagttctggatttaaagaattatccgtttgtttttccaaaatactttattctctcatacatagtattttcataatgtttgacatgcagtgcttctttctgtaattttgactttagaaatatattggc

SEQ ID NO: 61270 - DNA, 2380 bp, Homo sapiens
acagtgcagccctgcccttctgtccaccctacagagcccacggccatggcagcccaggcagctggtgtatctaggcagcgggcagccactcaaggtcttggctccaaccaaaacgctttgaagtacttgggccaggatttcaagaccctgaggcaacagtgcttggactcaggggtcctatttaaggaccctgagttcccagcatgtccatcagctttgggctacaaggatcttggaccaggctctccgcaaactcaaggcatcatctggaagcggcccacggagttgtgtcccagccctcagtttatcgttggtggagccacgcgcacagacatttgtcagggtggtctaggtgactgctggcttctggctgccattgcctccctgaccctgaatgaagagctgctttaccgggtggtccccagggaccaggacttccaggagaactatgcgggaatctttcactttcagttctggcagtacggagagtgggtggaggtggtcattgacgacaggctgcccaccaagaatggacagctgctcttcctacactcggaacaaggcaatgaattctggagtgccctgctggagaaagcctatgccaagcttaatggttgttatgaggctctcgctggaggttccacagtggaggggtttgaggatttcacaggtggcatctctgagttttatgacctgaagaaaccaccagccaatctatatcagatcatccggaaggccctctgtgcggggtctctgctgggctgctccattgatgtctccagtgcagccgaagccgaagccatcaccagccagaagctggttaagagtcatgcgtactctgtcactggagtcgaagaggtgaatttccagggccatccagagaagctgatcagactcaggaatccatggggtgaagtggagtggtcgggagcctggagcgatgatgcaccagagtggaatcacatagacccccggcggaaggaagaactggacaagaaagttgaggatggagaattctggatgtcactttcagatttcgtgaggcagttctctcggttggagatctgcaacctgtccccggactctctgagtagcgaggaggtgcacaaatggaacctggtcctgttcaacggccactggacccggggctccacagctgggggctgccagaactacccagccacgtactggaccaatccccagttcaaaatccgtttggatgaagtggatgaggaccaggaggagagcatcggtgaaccctgctgtacagtgctgctgggcctgatgcagaaaaatcgcaggtggcggaagcggataggacaaggcatgcttagcatcggctatgccgtctaccaggttcccaaggagctggagagtcacacggacgcacacttgggccgggatttcttcctggcctaccagccctcagcccgcaccagcacctacgtcaacctgcgggaggtctctggccgggcccggctgccccctggggagtacctggtggtgccatccacatttgaacccttcaaagacggcgagttctgcttgagagtgttctcagagaagaaggcccaggccctagaaattggggatgtggtagctggaaacccatatgagccacatcccagtgaggtggatcaggaagatgaccagttcaggaggctgtttgagaagttggcagggaaggattctgagattactgccaatgcactcaagatacttttgaatgaggcgttttccaagagaacagacataaaattcgatggattcaacatcaacacttgcagggaaatgatcagtctgttggatagcaatggaacgggcactttgggggcggtggaattcaagacgctctggctgaagattcagaagtatctggagatctattgggaaactgattataaccactcgggcaccatcgatgcccacgagatgaggacagccctcaggaaggcaggtttcaccctcaacagccaggtgcagcagaccattgccctgcggtatgcgtgcagcaagcttggcatcaactttgacagcttcgtggcttgtatgatccgcctggagaccctcttcaaactattcagccttctggacgaagacaaggatggcatggttcagctctctctggccgagtggctgtgctgcgtgttggtctgacccggggtttcggacatcagtgacactccctgccccactgcttgcttcttgtcaccccttctctacaattttgtgaacatttatgctccagtggcattcactggttgttcatacctttcttgccctgggtctatttcagcagcactgagctatgagctatgtaagccgacccggtgggcccagtggagggaaagcaatcaattaaagttgtgagccagaatgg

SEQ ID NO: 61271 - DNA, 1020 bp, Homo sapiens
cacaagagaaagaaatctgtaaggcatgtagaatttggactcaatcatgttggtctttaacgtgcctagagcaatggaacgggcactttgggggcggtggaattcaagacgctctggctgaagattcagaagtatctggtaactctcttttccttctgggcatcctctcctctgttctaatcctcccttacactcattcctggtccattgtattctgaccacatccttaatcatggtcaaaactattgagtcctgggcacattggtcatgaaggaacaagaaggcaatgagagactctcatgccaaccactgccctgaaagccctgctgttcagacagcaaaggggccagcactggccaagctcttatgcttgctctgaaaccttcttgggaggagtcaatagggtctccttttgaaagtgtccctggccttttgagaaagcagtgtggtggagggagatggttctggcaggggccgtgaatggttgttttctacttgggatttctttcctgctttaggagatctattgggaaactgattataaccactcgggcaccatcgatgcccacgagatgaggacagccctcaggaaggcaggtttcaccctcaacagccaggtgcagcagaccattgccctgcggtatgcgtgcagcaagcttggcatcaactttgacagcttcgtggcttgtatgatccgcctggagaccctcttcaaactattcagccttctggacgaagacaaggatggcatggttcagctctctctggccgagtggctgtgctgcgtgttggtctgacccggggtttcggacatcagtgacactccctgccccactgcttgcttcttgtcaccccttctctacaattttgtgaacatttatgctccagtggcattcactggttgttcatacctttcttgccctgggtctatttcagcagcactgagctatgagctatgtaagccgacccggtgggcccagtggagggaaagcaatcaattaaagttgtgagccagaatgg

SEQ ID NO: 61272 - DNA, 1740 bp, Homo sapiens
agacttcaccagcccactcggtcccagccttgtacgcaaagagacgccaaggacgcgctctcccgcgtccaggcagccccagcttgctggcttgcctgcccgcctgcgtgcagcactcggccggcgtgcagcatgaccctgtggaacggcgtactgcctttttacccccagccccggcatgccgcaggcttcagcgttccactgctcatcgttattctagtgtttttggctctagcagcaagcttcctgctcatcttgccggggatccgtggccactcggagtatctgcattcccacctcctcccctcggagatcaggctggggcctccctcttctgagggaggtgacccctgcgtgcctagcacttctggactcactgagcctcaccaagcagtgactggaccaggaggcagaaccaggaccaggcgccagacagctaggggagtgaaggtggtggaagagtgccaggaagtgggggtggaggggaggtgctgttagggtagatgggaaatggggctagggaggtgaaagtgcgtggtcacaaaatatcagaaatgccagtagcccagagggacttgcaggaaaagcgtgcctaacattagtctcaaaagtctggatataactaaagatccaggtgaagtggggtcaagggtggtcttggggactctggtttggcagggctcaggcctgacccgggtgcctattcctgcagcgctggttttggttggtgagagttcttctcagtctgttcataggcgcagaaattgtggctgtgcacttcagtgcagaatggttcgtgggtacagtgaacaccaacacatcctacaaagccttcagcgcagcgcgcgttacagcccgtgtcggtctgctcgtgggcctggagggcattaatattacactcacagggaccccagtgcatcagctgaacgagaccattgactacaacgagcagttcacctggcgtctgaaagagaattacgccgcggagtacgcgaacgcactggagaaggggctgccggacccagtgctctacctggcggagaagttcacaccgagtagcccttgcggcctgtaccaccagtaccacctggcgggacactacgcctcggccacgctatgggtggcgttctgcttctggctcctctccaacgtgctgctctccacgccggccccgctctacggaggcctggcactgctgaccaccggagccttcgcgctcttcggggtcttcgccttggcctccatctctagcgtgccgctctgcccgctccgcctaggctcctccgcgctcaccactcagtacggcgccgccttctgggtcacgctggcaaccggcgtcctgtgcctcttcctcggaggggccgtggtgagtctccagtatgttcggcccagcgctcttcgcacccttctggaccaaagcgccaaggactgcagccaggagagagggggctcacctcttatcctcggcgacccactgcacaagcaggccgctctcccagacttaaaatgtatcaccaccaacctgtgagggggacccaatctggactccttccccgccttgggacatcgcaggccgggaagcagtgcccgccaggcctgggccaggagagctccaggaagggcactgagcgctgctggcgcgaggcctcggacatccgcaggcaccagggaaagtctcctggggcgatctgtaaataaacctttttttcttttgttttttaaaaaaaaaaaaaaaaaaca

SEQ ID NO: 61273 - DNA, 888 bp, Homo sapiens
atgctacctcaatattgggtggatgaagaagactctgggcagcgaggcattgagaaaaaacatcaaacacaagttccattaaatgtggctacagtgtttgctatgctgacactcttttgtgatagaacaaattcttcacagaaaatggaagagtttgtgcagagctctggagaaaatggtgtcgtggcagtcttgcttaagtctatggtcagtaacatcacagaagaaagggccaacgtgattgcatcagctcttgcccagattccacgaaagttgattgacaatttctttagagttctaacatcttatagctttggcattctactcatggaacaagatattttctttaccccaacaggttctgtggatggaaagagaccaaatactttagcatccaatactcagctgtacaagtggatatcccagaatgaccttcttggtcatccaaaaactaaatcttttatgactcatggtgaaaccagtggcatctatgaggcaatctaccatgggatccctatggtgggcattcctttgtttgcagatcaacctgataacattgctcacatgaaggccctcaatgtggacatcaggaccatgtcaagtacagatttgctcaatgcactgaagacagtcattaatgaccctgtctacaaagagaatgctatgaagttatcaataattcgccatgatttgccaattaagcccctggatcaagcagccttctggattgagtttgtcatgcagcacaaaggagccaagcaccttcgggttgcagcccacgacctcacctggttccaataccacaacttgcatgtgattaggttcctgctggcctatgtgtcaactgtgatcttcatcatcacaagatgttgcctgttttctttctga

SEQ ID NO: 61274 - DNA, 965 bp, Homo sapiens
cccagacatttcaggaggtcgggaaatttttaaacccaggcagcttcctggcagtgccatttggagcatcaaaatgggccatgggtctggatttccaggaaagcggagacctcgaggtgcaggactgtcggggcgaggtggccgaggcaggtcaaagctgaaaagtggaatcggagctgttgtattgcctggggtgtctactgcagatatttcatcaaataaggatgatgaagaaaactctgtgctcgatatggttgtgttgttttctagcagtgacaagttcactttgaatcaggatatatgtgtagtttgtggcagttttggccaaggagcagaaggaagattacttgcctgttctcagtgtggtcagtgttaccatccatactgtgtcagtattaagatcactaaagtggttcttagcaaaggttggaggtgtcttgagtgcactgtgtgtgaggcctgtgggaaggcaactgacccaggaagactcctgctgtgtgatgattgtgacataagttatcacacctactgcctagaccctccattgcagacagttcccaaaggaggctggaagtgcaaatggtgtgtttggtgcagacactgtggagcaacatctgcaggtctaagatgtgaatggcagaacaattacacacagtgcgctccttgtgcaagtttatcttcctgtccagtctgctattgaaactatagagaagaagatcttattctgcaatgaagacaatgtgatagatggatgcatgcagttcgtcagaacttaaatactgaggaagaagtggaaaatgtagcagacattggttttgattgcaacatgtgcagaccctatatgcctgcgtctaatgtgccttcctcagactgctgtggatcttcacttgtagcacaaattgtcacaaaagtaaaagagctaacccacccaagacttatacccaggatggtgtgtgtttgactga

SEQ ID NO: 61275 - DNA, 2430 bp, Homo sapiens
catctttctccacctccttggtgactccaagtactcacacggtcatcatccctacccacacacagatggccacttctgcctccatccactcaatgccaacaggcaccattcctccaccgaccacgatcaaggccacagggtccacccacacagccccaccaatgacaccgaccaccagtgggaccagccaatccccaagctcatttagcacggccaaaacttctacatccctaccttaccacacttcctcaacacaccatcctgaagtcaccccaacttctaccaccaacatcacccccaaacacaccagtacaggcaccagaacccctgtggcccacaccacctcggccagcagcagcaggctacccacacccttcaccacacactccccacctacagggagcagtcccttctcttccacaggtcctatgactgcaacatccttccagaccaccactacctatccaaccccatcacaccctcagaccacacttcccactcacgttccacctttctccacctccttggtgactccaagtactcacacagtcatcatcactacccacacacagatggccacttctgcctccatccactcaacgccaacaggcaccgttcctccaccaacaacgctcaaggccacagggtccacccacacagccccaccaatgacagtgaccaccagtgggaccagccaaacccacagctcattcagcacagctacagcctcttcttccttcatatcctcctcgtcttggctgcctcagaactctagctcaaggccaccgtcatcacctatcaccacacaactcccccacttgagttctgcaaccactcctgtttccacaactaatcagctgtcctcctcattttctcccagtccttctgccccctctactgtttcttcttatgtgccctcctcccactcctctccccagacttcatcgccttctgttggcacatcttcctctttcgtgtccgcccccgtgcactccacaaccctgagctcggggtcacactcctcattgtccactcatcccacgactgcatcagtgtctgcatctcctctttttccttcttctccagctgcctctactaccattagggccactctcccccacactatctcctctcctttcaccctctctgctctactccccatatccactgttaccgtgtctcccaccccatccagccacctagcctccagcaccattgcatttccgtccacgcccaggaccacggccagcacccacaccgcccctgccttctcctctcagtccaccacctcgcggtccacttctctcaccacccgagttcccacatcaggctttgtgtcactcacctcgggggtgacgggtatccccacctctccagtcaccaaccttaccaccaggcaccctggtcccaccttgtcgcctaccacacggttcctgaccagctccctcactgcccatggaagcacccctgcttctgccccggtatcttctctcgggacacctacgcccacctcacccggggtctgcagtgtgcgggagcagcaggaggagatcacgttcaaggggtgcatggcgaacgtgacggtaacccgctgtgagggcgcctgcatttccgctgccagcttcaacatcatcacccagcaggtggatgcccgctgcagctgctgccgccccctccactcctatgagcagcagctggagctgccctgccccgatcccagcacgcctggccggcggctcgtactcaccctgcaggtgttcagccactgcgtgtgcagctctgtggcctgtggagactagcagggtcgctgcctgctctcctggggctgaaggactgcagatgacagacaggaaaacacccaccagcccccttcccgcttgtgccagcagctgctttcctggtcaccaggcctggcccccaagtgccctgggccgtggctccctggggcaccggttggagaggggctgccaagcaggggctcagactaccacactcctgcagaccctgagccagcagagagggactgaggcggacagtggtcacggacctcccaggcacacagggcactcccgaccacccctgcccaccgtccaacacctcccagcccctgaacttggccccagccctgctgggcccagaaccctgcagatgaagccacagagcaggcgctcgaccagacccatcaggggcgaggagggcacggaaacctgtgccgagatgggggcaagaggcccaggcagccaccagcacagagaagaggagatccccagagtcagggagggcagagggtggcagcgagggcagggcagccgcccccgctcccagccaggcagaaggcccccaccagcaccacacccatccccagcagcctgtccttgggagagggcgtcacccggtcagagactccaaataaaccggttcttgtcaagg

SEQ ID NO: 61276 - DNA, 1702 bp, Homo sapiens
acatcacccccaaacacaccagtacaggcaccagaacccctgtggcccacaccacctcggccagcagcagcaggctacccacacccttcaccacacactccccacctacagggagcagtcccttctcttccacaggtcctatgactgcaacatccttctgccccctctactgtttcttcttatgtgccctcctcccactcctctccccagacttcatcgccttctgttggcacatcttcctctttcgtgtccgcccccgtgcactccacaaccctgagctcggggtcacactcctcattgtccactcatcccacgactgcatcagtgtctgcatctcctctttttccttcttctccagctgcctctactaccattagggccactctcccccacactatctcctctcctttcaccctctctgctctactccccatatccactgttaccgtgtctcccaccccatccagccacctagcctccagcaccattgcatttccgtccacgcccaggaccacggccagcacccacaccgcccctgccttctcctctcagtccaccacctcgcggtccacttctctcaccacccgagttcccacatcaggctttgtgtcactcacctcgggggtgacgggtatccccacctctccagtcaccaaccttaccaccaggcaccctggtcccaccttgtcgcctaccacacggttcctgaccagctccctcactgcccatggaagcacccctgcttctgccccggtatcttctctcgggacacctacgcccacctcacccggggtctgcagtgtgcgggagcagcaggaggagatcacgttcaaggggtgcatggcgaacgtgacggtaacccgctgtgagggcgcctgcatttccgctgccagcttcaacatcatcacccagcaggtggatgcccgctgcagctgctgccgccccctccactcctatgagcagcagctggagctgccctgccccgatcccagcacgcctggccggcggctcgtactcaccctgcaggtgttcagccactgcgtgtgcagctctgtggcctgtggagactagcagggtcgctgcctgctctcctggggctgaaggactgcagatgacagacaggaaaacacccaccagcccccttcccgcttgtgccagcagctgctttcctggtcaccaggcctggcccccaagtgccctgggccgtggctccctggggcaccggttggagaggggctgccaagcaggggctcagactaccacactcctgcagaccctgagccagcagagagggactgaggcggacagtggtcacggacctcccaggcacacagggcactcccgaccacccctgcccaccgtccaacacctcccagcccctgaacttggccccagccctgctgggcccagaaccctgcagatgaagccacagagcaggcgctcgaccagacccatcaggggcgaggagggcacggaaacctgtgccgagatgggggcaagaggcccaggcagccaccagcacagagaagaggagatccccagagtcagggagggcagagggtggcagcgagggcagggcagccgcccccgctcccagccaggcagaaggcccccaccagcaccacacccatccccagcagcctgtccttgggagagggcgtcacccggtcagagactccaaataaaccggttcttgtcaagg

SEQ ID NO: 61277 - DNA, 625 bp, Homo sapiens
atgcattcaacactcagtgcggattatagatccaagaacacagactttcttaaaagcaatggaacgggcactttgggggcggtggaattcaagacgctctggctgaagattcagaagtatctggagatctattgggaaactgattataaccactcgggcaccatcgatgcccacgagatgaggacagccctcaggaaggcaggtttcaccctcaacagccaggtgcagcagaccattgccctgcggtatgcgtgcagcaagctcggcatcaactttgacagcttcgtggcttgtatgatccgcctggagaccctcttcaaactattcagccttctggacgaagacaaggatggcatggttcagctctctctggccgagtggctgtgctgcgtgttggtctgacccggggtttcggacatcagtgacactccctgccccactgcttgcttcttgtcaccccttctctacaattttgtgaacatttatgctccagtggcattcactggttgttcatacctttcttgccctgggtctatttcagcagcactgagctatgagctatgtaagccgacccggtgggcccagtggagggaaagcaatcaattaaagttgtgagccagaatgg

SEQ ID NO: 61278 - DNA, 4177 bp, Homo sapiens
caaaacaagagaacatactaaatgattctatttttttatttatgatttcatgactaccattaagaaaatataacctgttgggaaactgtttctgccttgatgatgttgtacagacaagagataaacagtgaggaatatgcttagatgtattgggaaagacacgggtctgtggcattgtcacaagggtacacgaatactgagagtgaatgctgaaggaatgatccccattggtggtgaccctcaggtgagactagggtgcctgtgtttcagcaaagcctgggcaattggaatgcagggctcctaagattccatgacacccccaccttctaattctgttttgcaactgcagacggttacctggcacgctggccacaatctacctcactcttatcagagtctgcgctactgacagtgctttcagctctgagttgaggcacctcgaaccttgtttttgtggtgaaggatcctaaagtgctgtggggagtgatcacatttttgacaacagtaatccctgactccacctcttctgccacaaacgtcagcatggtggtatcagccggccctttgtccagcgagaaggcagagatgaacattctagaaatcaatgagaaattgcgcccccagttggcagagaagaaacagcagttcagaaacctcaaagagaaatgttttctaactcaactggccggcttcctggccaaccgacagaagaaatacaaatatgaagagtgcaaagatctcataaaatttatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactgacacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataagaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagagcctgaagtcttgcaggactcactggatagatgttattcaactccttcaggttgtcttgaactgactgactcatgccagccctacagaagtgccttttacgtattggagcaacagcgtgttggcttggctattgacatggatgaaattgaaaagtaccaagaagtggaagaagaccaagacccatcatgccccaggctcagcagggagctgctggatgagaaagagcctgaagtcttgcaggactcactggatagatgttattcgactccttcagattatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatattattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagatgacaacccaccatgccccaggctcaacggcgtgctgatggaagtggaagagcctgaagtcttacaggactcactggatagatgttattcgactcagtcaatgtactttgaactacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagctcttactaagccgagagatgtcattcctgcaggcaggacctataggcacgagaagatttgaatgaaagtacagttccatttggaagcccagacataggatgggtcagtgagcatggctctattcctattctcaaaccatgccattggcaacctgtgctcaatctgaagacaatggacccatgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccattatgatatcagcactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttctggattgttttttacattcagtgttataatatttgattatgctgattggttttggtgggtactgatgcgaattaataaaaacatttcatttc

SEQ ID NO: 61279 - DNA, 3285 bp, Homo sapiens
atgttggctagtatttttgcaagaaaagaaattgaaaaagtaaatatattatatcaaaatattgggaaaatggggcccttaatacacaagatctgtgtctgcactgcgtcaagaactctcttcacttgaatgctgcatgtaaaattcaacccaatttatgcaaagtagttgaagccctgtgtcagttctctgtgctgcaagtcatgatggtagtttacagggagagtctgggtgccctgagttggctcatctgtggcaaatgtactgagcacatgctgcccatttttgctgtgtccccagagcagtcaccctccaccctgtatttagaaggatagttttatttctcttgaaggaaaaatgcctttggtttctgtgaccactccattctgtctcccatcagatcatctgggaggttttgttgtctaatgtctgttggttaaatcttctatcatccctgtcctgcctggctcatcaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagagcctgaagtcttgcaggactcactggatagatgttattcaactccttcaggttgtcttgaactgactgactcatgccagccctacagaagtgccttttacgtattggagcaacagcgtgttggcttggctattgacatggatgaaattgaaaagtaccaagaagtggaagaagaccaagacccatcatgccccaggctcagcagggagctgctggatgagaaagagcctgaagtcttgcaggactcactggatagatgttattcgactccttcagattatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatattattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagatgacaacccaccatgccccaggctcaacggcgtgctgatggaagtggaagagcctgaagtcttacaggactcactggatagatgttattcgactcagtcaatgtactttgaactacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagctcttactaagccgagagatgtcattcctgcaggcaggacctataggcacgagaagatttgaatgaaagtacagttccatttggaagcccagacataggatgggtcagtgagcatggctctattcctattctcaaaccatgccattggcaacctgtgctcaatctgaagacaatggacccatgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccattatgatatcagcactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttctggattgttttttacattcagtgttataatatttgattatgctgattggttttggtgggtactgatgcgaattaataaaaacatttcatttc

SEQ ID NO: 61280 - DNA, 3260 bp, Homo sapiens
agttttcagttgaacggtgacccatgcctagatgttcatgtctctgttgcacattgggctgactgtgcttgcagactgtgaagtgggaaatatctgaacgaacacttctgtatttacagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataagaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagagcctgaagtcttgcaggactcactggatagatgttattcaactccttcaggttgtcttgaactgactgactcatgccagccctacagaagtgccttttacgtattggagcaacagcgtgttggcttggctattgacatggatgaaattgaaaagtaccaagaagtggaagaagaccaagacccatcatgccccaggctcagcagggagctgctggatgagaaagagcctgaagtcttgcaggactcactggatagatgttattcgactccttcagattatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatattattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagatgacaacccaccatgccccaggctcaacggcgtgctgatggaagtggaagagcctgaagtcttacaggactcactggatagatgttattcgactcagtcaatgtactttgaactacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagctcttactaagccgagagatgtcattcctgcaggcaggacctataggcacgagaagatttgaatgaaagtacagttccatttggaagcccagacataggatgggtcagtgagcatggctctattcctattctcaaaccatgccattggcaacctgtgctcaatctgaagacaatggacccatgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccattatgatatcagcactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttctggattgttttttacattcagtgttataatatttgattatgctgattggttttggtgggtactgatgcgaattaataaaaacatttcatttc

SEQ ID NO: 61281 - DNA, 4275 bp, Homo sapiens
caaaacaagagaacatactaaatgattctatttttttatttatgatttcatgactaccattaagaaaatataacctgttgggaaactgtttctgccttgatgatgttgtacagacaagagataaacagtgaggaatatgcttagatgtattgggaaagacacgggtctgtggcattgtcacaagggtacacgaatactgagagtgaatgctgaaggaatgatccccattggtggtgaccctcaggtgagactagggtgcctgtgtttcagcaaagcctgggcaattggaatgcagggctcctaagattccatgacacccccaccttctaattctgttttgcaactgcagacggttacctggcacgctggccacaatctacctcactcttatcagagtctgcgctactgacagtgctttcagctctgagttgaggcacctcgaaccttgtttttgtggtgaaggatcctaaagtgctgtggggagtgatcacatttttgacaacagtaagttaagaatttcagttacttacatccctcagtcctgattaaacctatttgatttcaccagtttttaacccatcatatgtttgggtttcttctccccagtccctgactccacctcttctgccacaaacgtcagcatggtggtatcagccggccctttgtccagcgagaaggcagagatgaacattctagaaatcaatgagaaattgcgcccccagttggcagagaagaaacagcagttcagaaacctcaaagagaaatgttttctaactcaactggccggcttcctggccaaccgacagaagaaatacaaatatgaagagtgcaaagatctcataaaatttatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactgacacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataagaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagagcctgaagtcttgcaggactcactggatagatgttattcaactccttcaggttgtcttgaactgactgactcatgccagccctacagaagtgccttttacgtattggagcaacagcgtgttggcttggctattgacatggatgaaattgaaaagtaccaagaagtggaagaagaccaagacccatcatgccccaggctcagcagggagctgctggatgagaaagagcctgaagtcttgcaggactcactggatagatgttattcgactccttcagattatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatattattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagatgacaacccaccatgccccaggctcaacggcgtgctgatggaagtggaagagcctgaagtcttacaggactcactggatagatgttattcgactcagtcaatgtactttgaactacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagctcttactaagccgagagatgtcattcctgcaggcaggacctataggcacgagaagatttgaatgaaagtacagttccatttggaagcccagacataggatgggtcagtgagcatggctctattcctattctcaaaccatgccattggcaacctgtgctcaatctgaagacaatggacccatgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccattatgatatcagcactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttctggattgttttttacattcagtgttataatatttgattatgctgattggttttggtgggtactgatgcgaattaataaaaacatttcatttc

SEQ ID NO: 61282 - DNA, 3089 bp, Homo sapiens
caaaacaagagaacatactaaatgattctatttttttatttatgatttcatgactaccattaagaaaatataacctgttgggaaactgtttctgccttgatgatgttgtacagacaagagataaacagtgaggaatatgcttagatgtattgggaaagacacgggtctgtggcattgtcacaagggtacacgaatactgagagtgaatgctgaaggaatgatccccattggtggtgaccctcaggtgagactagggtgcctgtgtttcagcaaagcctgggcaattggaatgcagggctcctaagattccatgacacccccaccttctaattctgttttgcaactgcagacggttacctggcacgctggccacaatctacctcactcttatcagagtctgcgctactgacagtgctttcagctctgagttgaggcacctcgaaccttgtttttgtggtgaaggatcctaaagtgctgtggggagtgatcacatttttgacaacatccctgactccacctcttctgccacaaacgtcagcatggtggtatcagccggccctttgtccagcgagaaggcagagatgaacattctagaaatcaatgagaaattgcgcccccagttggcagagaagaaacagcagttcagaaacctcaaagagaaatgttttctaactcaactggccggcttcctggccaaccgacagaagaaatacaaatatgaagagtgcaaagatctcataaaatttatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactgacacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataagaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagagcctgaagtcttgcaggactcactggatagatgttattcaactccttcaggttgtcttgaactgactgactcatgccagccctacagaagtgccttttacgtattggagcaacagcgtgttggcttggctattgacatggatgaaattgaaaagtaccaagaagtggaagaagaccaagacccatcatgccccaggctcagcagggagctgctggatgagaaagagcctgaagtcttgcaggactcactggatagatgttattcgactccttcagattatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatattattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagatgacaacccaccatgccccaggctcaacggcgtgctgatggaagtggaagagcctgaagtcttacaggactcactggatagatgttattcgactcagtcaatgtactttgaactacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagctcttactaagccgagagatgtcattcctgcaggcaggacctataggcacgagaagatttgaatgaaagtacagttccatttggaagcccagacataggatgggtcagtgagcatggctctattcctattctcaaaccatgccattggcaacctgtgctcaatctgaagacaatggacccatgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaagtgtctgctgttgcaaaaagaagaaaacattctctgcctgagttttaatttttgtccaaagttaattttaatctatacaattaaaaccttttgcctatcactctggacttctggattgttttttacattcagtgttataatatttgattatgctgattggttttggtgggtactgatgcgaattaataaaaacatttcat

SEQ ID NO: 61283 - DNA, 2940 bp, Homo sapiens
caaaacaagagaacatactaaatgattctatttttttatttatgatttcatgactaccattaagaaaatataacctgttgggaaactgtttctgccttgatgatgttgtacagacaagagataaacagtgaggaatatgcttagatgtattgggaaagacacgggtctgtggcattgtcacaagggtacacgaatactgagagtgaatgctgaaggaatgatccccattggtggtgaccctcaggtgagactagggtgcctgtgtttcagcaaagcctgggcaattggaatgcagggctcctaagattccatgacacccccaccttctaattctgttttgcaactgcagacggttacctggcacgctggccacaatctacctcactcttatcagagtctgcgctactgacagtgctttcagctctgagttgaggcacctcgaaccttgtttttgtggtgaaggatcctaaagtgctgtggggagtgatcacatttttgacaacatccctgactccacctcttctgccacaaacgtcagcatggtggtatcagccggccctttgtccagcgagaaggcagagatgaacattctagaaatcaatgagaaattgcgcccccagttggcagagaagaaacagcagttcagaaacctcaaagagaaatgttttctaactcaactggccggcttcctggccaaccgacagaagaaatacaaatatgaagagtgcaaagatctcataaaatttatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactgacacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataagaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagagcctgaagtcttgcaggactcactggatagatgttattcaactccttcaggttgtcttgaactgactgactcatgccagccctacagaagtgccttttacgtattggagcaacagcgtgttggcttggctattgacatggatgaaattgaaaagtaccaagaagtggaagaagaccaagacccatcatgccccaggctcagcagggagctgctggatgagaaagagcctgaagtcttgcaggactcactggatagatgttattcgactccttcagattatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatattattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagatgacaacccaccatgccccaggctcaacggcgtgctgatggaagtggaagagcctgaagtcttacaggactcactggatagatgttattcgactcagtcaatgtactttgaactacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagctcttactaagccgagagatgtcattcctgcaggcaggacctataggcacgagaagatttgaatgaaagtacagttccatttggaagcccagacataggatgggtcagtgagcatggctctattcctattctcaaaccatgccattggcaacctgtgctcaatctgaagacaatggacccatgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctgagatt

SEQ ID NO: 61284 - DNA, 4786 bp, Homo sapiens
caaaacaagagaacatactaaatgattctatttttttatttatgatttcatgactaccattaagaaaatataacctgttgggaaactgtttctgccttgatgatgttgtacagacaagagataaacagtgaggaatatgcttagatgtattgggaaagacacgggtctgtggcattgtcacaagggtacacgaatactgagagtgaatgctgaaggaatgatccccattggtggtgaccctcaggtgagactagggtgcctgtgtttcagcaaagcctgggcaattggaatgcagggctcctaagattccatgacacccccaccttctaattctgttttgcaactgcagacggttacctggcacgctggccacaatctacctcactcttatcagagtctgcgctactgacagtgctttcagctctgagttgaggcacctcgaaccttgtttttgtggtgaaggatcctaaagtgctgtggggagtgatcacatttttgacaacatccctgactccacctcttctgccacaaacgtcagcatggtggtatcagccggccctttgtccagcgagaaggcagagatgaacattctagaaatcaatgagaaattgcgcccccagttggcagagaagaaacagcagttcagaaacctcaaagagaaatgttttctaactcaactggccggcttcctggccaaccgacagaagaaatacaaatatgaagagtgcaaagatctcataaaatttatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactgacacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataagaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagagcctgaagtcttgcaggactcactggatagatgttattcaactccttcaggttgtcttgaactgactgactcatgccagccctacagaagtgccttttacgtattggagcaacagcgtgttggcttggctattgacatggatgaaattgaaaagtaccaagaagtggaagaagaccaagacccatcatgccccaggctcagcagggagctgctggatgagaaagagcctgaagtcttgcaggactcactggatagatgttattcgactccttcagattatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatattattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagatgacaacccaccatgccccaggtaactttcagcaattgtggatgcttaattctgtgttaacacctggaggcaacagattcagggaaaccagagtgtgtttgatgtcatgttttcaacgaaggctgaattactcctactgtcattgctgttggttttcattgcagtagatgtttaggtttccatttcttcctccccttatcatttactaacgtaccataggttgaccatacttcaaaagctgtactctgatggccactgcatcaaattttgagcatattttatgggaaactattgagctcactctttttgtgatcacagtttgctgtgtgtcatgagggcactaactcagagtgtccttttactcccttaccagtatgtcacctgggcaattcactagctcactttctctctgtctctgtctctgtctctctctctctgtctttctctttcattgttttctacctggccctgttctatcccaacataaaggcaataaattttttttttttacctcattaatgaatctatcctttttcttttctaaccacttccttatattacttctgaaatctagtggggctctgtggtgtctgattttccctggctgcttctttagttttgtctccttttccaggctcaacggcgtgctgatggaagtggaagagcctgaagtcttacaggactcactggatagatgttattcgactcagtcaatgtactttgaactacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagctcttactaagccgagagatgtcattcctgcaggcaggacctataggcacgagaagatttgaatgaaagtacagttccatttggaagcccagacataggatgggtcagtgagcatggctctattcctattctcaaaccatgccattggcaacctgtgctcaatctgaagacaatggacccatgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccattatgatatcagcactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttctggattgttttttacattcagtgttataatatttgattatgctgattggttttggtgggtactgatgcgaattaataaaaacatttcatttc

SEQ ID NO: 61285 - DNA, 3948 bp, Homo sapiens
caaaacaagagaacatactaaatgattctatttttttatttatgatttcatgactaccattaagaaaatataacctgttgggaaactgtttctgccttgatgatgttgtacagacaagagataaacagtgaggaatatgcttagatgtattgggaaagacacgggtctgtggcattgtcacaagggtacacgaatactgagagtgaatgctgaaggaatgatccccattggtggtgaccctcaggtgagactagggtgcctgtgtttcagcaaagcctgggcaattggaatgcagggctcctaagattccatgacacccccaccttctaattctgttttgcaactgcagacggttacctggcacgctggccacaatctacctcactcttatcagagtctgcgctactgacagtgctttcagctctgagttgaggcacctcgaaccttgtttttgtggtgaaggatcctaaagtgctgtggggagtgatcacatttttgacaacatccctgactccacctcttctgccacaaacgtcagcatggtggtatcagccggccctttgtccagcgagaaggcagagatgaacattctagaaatcaatgagaaattgcgcccccagttggcagagaagaaacagcagttcagaaacctcaaagagaaatgttttctaactcaactggccggcttcctggccaaccgacagaagaaatacaaatatgaagagtgcaaagatctcataaaatttatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactgacacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataagaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagagcctgaagtcttgcaggactcactggatagatgttattcaactccttcaggttgtcttgaactgactgactcatgccagccctacagaagtgccttttacgtattggagcaacagcgtgttggcttggctattgacatggatgaaattgaaaagtaccaagaagtggaagaagaccaagacccatcatgccccaggctcagcagggagctgctggatgagaaagagcctgaagtcttgcaggactcactggatagatgttattcgactccttcagattatcttgaactgcctgacttaggccagccctacagcagtgctgtttactcattggaggaacagtaccttggcttggctcttgacgtggacaaaattgaaaagaaggggaaggggaagaaaagaaggggaagaagatcaaagaagaaaagaagaaggggaagaaaagaaggggaagatgacaacccaccatgccccaggctcaacggcgtgctgatggaagtggaagagcctgaagtcttacaggactcactggatagatgttattcgactcagtcaatgtactttgaactacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagctcttactaagccgagagatgtcattcctgcaggcaggacctataggcacgagaagatttgaatgaaagtacagttccatttggaagcccagacataggatgggtcagtgagcatggctctattcctattctcaaaccatgccattggcaacctgtgctcaatctgaagacaatggacccatgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccattatgatatcagcactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttctggattgttttttacattcagtgttataatatttgattatgctgattggttttggtgggtactgatgcgaattaataaaaacatttcatttc

SEQ ID NO: 61286 - DNA, 2701 bp, Homo sapiens
tcccccaggagtcctgggatgaaggttattcgactctctcaattcctcctgaaatgacatcggtgggatcaagtgaaaaaggaggaccaagaggcaacaggtcccaggctcagcagggagctgctggatgagaaagagcctgaagtcttgcaggactcactggatagatgttattcaactccttcaggttgtcttgaactgactgactcatgccagccctacagaagtgccttttacgtattggagcaacagcgtgttggcttggctattgacatggatgaaattgaaaagtaccaagaagtggaagaagaccaagacccatcatgccccaggctcagcagggagctgctggatgagaaagagcctgaagtcttgcaggactcactggatagatgttattcgactccttcagattatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatattattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagatgacaacccaccatgccccaggctcaacggcgtgctgatggaagtggaagagcctgaagtcttacaggactcactggatagatgttattcgactcagtcaatgtactttgaactacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagctcttactaagccgagagatgtcattcctgcaggcaggacctataggcacgagaagatttgaatgaaagtacagttccatttggaagcccagacataggatgggtcagtgagcatggctctattcctattctcaaaccatgccattggcaacctgtgctcaatctgaagacaatggacccatgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccattatgatatcagcactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttctggattgttttttacattcagtgttataatatttgattatgctgattggttttggtgggtactgatgcgaattaataaaaacatttcatttc

SEQ ID NO: 61287 - DNA, 3205 bp, Homo sapiens
tgtgtcttctaagttcgcttgttttagctcatctgtccatcatgttcctggtacgttttctagataaacagctgacttttcacccacaaaagccataatagctgatgcttctgtgtagaaccaagtttcattttgactcaagagctggtacattgcaccccttcatcaaatctctgtgtccacaatctcataaactatcaaattctgggtatttaatgagagaaagcttaatattgaagtatctctcctatgaggtgttagaactatttgcctacaatttattggggaaaaaattgctcatttgtgtacataaacctaggacagagcacatagggaagataacattccaaaacaggggaattttgcccaaggctcatgaaagaacccaagccagttttctcaagacttgacctcaggcctactggaatatttctctcaaagtctcctgttctcacactgacaagactgatgtccctgtgttaggattggacagaggaatgtttctgtgtgcaaggaagaactgcttaatgtaagagggcccatctgaatttatttgcaggacatcggtgggatcaagtgaaaaaggaggaccaagaggcaacaggtcccaggctcagcagggagctgctggatgagaaagagcctgaagtcttgcaggactcactggatagatgttattcaactccttcaggttgtcttgaactgactgactcatgccagccctacagaagtgccttttacgtattggagcaacagcgtgttggcttggctattgacatggatgaaattgaaaagtaccaagaagtggaagaagaccaagacccatcatgccccaggctcagcagggagctgctggatgagaaagagcctgaagtcttgcaggactcactggatagatgttattcgactccttcagattatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatattattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagatgacaacccaccatgccccaggctcaacggcgtgctgatggaagtggaagagcctgaagtcttacaggactcactggatagatgttattcgactcagtcaatgtactttgaactacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagctcttactaagccgagagatgtcattcctgcaggcaggacctataggcacgagaagatttgaatgaaagtacagttccatttggaagcccagacataggatgggtcagtgagcatggctctattcctattctcaaaccatgccattggcaacctgtgctcaatctgaagacaatggacccatgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccattatgatatcagcactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttctggattgttttttacattcagtgttataatatttgattatgctgattggttttggtgggtactgatgcgaattaataaaaacatttcatttc

SEQ ID NO: 61288 - DNA, 6819 bp, Homo sapiens
caaaacaagagaacatactaaatgattctatttttttatttatgatttcatgactaccattaagaaaatataacctgttgggaaactgtttctgccttgatgatgttgtacagacaagagataaacagtgaggaatatgcttagatgtattgggaaagacacgggtctgtggcattgtcacaagggtacacgaatactgagagtgaatgctgaaggaatgatccccattggtggtgaccctcaggtgagactagggtgcctgtgtttcagcaaagcctgggcaattggaatgcagggctcctaagattccatgacacccccaccttctaattctgttttgcaactgcagacggttacctggcacgctggccacaatctacctcactcttatcagagtctgcgctactgacagtgctttcagctctgagttgaggcacctcgaaccttgtttttgtggtgaaggatcctaaagtgctgtggggagtgatcacatttttgacaacatccctgactccacctcttctgccacaaacgtcagcatggtggtatcagccggccctttgtccagcgagaaggcagagatgaacattctagaaatcaatgagaaattgcgcccccagttggcagagaagaaacagcagttcagaaacctcaaagagaaatgttttctaactcaactggccggcttcctggccaaccgacagaagaaatacaaatatgaagagtgcaaagatctcataaaatttatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactgacacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataagaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagagcctgaagtcttgcaggactcactggatagatgttattcaactccttcaggttgtcttgaactgactgactcatgccagccctacagaagtgccttttacgtattggagcaacagcgtgttggcttggctattgacatggatggtgagtacctttctatgaaggtgataaggatccactgagtcttctggttagggtcatattcctactgcaagtggcccttactgagctgagagatgtcattgccacagggaggacctataggcacatgtaggttgaatgaaactctagttccacttggaagcccagacaagggatgggtcagtgagcaaggctctcttcctagtctcaggccatgcctgtggcgccctaatcctactctcatgacgttggacctgggcagatgtgacaaattcacacaactctgattttgtctcaattttgtagatcttgtagatttcatccttcactctaatttcagcgtctaaaatccttgctaccatgaacaatctgagtatttgatgagacagggctgaatagtgcagtttttctcctagcaaccatttgggggcatttgctttaaatcgattggaaaaatatggcataaccatttgcacaaacttgggacaaatgatattgggataacgatctaccagaatagggaattttacccacagtttctgggacaaaaaccaaggaatctctatcgtgatcagccttcaggcctcttgaagaatatctctcacagtgtcctattctcatgctgaggagcctgaagtccctgtgtgaggattagacagtggattgttatgtgtgtaggagaaccagcttaatatgtctgtccatgtctgaacttattgcagaaattgaaaagtaccaagaagtggaagaagaccaagacccatcatgccccaggtaactttgagcaattatggatgcttaattgtgtgttgacacctggagatgccaggtccagggaaaacaagagtgtgttcaatttcatgttttcaacgaaggttgaattactcctcctgacattgctgttggttttcattgcagtagatgtttaggtttccatttcttcctccccttatcatttactaacttactataggttgaccatacctcaaaggctgtatggcaactgcatggaatcttgagcaagtttatggaaaattattgagcccactcttttcatgaccactgttcgctgtgtgtcccgagcgcactaactcagagtgtcctttgaccccttcatcagtgtgtcacccggccaattcgctgagctcactttctcctctctctctctctccctctccctgtctttctctttcattcttttctacctggccctggtctatcccaacataaaggcaataattcattacctcattaatggatccgtcctttttctttttaaacagttccttatgttagccatgaaatctagctggggctgtgtggtttctgattctccctggcttattctttactttttcctacttttccaggctcagcagggagctgctggatgagaaagagcctgaagtcttgcaggactcactggatagatgttattcgactccttcagattatcttgaactgcctgacttaggccagccctacagcagtgctgtttactcattggaggaacagtaccttggcttggctcttgacgtggacagtgagtaccttactgtgaaggtgataagcctccacctggtcttccagataggggtgatattcctgttccaagtggcccttactgacccgagagatgtcattgccgcaggcaggacctatgggcgcatataggttgtaatgaaactgttgtctcagttggaagcctagacatgaaatgggtcagtgagcaaggctctattcctagtctccagccatgcctgtggcaagctgagcccgctctcagcacattggacccaggcagatgtaaaaaattcacagaactatgatttggactcaagggtttgtagatttcctccttcattctaatttcagtgtctaaaattcttgcatccatgaacgagctgggcatttgatgagacagggctgaatactgcagttttcctcctagaaatcatctggggcattttctttgaactgatgggaacaataaggcataactgtttgcacaaacttgggataaatgattttgggataacgatctaccagaatggggatatttcacccttggttctgagatgcaaaccaaagaatatcatgaccagctttcaggcctcctgaagtatctctctcacattgtcctgttctcatgctgagaagcctgagatccctgtgtggggattagacagtggactgttatgggtgtaggtgaattggcttattttgtctgtccctgtctgaatgtattgcaggaattaaaaaggaccaagaagaggaagaagaccaaggcccaccatgccccaggtaactgagcaattgtgaacagctacttctgtgttgacatctggagactcctggttcagggaaaacagagcgggctgacattatcgattacatcttttccagcaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatcactgtatgctgtgtgtcctgagggcactaactcagagtgtcctgttactccctcatcagtgtgtcacctggacaattcactgagctcattctctctctctctctctgtgtgtgtgtgtgtgtgtgtctatctgtctttctctttcattcttttccatttggccctgttctgtcccaacatgaaggcaataatttgttacctcattaatggatctatccttttacttttttaaccacttccttatgctacccatgaaacctagttggggctctgttgtgtctgatttcccctggcttattctttactttttcctccttttccaggctcagcagggagctgctggaggtagtagagcctgaagtcttgcaggactcactggatagatattattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagatgacaacccaccatgccccaggctcaacggcgtgctgatggaagtggaagagcctgaagtcttacaggactcactggatagatgttattcgactcagtcaatgtactttgaactacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagctcttactaagccgagagatgtcattcctgcaggcaggacctataggcacgagaagatttgaatgaaagtacagttccatttggaagcccagacataggatgggtcagtgagcatggctctattcctattctcaaaccatgccattggcaacctgtgctcaatctgaagacaatggacccatgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccattatgatatcagcactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttctggattgttttttacattcagtgttataatatttgattatgctgattggttttggtgggtactgatgcgaattaataaaaacatttcatttc

SEQ ID NO: 61289 - DNA, 3861 bp, Homo sapiens
cagtcccatagtcctaggggccttcccgactgtacgagaaatcactacttcatgccccagtgcagtgttttagaggagaggctgcaaggcttgggaaagtggccccgcattcagagtcagacctcagggactgtgaattctgactccacttcgttgtggttgaatcatcttgtcaacttccttgatgtgcccttgaggttctctttcttcatctctaaattttggaggatcagatgccagaaagtcaggagactgaagagtaaagatgtggaaatccctgtctagaccctggtactggggagagttttgtccttgggatggacctggctcctgtcctgtaggcaatgaccacagcagcatgtccagccttccactgaggcaggcgtgtctgtcttttctcagaatatgaagagtgcaaagatctcataaaatttatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactgacacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataagaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagagcctgaagtcttgcaggactcactggatagatgttattcaactccttcaggttgtcttgaactgactgactcatgccagccctacagaagtgccttttacgtattggagcaacagcgtgttggcttggctattgacatggatgaaattgaaaagtaccaagaagtggaagaagaccaagacccatcatgccccaggctcagcagggagctgctggatgagaaagagcctgaagtcttgcaggactcactggatagatgttattcgactccttcagattatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatattattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagatgacaacccaccatgccccaggctcaacggcgtgctgatggaagtggaagagcctgaagtcttacaggactcactggatagatgttattcgactcagtcaatgtactttgaactacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagctcttactaagccgagagatgtcattcctgcaggcaggacctataggcacgagaagatttgaatgaaagtacagttccatttggaagcccagacataggatgggtcagtgagcatggctctattcctattctcaaaccatgccattggcaacctgtgctcaatctgaagacaatggacccatgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccattatgatatcagcactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttctggattgttttttacattcagtgttataatatttgattatgctgattggttttggtgggtactgatgcgaattaataaaaacatttcatttc

SEQ ID NO: 61290 - DNA, 546 bp, Homo sapiens
atgggggtgccagggcacaggaaccctccccagacccacactaagccacctgcggagacggtgcagctggagctggacgaggtgctgggtgctgccccggttgtctgctatgaagaccgcaagcgactgccttacaccatgctgtcctccatgacgtgcagcgcctcagcagcgtcatggccatggggcaccatcatcttacccaacctggcctctgtgctctatgaccctgagtgctgggagacccctcgacagttcaaccctggccacttctcggacaaggatggaaactttgtggccaatgaggccttcctgccattctctgcagggcatcgtgtctacccagcagaccagctggctcaaatggagctcttcctgatgtttgccaccctcctcaggacctttcggttccaactgccagaagggagcccggggctcaagctggagtacatctttggcggcacttggcaaccccagccccaggagatctgcgcagtgccccgcctgagcagccccagccctggtcctagggaggatggcctgtag

SEQ ID NO: 61291 - DNA, 546 bp, Homo sapiens; identical to SEQ ID NO: 61290

SEQ ID NO: 61292 - DNA, 3781 bp, Homo sapiens
atgacctctggtcctggaactactcccagccctcacaacctctgctcctacaaccagcacaacctctgcctctacagccagcacaacctctgccctgttcccaccaccagcacaacctctgctcctacaaccagcacgacctctggtcctggaactactcccagccccgttcccaccaccagcacaacccctgtttcaaagaccagcacaagccatctttctgtatccaagacaacccactcccaaccagtcaccagtgactgtcatcctctgtgcgcctggacaaagtggttcgacgtggacttcccatcccctggaccccacggcggggacaaggaaacctacaacaacatcatcaggagtggggaaaaaatctgccgccgacctgaggagatcaccaggctccagtgccgagccgagagccacccggaggtgaacattgaacacctgggtcaggtggtgcagtgcagccgtgaagagggcctggtgtgccggaaccaggaccagcagggacccttcaagatgtgcctcaactacgaggtgcgcgtgctctgctgcgagacccccagaggctgcccggtgacctctgtgaccccatatgggacttctcctaccaatgctctgtatccttccctgtctacttccatggtatccgcctccgtggcatccacctctgtggcatccagctctgtggcatccagctctgtggcttactccacccaaacctgcttctgcaacgtggctgaccggctctaccctgcaggatccaccatataccgccacagagacctcgctggccattgctattatgccctgtgtagccaggactgccaagtggtcagaggggttgacagtgactgtccgtccaccacgctgcctcctgccccagccacgtccccttcaatatccacctccgagcccgtcactgagctgggatgcccaaatgcggttccccccagaaagaaaggtgagacctgggccacacccaactgctccgaggccacctgtgagggcaacaacgtcatctccctgcgcccgcgcacgtgcccgagggtggagaagcccacttgtgccaacggctacccggctgtgaaggtggctgaccaagatggctgctgccatcactaccagtgccagtgtgtgtgcagcggctggggtgacccccactacatcaccttcgacggcacctactacaccttcctggacaactgcacgtacgtgctggtgcagcagattgtgcccgtgtatggccacttccgcgtgctcgtcgacaactacttctgcggtgcggaggacgggctctcctgcccgaggtccatcatcctggagtaccaccaggaccgcgtggtgctgacccgcaagccagtccacggggtgatgacaaacgagatcatcttcaacaacaaggtggtcagccccggcttccggaaaaacggcatcgtggtctcgcgcatcggcgtcaagatgtacgcgaccatcccggagctgggagtccaggtcatgttctccggcctcatcttctccgtggaggtgcccttcagcaagtttgccaacaacaccgagggccagtgcggcacttgcaccaacgacaggaaggatgagtgccgcacgcctagggggacggtggtcgcttcctgctccgagatgtccggctctggaacgtgagcataccctgaccagccagcctgccaccggcctcacccgacgcccaccacggtcgggcccaccacagttgggtctaccacggtcgggcccaccacagttgggtctaccacggtcgggcccaccacaccgcctgctccgtgcctgccatcacccatctgccagctgattctgagcaaggtctttgagccgtgccacactgtgatccccccactgctgttctatgagggctgcgtctttgaccggtgccacatgacggacctggatgtggtgtgctccagcctggagctgtacgcggcactctgtgcgtcccacgacatctgcatcgattggagaggccggaccggccacatgtgcccattcacctgcccagccgacaaggtgtaccagccctgcggcccgagcaacccctcctactgctacgggaatgacagcgccagcctcggggctctgccggaggccggccccatcaccgaaggctgcttctgtccggagggcatgaccctcttcagcaccagtgcccaagtctgcgtgcccacgggctgccccaggtgtctggggccccacggagagccggtgaaggtgggccacaccgtcggcatggactgccaggagtgcacgtgtgaggcggccacgtggacgctgacctgccgacccaagctctgcccgctgccccctgcctgccccctgcccggcttcgtgcctgtgcctgcagccccacaggccggccagtgctgcccccagtacagctgcgcctgcaacaccagccgctgccccgcgcccgtgggctgtcctgagggcgcccgcgcgatcccgacctaccaggagggggcctgctgcccagtccaaaactgcagctggacagtgtgcagcatcaacgggaccctgtaccagcccggcgccgtggtctcctcgagcctgtgcgaaacctgcaggtgtgagctgccgggtggccccccatcggacgcgtttgtggtcagctgtgagacccagatctgcaacacacactgccctgtgggcttcgagtaccaggagcagagcgggcagtgctgtggcacctgtgtgcaggtcgcctgtgtcaccaacaccagcaagagccccgcccacctcttctaccctggcgagacctggtcagacgcagggaaccactgtgtgacccaccagtgtgagaagcaccaggatgggctcgtggtggtcaccacgaagaaggcgtgccccccgctcagctgttctctggacgaggcccgcatgagcaaggacggctgctgccgcttctgcccgccgcccccgcccccgtaccagaaccagtcgacctgtgctgtgtaccataggagcctgatcatccagcagcagggctgcagctcctcggagcccgtgcgcctggcttactgccgggggaactgtggggacagctcttccatgtactcgctcgagggcaacacggtggagcacaggtgccagtgctgccaggagctgcggacctcgctgaggaatgtgaccctgcactgcaccgacggctccagccgggccttcagctacaccgaggtggaagagtgcggctgcatgggccggcggtgccctgcgccgggcgacacccagcactcggaggaggcggaacccgagcccagccaggaggcagagagtgggagctgggagagaggcgtcccagtgtcccccatgcactgaccagcactgccgccctcctgacctccaaggagaacctcccatatgtcctctgagctcggcttccaaggccagtggaacttgtgcccctgtccaggcggctgcagctttgaacacactgtccacgcccgctttcttgtggagggtgtgggctatgggtcacctgctgcctggaggaggggcccttacccaccccgcctgcagccacctctcaggaccagccccggggctggccgagctcctctggccatgcatccagcctgctgttctggggacgtgagcatcacctgagggtctcaggaatgacgcttggacatggtgatcagctgcctggtggctgcaggaggaagaacctcactcctacctcagccctcagcctgcgctcccctcctcagtacatggccagtctgttgcataaatacacttgagcattttg

SEQ ID NO: 61293 - DNA, 5022 bp, Homo sapiens
atggatggcagcagcaggcctgccgggcccagcgcgagctcctctccactgtgcaccatggtccagcggtggctgctgctgtcctgctgcggagccctgctcagcgctggtctggctaacacctcctacaccagcccaggcctccagaggctgaaggactctccacagacagccccggacaaaggccagtgctccacgtggggggctggtcacttctccaccttcgaccaccacgtgtacgacttctcggggacgtgcaactacatcttcgcggccacctgcaaggacgccttccccaccttcagtgtccagctgcggcgaggcccagacgggagcatctcgcggatcatcgtggagctgggggcctccgtcgtcactgtgagcgaagccatcatctcagtcaaggacatcggggtcatcagcctgccctataccagcaatggactccagatcacacccttcggccagagcgtgcggctggtggccaagcagctggagctggagctggaagtcgtgtggggtcctgacagccacctcatggttctggtggagcggaagtacatgggtcagatgtgcgggctctgcgggaactttgacgggaaggtgaccaacgagtttgtcagtgaggagggcaagttcctggaaccccacaagtttgctgccctccagaagctggacgaccccggcgagatctgcaccttccaggacatccccagcacccacgtccggcaggcccagcacgcccggatctgcacccagctgctgaccctggtggcccctgagtgcagcgtgtccaaggagcccttcgtgctaagctgccaggcggacgtggccgcagccccccagccaggcccacagaacagcagttgtgccaccctgtcggagtactcccgccagtgcagcatggtgggccagccggtccgccgctggcggagccccggcctgtgctccgtgggtcagtgcccggccaaccaggtgtaccaggagtgcggctcggcctgcgtgaagacctgctccaacccgcagcacagctgctccagctcctgcaccttcgggtgcttctgcccggaaggtacggtcctgaatgacctctccaataaccacacctgcgtgcccgtcacccagtgcccctgtgtgctccacggcgccatgtatgcccccggggaggtcacaatagctgcctgccaaacctgccggtgcaccctgggccgctgggtgtgcacggagcggccgtgccccggacactgctccctggaaggtggctcctttgttaccacatttgacgccaggccctaccgcttccacggcacctgcacctacatcctcctccagagcccccagcttcccgaggacggtgccctcatggctgtgtacgacaagtccggcgtctcacactccgagacctccctggtggctgtggtctacctctccaggcaggacaaaattgtgatctctcaggacgaggtggtcaccaacaacggagaagccaagtggctgccatacaagactcgcaacatcacggtcttcaggcagacgtccacccacctccagatggccaccagcttcgggctggagctcgtggtccagctgcgccccatcttccaggcctatgtcactgttgggccccagttcagaggtcagaccagagggctctgcggcaacttcaacggggacacaacggatgacttcaccactagcatgggtatcgccgagggcaccgcctcgctgtttgtggactcctggcgggcggggaactgtccggccgctctggagcgtgagactgacccctgctccatgagccagctcaacaaggtgtgtgcagagacccactgctccatgctgctgaggacaggcacggtgttcgagaggtgccacgccacagtgaaccctgcacccttctacaagaggtgcgtgtaccaggcctgcaactacgaggagacctttccccacatctgtgccgccctgggcgactacgtacacgcctgctccttgcggggcgtcctgctctggggctggagaagcagtgtggacaactgcaccatcccctgcacgggtaacaccaccttcagctacaacagccaagcctgtgagcgcacctgcctgtcgctgtcggaccgtgccaccgagtgccaccacagcgccgtgcccgtggacggttgcaactgccccgatggcacctacctgaaccaaaagggcgagtgtgtgcgcaaggcccagtgcccgtgcatactggagggttacaagttcatcctggccgagcagtccactgtcatcaacggcatcacctgccactgcatcaacgggcggctgagttgcccgcagcggccacagatgttcctggcctcctgccaggcccctaagaccttcaagtcctgcagccagtcctccgagaacaagtttggggcagcctgtgcccccacatgccagatgctggccaccggtgttgcctgcgtgcccaccaagtgtgagcctggctgtgtctgcgccgagggcctctacgagaatgccgacgggcagtgtgtgccccccgaggagtgcccatgtgagttctcgggggtctcctaccctggaggagctgagctccacactgactgcaggacctgctcctgctcaagggggaggtgggcctgtcagcagggcacccactgcccatccacctgcaccctctacggggagggccacgtcatcaccttcgacggccagcgcttcgtattcgacggcaactgcgagtacatcctggccacggacgtctgtggtgtcaacgactcacagcccaccttcaagatcctgacagagaacgtcatctgtgggaactccggggtcacatgctcacgggccatcaagatcttcctggggggcctgtccgtggtgctggcggacagaaactacacggtcaccggggaggagccccacgtgcagctcggggtgacgccgggtgcgctgagccttgtcgtggacatcagcatccccgggaggtacaacctgacgctcatctggaacaggcacatgaccatcctcatcaggatcgcccgtgcctcccaggatcccctctgcggcttgtgtggcaacttcaacgggaacatgaaggacgacttcgagacgcgcagcaggtacgtggcatccagcgagctggagttggtgaactcgtggaaggagagcccgctgtgcggggacgtgagcttcgtgacagacccctgcagtctcaatgccttccggcgctcctgggccgagcgcaagtgcagcgtcatcaacagccagacctttgccacctgccacagcaaggtataccacctgccctactacgaggcctgcgtgcgcgacgcatgtgggtgtgacagtggcggggactgtgagtgtctgtgcgatgccgtggctgcctacgcccaagcctgtctggacaagggtgtgtgcgtggactggaggaccccggccttctgccccatctactgcggcttctacaacacgcacacgcaggacggccatggcgagtaccagtacacacaggaggccaactgcacgtggcactaccagccctgcctctgccccagccagccacagagcgtcccaggcagcaacatcgaaggctgctacaactgctcccaggatgagtacttcgaccacgaggagggggtgtgcgtgccctgcatgccgcccaccacgccgcagccacccaccacgccgcagctgcccaccacaggctcacggcccacgcaagtctggcccatgacgggaacctccaccaccatcgggcttctcagctccaccggaccctcacccagctctaatcacacccctgccagccccacccagacacccctccttccagccacgctcacatcctccaagcccacagcctcctcgggagaaccacctagaccaaccacggccgtcaccccacaagccacatcagggctgcctcccacagccacactgagatcgacagccacaaaacccacagtgacccaggccacaaccagggccacggcgtcgaccgccagcccagccacgacgtccacagctcagtccacaacacggaccacaatgacactaccaaccccagccacatcagggacaagccccacgctgccaaaatcgaccaatcaggaactgccaggaacaacggccacccagacgacaggcccacgtccaaccccagcaagcaccacaggcccaaccaccccacagccaggacaacccacgaggcccacagccacagagaccactcaaacaagaacgactactgaatacacaacgccccaaaccccacacaccacacactccccgcctacggcggggagtcccgtcccttccacaggtcctgtcactgcaacatctttccatgccaccactacctatccaaccccatcacaccctgagaccacacttcccactcacgttccacctttctccacctccttggtgactccaagtactcacacagtcatcacccctacccacgcacagatggccacatctgcctccaaccactcagcgccaacaggtaccattcctccaccaacaacgctcaaggccacagggtccacccacacagccccaccaataacgccgaccaccagtgggaccagccaagcccacagctcattcagcacaaacaaaacacctacctcgctacattcacacacttcctccacacaccatcctgaagtcaccccaacttctactaccacgattactcccaaccccactagtacacgcaccagaacccctgtggcccacaccaactcagccaccagcagcaggccaccaccacccttcaccacacactccccacctacagggagcagtcccttctcttccacagatggccacttctgcctccatccactcaatgccaacaggcacgattcctccaccgacaacgctcaaggccacagggtccacccacacagcgccaacaatgacgctgaccaccagcgggaccagccaagccctgagctcattaaacacagccaaaacctctacatccctacattcacacacttcctccacacaccatgctga

SEQ ID NO: 61294 - DNA, 2430 bp, Homo sapiens
catctttctccacctccttggtgactccaagtactcacatagtcatcacccctacccacgcacagatggccacttctgcctccatccactcaatgccaacaggcaccattcctccaccgaccacgatcaaggccacagggtccacccacacagccccaccaatgacaccgaccaccagtgggaccagccaatccccaagctcatttagcacggccaaaacttctacatccctaccttaccacacttcctcaacacaccatcctgaagtcaccccaacttctaccaccaacatcacccccaaacacaccagtacaggcaccagaacccctgtggcccacaccacctcggccagcagcagcaggctacccacacccttcaccacacactccccacctacagggagcagtcccttctcttccacaggtcctatgactgcaacatccttccagaccaccactacctatccaaccccatcacaccctcagaccacacttcccactcacgttccacctttctccacctccttggtgactccaagtactcacacagtcatcatcactacccacacacagatggccacttctgcctccatccactcaacgccaacaggcaccgttcctccaccaacaacgctcaaggccacagggtccacccacacagccccaccaatgacagtgaccaccagtgggaccagccaaacccacagctcattcagcacagctacagcctcttcttccttcatatcctcctcgtcttggctgcctcagaactctagctcaaggccaccgtcatcacctatcaccacacaactcccccacttgagttctgcaaccactcctgtttccacaactaatcagctgtcctcctcattttctcccagtccttctgccccctctactgtttcttcttatgtgccctcctcccactcctctccccagacttcatcgccttctgttggcacatcttcctctttcgtgtccgcccccgtgcactccacaaccctgagctcggggtcacactcctcattgtccactcatcccacgactgcatcagtgtctgcatctcctctttttccttcttctccagctgcctctactaccattagggccactctcccccacactatctcctctcctttcaccctctctgctctactccccatatccactgttaccgtgtctcccaccccatccagccacctagcctccagcaccattgcatttccgtccacgcccaggaccacggccagcacccacaccgcccctgccttctcctctcagtccaccacctcgcggtccacttctctcaccacccgagttcccacatcaggctttgtgtcactcacctcgggggtgacgggtatccccacctctccagtcaccaaccttaccaccaggcaccctggtcccaccttgtcgcctaccacacggttcctgaccagctccctcactgcccatggaagcacccctgcttctgccccggtatcttctctcgggacacctacgcccacctcacccggggtctgcagtgtgcgggagcagcaggaggagatcacgttcaaggggtgcatggcgaacgtgacggtaacccgctgtgagggcgcctgcatttccgctgccagcttcaacatcatcacccagcaggtggatgcccgctgcagctgctgccgccccctccactcctatgagcagcagctggagctgccctgccccgatcccagcacgcctggccggcggctcgtactcaccctgcaggtgttcagccactgcgtgtgcagctctgtggcctgtggagactagcagggtcgctgcctgctctcctggggctgaaggactgcagatgacagacaggaaaacacccaccagcccccttcccgcttgtgccagcagctgctttcctggtcaccaggcctggcccccaagtgccctgggccgtggctccctggggcaccggttggagaggggctgccaagcaggggctcagactaccacactcctgcagaccctgagccagcagagagggactgaggcggacagtggtcacggacctcccaggcacacagggcactcccgaccacccctgcccaccgtccaacacctcccagcccctgaacttggccccagccctgctgggcccagaaccctgcagatgaagccacagagcaggcgctcgaccagacccatcaggggcgaggagggcacggaaacctgtgccgagatgggggcaagaggcccaggcagccaccagcacagagaagaggagatccccagagtcagggagggcagagggtggcagcgagggcagggcagccgcccccgctcccagccaggcagaaggcccccaccagcaccacacccatccccagcagcctgtccttgggagagggcgtcacccggtcagagactccaaataaaccggttcttgtcaagg

SEQ ID NO: 61295 - DNA, 1702 bp, Homo sapiens
ccatcacccccaaccacaccagtacaggcaccagaacccctgtggcccacaccacctcggccaccagcagcaggctacccatacccttcaccacacattccccacctacagggagcagtcccatctcttccacaggtcctatgactgcaacatccttctgccccctctactgtttcttcttatgtgccctcctcccactcctctccccagacttcatcgccttctgttggcacatcttcctctttcgtgtccgcccccgtgcactccacaaccctgagctcggggtcacactcctcattgtccactcatcccacgactgcatcagtgtctgcatctcctctttttccttcttctccagctgcctctactaccattagggccactctcccccacactatctcctctcctttcaccctctctgctctactccccatatccactgttaccgtgtctcccaccccatccagccacctagcctccagcaccattgcatttccgtccacgcccaggaccacggccagcacccacaccgcccctgccttctcctctcagtccaccacctcgcggtccacttctctcaccacccgagttcccacatcaggctttgtgtcactcacctcgggggtgacgggtatccccacctctccagtcaccaaccttaccaccaggcaccctggtcccaccttgtcgcctaccacacggttcctgaccagctccctcactgcccatggaagcacccctgcttctgccccggtatcttctctcgggacacctacgcccacctcacccggggtctgcagtgtgcgggagcagcaggaggagatcacgttcaaggggtgcatggcgaacgtgacggtaacccgctgtgagggcgcctgcatttccgctgccagcttcaacatcatcacccagcaggtggatgcccgctgcagctgctgccgccccctccactcctatgagcagcagctggagctgccctgccccgatcccagcacgcctggccggcggctcgtactcaccctgcaggtgttcagccactgcgtgtgcagctctgtggcctgtggagactagcagggtcgctgcctgctctcctggggctgaaggactgcagatgacagacaggaaaacacccaccagcccccttcccgcttgtgccagcagctgctttcctggtcaccaggcctggcccccaagtgccctgggccgtggctccctggggcaccggttggagaggggctgccaagcaggggctcagactaccacactcctgcagaccctgagccagcagagagggactgaggcggacagtggtcacggacctcccaggcacacagggcactcccgaccacccctgcccaccgtccaacacctcccagcccctgaacttggccccagccctgctgggcccagaaccctgcagatgaagccacagagcaggcgctcgaccagacccatcaggggcgaggagggcacggaaacctgtgccgagatgggggcaagaggcccaggcagccaccagcacagagaagaggagatccccagagtcagggagggcagagggtggcagcgagggcagggcagccgcccccgctcccagccaggcagaaggcccccaccagcaccacacccatccccagcagcctgtccttgggagagggcgtcacccggtcagagactccaaataaaccggttcttgtcaagg

SEQ ID NO: 61296 - DNA, 5561 bp, Homo sapiens
ggtgcggcagcgcgaagcctgcagtcctaaacgcggggtagctccgggcttccgagggggtgtgtctcccgcctctttaacctggcaggggcggttcaagtggccggggaaatcagcgaattgcagggtcaagggctggtgctttgaaagagaggcggaggggagagagggattttcccgtccccgctgcgctctgtcctccattactccttttctcggcccgcggcccgaacccgctgtgcggtagaggcagccgggtccctttaaggcccagctgcgcctgtgccttgggctctcctgacacggcccatccggaccctgaggagccagcgggccgcaagcaagttgctgggcggcggtggagatagcggcggtgctgggaggggtaggtgagggtcgcgaggctgcctgagcttctgagtgagcctggtgattttgggaacgcgggacgggcgacctgcggcgccaggagcggggccgaggtacggcggcacggctgcagcctggatgggaagttcaagtttactgcgaagtccacccagcgttccggaggtgagggcgccgcgccaggccgggcgggaggcattctgaaggcaaatcctgtttagacccaggcaaaggttcctggtgacccaggctctcatgagcagattgtcccttatcattctcctgaggatgtctggagcttcagtgctgtgtgctcttggcctccacactgggggtgccaccaactcccactgtccagggcttctggtggactctccgaggcaccgatgtagaaacttacccattcagtgcaccaagagcagcttcacatggtgtgggccgacatgaagagctgccagatccaacagaaatgtgattgataacagtaaagccacactcctcaagtgcctgaaatacccctcattgtcttcttcaggtggcaagggctctggaacagccacataaagcccttgaagataaggatggtcaaacaaaataatatcatacctggagaaactcagatcttgctaagatttactggttgggaatccaaagttaatgccaagaagcagctgccagttgggatcaaatgtgagcctatggatcaagacggttacctggcacgctggccacaatctacctcactcttatcagagtctgagcagtgctttcagctctgagttgaggcacctcgaaccttgtttttgtggtgaaggatcctaaagtgctgtggggagtgatcacatttttcacaacatccctgactccacctcttctgccacaaacgtcagcatggtggtatcagccggcccttggtccagcgagaaggcagagatgaacattctagaaatcaacgagaaattgcgcccccagttggcagagaacaaacagcagttcagaaacctcaaagagagatgttttctaactcaactggccggcttcctggccaaccgacagaagaaatacaagtatgaagagtgtaaagacctcataaaatttatgctgaggaatgagcgacagttcaaggaggagaagcttgcagagcagctgaagcaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggatgagaaagtactggaatcatctgcccccagggaggtgcagaaggctgaagagagcaaagtccctgaggactcactggaggaatgtgccatcacttgttcaaatagccacggcccttgtgactccatccagcctcacaagaacatcaaaatcacatttgaggaagacaaagtcaactcatctctggttgtagacagagaatcctctcatgatggatgtcaggatgctctaaacattctcccagtccctggccccacctcttctgccacaaacgtcagcatggtggtatcagccggccctttgtccagcgagaaggcagagatgaacattctagaaatcaatgagaaattgtgcccccagctggcagagaagaaacagcagttcagaagcctcaaagagaaatgttttgtaactcaagtggcctgcttcctggccaagcagcagaacaaatacaaatatgaagagtgcaaagacctcataaaatctatgctgaggaatgagcgacagttcaaggaggagaagcttgcagagcagctgaagcaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgataacgatgacgatgaagatgttcaagttgaggtggctgagaaagtgcagaaatcgtcttcccccagggagatgcagaaggctgaagaaaaggaagtccctgaggactcactggaggagtgtgccatcacttgttcaaatagccatggcccttatgactccaaccagccacatagaaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaaggacatcggtgggatcaagtgaaaaaggaggaccaagaggcaacaggtcccaggctcagcagggagctgctggatgagaaagagcctgaagtcttgcaggactcactggatagatgttattcaactccttcagtttatcttggactgactgactcatgccagccctacagaagtgccttttacgtattggagcaacagcgtattggcttggctgttgacatggatgaaattgaaaagtaccaagaagtggaagaagaccaagacccatcatgccccaggctcagcagggagctgctggctgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccgtgccccaggctcagcagggagctgctggaggtagtagagcctgaagtcttgcaggactcactggatgttattcaactccttccagttgtcttgaacagcctgactcctgccagccctacggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcagcagcgtgctgatggaagtggaagtgcctgaagtcttacaggactcactggatagatattattcgactccatcaatgtactttgaactacctgactcattccagcactacagaagtgtgttttactcatttgaggaacagcacatcagctttgcccttgacatggacaataggttttttactttgacggtgagaagtctccacctggtcttccagatgggagtcatattcccacaataagcagcccttactaagccgagaggtgtcattcctgcaggcaggacctataggcacctgaagatttgaatgaaactatagttccatttggaagcccagacataggatgggtcagtgggcatggctctattcctattctcagagcatgccagtggcaacctgtgctcagtctgaagacaatggacccacgttaggtgtgacacgttcacataactgtgcagcacatgccgggagtgatcagtcggacattttaatttgaaccacgtatctctgggtagctacaaaattcctcagggatttcattttgcaggcatgtctctgagcttctatacctgctcaaggtcagtgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgagcaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttgaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaactttttgacgggaacactgcagagacaatgctgtgagtttccaacctcagcccatctgcgggcagagaaggtctagtttgtccaacaccattatgatatcaggactggttacttggttaaggaggggtctaggagatctgtcccttttagagacaccttacttataatgaagtacttgggaaagtggttttcaagagtataaatatcctgtattctaatgatcatcctctaaacattttatcatttattaatcctccctgcctgtgtctattattatattcatatctctacgctgcaaattttgggtctcaatttttactgtgcctttgtttttactagtgtctgctgttgcaaaaagaagaaaacattctttgcctgagttttaatttttgtccaaagttaattttaatctatacaattaaaaccttttgcctatcaaaaaaaaaaaaaaaaaaaaa

SEQ ID NO: 61297 - DNA, 1578 bp, Homo sapiens
atgttggcttttctcttgacgtgggaggtgaaaggggaagaagatcaaaacccaccatgccccaggctcagcagggagctgctggctgagaaagagcctgaagtcttgcaggactcactggatagatggtattcgactccttcagtttatcttggactgactgacccatgccagccctacagaagtgccttttacgtattggagcaacagcgtgttggcttggctgttgacatggatgaaattgaaaagtaccaagaagtggaagaagaccaagacccatcatgccccaggctcagcagggagctgctggctgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctacagaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcaacagcgtgctgatggaagtggaagagcctgaagtcttgcaggactcactggatagatgttattcgactccatcaatgtactttgaactacctgactcattccagcactacagaagtgtgttttactcatttgaggaacagcacatcacctttgcccttgacatggacaatagcttttttactttgacggtgacaagtctccacctggtcttccagatgggagtcatattcccacaataagcagcccttactaagccgagaggtgtcattcctgcaggcaggacctataggcacctgaagatttgaatgaaactatagttccatttggaagcccagacataggatgggtcagtgggcatggctctattcctattctcagagcatgccagtggcaacctgtgctcagtctgaagacaatggacccacgttaggtgtgacacgttcacataactgtgcagcacatgccgggagtgatcagccggacattttaatttgaaccatgtatctctgggtagctacaaaattcctcagggatttcattttgcaggcatgtctctgagcttctatacctactcaagtgtctgctgttgcaaaaagaagaaaacattctctgcctgagttttaatttttgtccaaagttaattttaatctatacaattaaaaccttttgcctatcactctggacttttggattgttttttacattcagtgttataatatttgattatgctgattggttttggtgggtactgatgtgaattaataaaaacatttcat

SEQ ID NO: 61298 - DNA, 4046 bp, Homo sapiens
ccaactcccactgtccagggcttccagtggactctccgaggtactgatgtagaaacttccccattcggtgcaccaagagcaacctcacacggtgtgggctgaatgaagagctgccagatcccacaggtggcaagggctctggaacagccacataaagcccttgaagataaggatggtcaaacaaaataatatcatacctggagaaactcagatcttggtaagatttactggttgggaatccaaagttaatgccaagaagcagccgccagttgggatcaaatgtgagcctatggatcaagacggttacctggcacgctggccacaatctacctcactcttatcagagtctgcgctactgacagtgctttcagctctgagttgaggcacctcgaaccttgtttttgtggtgaaggatcctaaagtgctgtggggagtgatcacatttttgacaacatccctgactccacctcttctgccacaaacgtcagcatggtggtatcagccggccctttgtccagcgagaaggcagagatgaacattctagaaatcaatgagaaattgcgcccccagttggcagagaagaaacagcagttcagaaacctcaaagagaaatgttttctaactcaactggccggcttcctggccaaccgacagaagaaatacaaatatgaagagtgcaaagatctcataaaatttatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactgacacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataagaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagagcctgaagtcttgcaggactcactggatagatgttattcaactccttcaggttgtcttgaactgactgactcatgccagccctacagaagtgccttttacgtattggagcaacagcgtgttggcttggctattgacatggatgaaattgaaaagtaccaagaagtggaagaagaccaagacccatcatgccccaggctcagcagggagctgctggatgagaaagagcctgaagtcttgcaggactcactggatagatgttattcaactccttcagattatcttgaactgcctgacttaggccagccctacagcagtgctgtttactcattggaggaacagtaccttggcttggctcttgccgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagatgacaacccaccatgccccaggctctacggcgtgctgatggaagtggaagagcctgaagtcttacaggactcactggatagatgttattcgactccgtcaatgtactttgaacaacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagctcttactaagccgagagatgtcattcctgcaggcaggacctataggcacgagaagatttgaatgaaagtacagttccatttggaagcccagacataggatgggtcagtgagcatggctctattcctattctcaaaccatgccattggcaacctgtgctcaatctgaagacaatggacccatgttaggtgtgacacgttcacataactgtgcagaacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacattttgccgggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcaaaaaaaaaaaaaaaaaaaaaaaaaaa

SEQ ID NO: 61299 - DNA, 2195 bp, Homo sapiens
gcctctgtgtgcccaggaagggacttcatttctgcctgtggattctttagaatgcccagtcgtctgcgggtcctgccctgatcacaaggagaagccaggagcctcctcttcaggctacaaccttccttcttaagggccacagagtttgtggccccacccccagcacagccccaccttggccccaggaaccctgggagtggccttggcttcctgcaggacagccatggacctactctggatgcccctgctgctggtggccgcttgtgtctctgctgtccacagctcaccagaggttaacgccggtgtttccagcatccacataaccaagcctgtgcacatcctggaggaacgcagtctcctagtgctaacgcccgctggcctgacccagatgctgaaccagacccgcttcctcatggtgcttttccacaacccatcctcaaagcaatccaggaacttggcggaagagctgggcaaagctgtggagatcatgggcaaaggcaagaatgggatcggctttggcaaagtggacattaccatagagaaggagcttcagcaggagtttgggattaccaaggccccggagttgaagctgttttttgagggcaacaggtcagagcccatcagctgcaaaggagtggttgaatctgctgccttagtcgtttggttgagacgacaaattagccagaaagcatttttgttcaacagcagcgagcaggtggcagagtttgtgatatccaggcccttggtcatcgttggcttcttccaggatttagaggaagaagtagcagagttgttctatgatgtgatcaaagactttccagagctaacgtttggagtcataacgattggcaatgtcattgggcgtttccacgtcacccttgacagcgtcctggtgttcaaaaagggaaaaattgtgaaccgccaaaagcttattaatgacagtaccaacaaacaggaactcaatcgtgtcataaaacagcaccttacagattttgtgatcgaatacaacactgagaataaggatctgatttccgagttgcacatcatgagtcacatgctgctgtttgtctccaaaagctccgagtcatatggtatcataattcagcattataagctggcatcaaaggaattccaaaacaagatccttttcatccttgtggatgcagacgaacccagaaatggacgtgtcttcaagtacttccgggtcacagaggtcgatatcccatccgtccaaatcctaaacttgagctctgacgccaggtacaaaatgccttcagatgacataacctacgaaagcctcaagaaatttggccgcagcttcctgagtaaaaatgccacaaaacatcaatccagtgaagagattccaaaatactgggaccagggactggttaagcagctcgtggggaagaacttcaacgtagtcgtctttgacaaagaaaaggacgtatttgtgatgttctatgcaccctggtctaaaaagtgcaagatgctgttcccactgttggaggaattgggcagaaaatatcaaaaccactccacaattatcattgccaagatcgatgtcacagcaaatgacattcagctgatgtacctggaccggtacccattcttcaggctgttccccagcggctctcaacaagctgtcctgtataagggagaacacaccctgaagggcttctctgacttcctggaaagccacatcaaaactaagattgaggatgaggatgagctgttgtctgttgagcaaaatgaagtgatagaagaggaagtgctagctgaggaaaaggaggtgcctatgatgaggaaagggttacctgaacagcagtcgcctgagctggagaacatgaccaagtacgtatccaagctggaagagcccgctgggaagaagaaaacatctgaggaggtggtggtggtggtggctaagccaaagggacctccagtgcaaaagaagaaaccaaaagtcaaggaagaactttagcttctccaataccaggaaaaaagatgcttattttccagatcctggcatcattttctgaatggattgattccaataaaagcatatatcattgtggtagggtaggtggggcgggggtaggggtggataataaagcctctgagtgtccttggaaaaaaaaaaaaaaaaaaaaaaaaaaaaaaaaaaaaaaaaaaaaaaaaaaaaaaaaaaaaaaaaaaaa
